United States Patent 10,407,724 (METHODS AND COMPOSITIONS FOR SCREENING AND TREATING DEVELOPMENTAL DISORDERS) - sequence listing, part 82

SEQ ID NO: 2395 - DNA, 802742 bp, Homo sapiens
gggcactctttaatgaagaaacaccagagctgttaaacacattgagacacagaagattctagtgactgaggatggcttcctcttggaaactaatgctgtttctgtcagtcaccatgtgtctttcaggtaaaagtcctgattaattaattatttgattttctaagtatcaaaataaccaaaatatatcaaggtctccattacaaaatatcctcaggtattaatttaaatttatatcagtatttatactttccaacaagagaaaggcagcaacccttaagccgctgttaacattgcaaaatgccatatacaatttaatataataaggtacactataaatgttaataaaatgagtatttacctccttgacattcatttgcaatctaaaccatctagctttcagaaggcttggaaatatatatatatatatatatatatatatatatatatatatctcccacacatatatacatacatatgtgcatatatttatgcatataatgtatatgtatataaataattatgtattttatagcagctaattataaaagtgtctcatcacaatgctaaatttcaccatataaaacagaatcaggttagctttattatatataacacagtatctaaaggcatctctaacacaatgtattttttcagattgtctcaccttctctgactttgttgtaattaaacttatttttctatatcttgactctaaaatgagatactttattccgaagaaaagtttatagtattggtagtaataatatcataatgcctaaagttaatatgtcagagcttatttgctttaattgaagaatgattagaaattaaattgtggtcataatttaagcgctatgcatgtaacatttacagcttgattatatttaaatcagtacctatattgtgggctaaatttaggtagtatgtatggtaagagagtctgaaataaaatgtaacagctgataattttagattaaaagattgctttcattttaaacacatttttaatgtgttaattatactaaatatatttttaaagcagtaaaatattcattttgatatatatgatcattcagtactctatgcaaatattgatataaatacatacatgttccatttatacatatatatgaggataacacatgttcaagatatgtatttatgatcatatataatatagaatacaaactacataaagatatagaacatgcatattatttacatatgatcactaatattgcctcatcttctatatggttatattactatgcaacaaaaatatctaattgattatactaaatttctttatttcaaagaactaaacacattctcctgtcaattaagtctttcctgtattgtgtaacatgaagaaaactgcagattgtctaaagaaaaaaggactgatagaagaacaaacccaaatacaagaaaatataaactctttttagaatcatttaagctatattttttaaattataattttacaatggttattctttagcctttatactattattactattcgtaatgtaccaaaagtataacttcaattatgtatgatatatgagtcttctttataactgaaaaggcaatcctcaacttatcagattatgctccaaaacattatttgaaatctaaaagaatttctttatatacagaaataaatttagtatttcagttatataagttgttatgtgttgaatgtaatatctgcagcatacctgcactcatctaaatgcttttacaagatatataaaagcctttttattgcaatactagtaattaaataactgaaaaaacaaaaaaccaagtaattatttatatattagtactattatacgttcaacacgttgcttacagaaaaaacaggtttaataagagacatgcaaggaaaaaggatacctctataaaaagttggtagagacatctatgacatgaaaaggtaaggtatctcaaaggcattaagagttaagtgaaaactgtgattcatcaatattatggttacttaaaaaagaaatcaagagtcttcagatattttattcagtgttgggtttcttttttttgtgcagcattactgtcttccctgctgatctcagttgtttctcttttatcttctcaatgtcattttcctcttgaacttataagccaactgaaggagatggaggtagggttgcaagatgaaataaaggacacccagttagatttggatttcaaaagaaagttttgtgtgtatgttttttgttgttgttttgtttttagctctggtatgttccatgcaatattttatttcattttatctagaaattaaatttaacagatgtccagtgcttttatttattaatctgacaatgctagaaagaaagaaggtggtgttctataataatactgtaaagtttcattctcttgtatttgtccaatattgtttcctcaaataaacagtccctgcaaaagagctattatacagtggttgtggaaacaaacacaaaaatactcagcctgatatggggtccatgatccctagatttccagctaatactggaatcaagttactattcatttcatgaaataaaggaaacattggaagacagaaataattaggaagagtttgggtatgagtggcatttcaaatgttataggcaaagcagaaagaaaagttgaaaacaaaggtcatgtacaattgctacatgggatttgatctttaatcatcatatctgcggttgatgtgcagcaaatattcagttgcttttttaaacagatgaatttcttttttgctgtagatatctgtttaaaataaaattgattaggatacttgaaaggatcatttatcaagaatgattatgttcaaaatctttcatttgccttcatcctcattttatcatactatttcagaggtggagcccctattctgcttttgttccttggttaatgcttacactctatattgccctcactattttaaatatttagtattttattatttcattttcactggttattgcttttagctgtatatgaatgtcacattatagggcctatttggcacactgagttaattactattacgaaaatgagggccattaagctgtggatcacgagcacattttacgttgttggtgctgtttgaaccaaaaagactaactgaagaataccctgattgtattccatatttcctttatttattcagtttttgaaaatctacggattatcttgggtgtgtctaagaaacggaaaagaactcttacctaactctatgtttgaaaactcactacaggtagtcataaaagcttggcatctttcacaagaacaggcaaccttatattaaaaatgaatccacaattaaaacaacaatgatatattgctacagatatcaaaatggctaaaatccaaataaataaaaattaataaaaacaataccaattctggtgaagatacagattgatgggaactctcattgacagtgagaattcaacatggtatagccattttggaaggcagttttgcagtttcttacaaagctaaacacaattttgtcatatgatcaaacagtaggtcttctaggcatttacctaactgatttgaaaacttatatccacacaaaaactaccatataagcgtttaccagagatttagtaataataaccccaaactggaaacaacaaatgtccttcaataagtgattaaactatggaattctatacaatggaatactattcagtgataaaaaagaatgaattaccaataccaaactacacaaacatattaatggattctatatacaaatggctaattgaaaaaaagatgatagtttgaacagactacatgctatatgattttctttatataacaactggaaagagaaaagctgtggagactataaacagatcagtgattgccagggtcagggagaaggttgaatgggtaaatgaagcaaaggacattttttagggcattgaaactactttgtatgatactataatcatggatgcaagatattacacatttatcaaaatcaactagaactttccagcatggagtaaaccataatgtttgcatatttaaaaaatatatagtagtaggtcagaggatctgaggacaaaaagcagaatatgacaaagaatctaactgtattattattattattattattattattattattattattttgagatggagtttcaccttgtctcccaggctgcagtgcagtgaagctatctcagctcactgccatctctgcctccgggttcaagaaattctcctgcctcagactcccgagtagctgggattacagatgtgtgccaccatgaccagctaatttttctatttttagtagaggtgggtttcaccatgttggccaggctggtctcaaattcccaacctcaggtgatccgcctgcctcggcctcccaaactgctgggataacaggcgtgagccaccgcgcccagcctgtattattaataggaagcaacttcacttaggggagttaggggataaacagacttaaataacttcagaaatgagtctgcaaaactaaaggcaaaaaatactgtacttaagcactgcactctagttaataatattttttcccatgtcagcactcctaaaatccataaacatgtatactggaacaactaagtccatggaaggcagatggtggaggccaggtttctcactgttggtgtgggagattacaataagcaagagaagaagtttagaatgatccatgtgataatggattagaatttgagacacacacatgtgtgtgtgtttgggtgggtgtgtgtatacttctgcagatatactaatacctatttcatttctctaacagctgagaaggattagaatctatgtgtctgagtagcaaccaacacacaaagtatcaacatttcggtttctaataccatttataccattttctactcaaagcaaccagggctgtttagagagaagcctaattctaggactgggccaagaaatatataaatcattctagagtatcctgtagtgccagaaagtaagcgagtgctaaaacaaacaaaccaaaaccaaaacaaaaccagaaagaatatgagagtctggtgtgtcaaagagatgtaggagccaactgggatagttcccagtaaccaaaactgggacaatttcagcaaataagtaagtaagtaagtaagtaaataaataaataaatattgggttatagtccaaataaatgaatattcataagtccatattgatatagataaaagattaaataaataatgaatcaggaaaattgatcaatctttatgtagattaatttcaaataatttatgtagatacttcatcctcaaggaggtgtgaaataaatatctcttttcttaagtattcgctgtgcatactgacttgtttccaaagagtacagaatgggaaatgggggccaaaagagaagtgatttcatggtggagaaaactggtaaacatttcctcagccatgtaataatcatgatcaatattagcagagataagtcatgttgatgatattacccttggtatgatgagaatgacagctcagctttgtggttttcctccccaaaacctataaccccaaaactttcgaagtcatcaaaacttaggaaaattagggaaacttttgcacagaaagaggagactaaggagatatgataactaaatgtaatgaggtatattggataggatctcataagagaaaaagagcattacataaatactaaggaaatgtcagtcaagtatgtgtgttagtgataatgctcaggacatttcatccccagaatataactgctggagatcagaatatgccactccaaagtatgcctccttggcatactagttattttgagttggttattttgaaaaactgcagacacaggactggctctgagaagttgcccttttgtaagaaaaatgtgtgtttgcataagaaatacctgtttgtaagagtgtctctctctctctgcaccatgaagaggacaactaaattactagagactcataatcaataaagcaggcattgactaaaatctgcatatcaaatcttacctttgtttaagctgtttttctggccatcttatcttaactgagccttccttgcacttttttttcctttctattaaaaagcaatgatgttgaaacctaaagtttaattttattttctttgagatctgctctagacatttacatatttctctgagttatcagtcatatacagggaatatacatgttaataaacttttttactcctgttgatctgtctttcattacaggaagtcttagttaagaactattaagtccacagaaaaaaataaattatcttttctcctctacattcgttacaaataaaatataaatattagtttattaactgtggtacatgtttcatactaccatgagatgttaataggaaaaactggttatgaatacatgagaattagactaagcatagcattctgaatacttgaataaaatatgatgagggcctgaaaataagactacagtgaagattatcaacaggagtgaaatatttaaaaacatactggcattaaaatatataggacttagtaattgattaaatatttattggtagaggaaatggtttcttaccttgcttataggtgtagatgatcttgccatttacctggattcttaataaaatgggaagtgcagatttaaagctgggaaatactgagctcaacaatgtacatgttgagctttagatgtctacaatacccttaggtgaaaaatatctaaaatttagggaagatgaccgagctaaaagtaaatctgtgattcattcttgcatggatgacattttaagatatgggaaaggaaataatcactcaacaactatggatgtaataatgagttataagacaaggaagcatgtctgagtagcatgtacttttttaaggggaaagaggaagtacaggctgaaaagaatgaaaggcaaattataaattttgggaaacggtgggaaagaaggaaagcaaaacatctccagaaagagagtggtcagcagtggcaatgcattaggaagtttaaatgtgactggtactaaactcttttcttttaatgatagtaatagttacatttaatgaagtagtagaaaccccagcgttacggcagtgagttgtgaattggttagtagaagaggaaaattagacaattattgtcaaatctgttttctgacaatgtaaacctaggaaaaggagaaagaatggtagagagcttggaaaagacaaaaatttgaggaggagtgtgtgtctttccatttgtggatatgtgttttaaggctggagaaactgtttatggaaattcaattcactttatgcccaatgtacatgaagaatgcatattgccttagttagcttttgcagcataacaaatcagcccacaatttattcacttaaaataaaatagcatgtattctttcctacaattccaagggttagagctcggtggttcttctggtctgggcagcctcagtttatctctgcagtacccatgacgcacttgatggtgttatttggccttactcacattgcttgtgattgatgccttgttagcaaaggcaatgggaatgacttggtcatgtctctgatcatccagaaggctagcttaggctctttcatgtagttgtaggctttttaggtacaggaagaaacaggaaaatccccagtttacaagcacttttcatgcctctgttatatttgctaatatttcattggacaaagcaaatcccatgagccaagatcagattcaagaggtggaaaagtagattcaatctcttcaagagagtagctgcaaaagcacattatacagagagcacgtacagcaataagaaaaacgtgggctcattttttactctaacacatatttatatatgtctgtgactgtttcacatgcaaatagaagcaattctgttttttttaaaatttacttatttatttagacagggtcttgctttgtcacccaagctagagtgcagcggcatcatcatagctcactgaaacattgaatccctgagatcaagtgatcttctcacttcaccctcccaagtagctaggactacaggcatgtgtcaccacatcagggtaatttttttatttttattttttattttgtagagatagggtgtcactaagttggctggttttgaattcctggcctcaagcgatcctcctgcccaggcctcctaaagtgctgggattacaggcatgagccaccacacctggccaacaattctgtttatagcaaaagtaaagtagactaaatatttctctgtatcctcattttcaaatacagtagcagtgaaagaactgtgtcctaaactcattagctgaacgtaaaaaaacaaaaacaaaaacaaaaaagaactttaaaactctgtaaattaatttagttttcttaatatgaaattaattaacttcaagaaaatctaagctattatcaaagaatatgtgaaatcatttgaggtaatcataattactgtagcctatttttaatatatatgtgaaaaaagcatcaacattttaatctctattgtgccaaaatctgttattgttctctttgagaattctttttttggaacacatacatcccccaaatgtgtgcagagatagcaattggaagaagacaatacggtccaggatttatctactttcaatttataagcagctttcctgatggttttcggctctttgtaaattcagtctccatgtttaaacaaactcaacaacagaaactaaaattttatgttcctttactctgttatgcagaatttctccagctaatgggtttttttaactatcatattctttttagactatggccagtaattattctaatttctttataagtatttaacatttcaataagtatatcacaataatatttagtacaaatagcttcctttttgtgaaatataaattgttctttattcatgtgtttgggcttaaagaacaataacccaaaatatgatgctttgtcatgctgagcactttcaacttgtcttaaaggaagttggaagcccctagaagccgcctcataaccaaggactttccacctttcccttgtttctctcctcccaagggcactttctgtggaagtgcccttatctgactgaggaaatttcttccaaaagaaatgcaattgtcttaaagcctcctcctcagaaatctcatcaaatgatcaggcaatattaactagcagagaagagaaaaagactaaaagttgtcaccatgcccagatagacttttcatgtattcttctgagggtacagtcaagagattacttgagagactttatatacataataagacaacctttgtttacagtgaagtttcacccctcactttctcacaatttgttgccatctgccccagagctcagaggaaccttgtcccttgctattttctgttccccattaccacttggtattcaaagagaatcatttacaaaccattgtctgctctttgggaccattcagttctcctgaaaaatgatttactactccttaaaattgcctacattctcctatctctgtctttccaatgaagaagagtatatacgattgtgaacctgattgggttgttaggtaatcattctcccatgatttccccccatgcatgttagtaaatttgtatgccttttcttctgttaatctttccattgtcagtacatttcagccaaccttcagagggcagaagggaagtcttcccttcatacctataggtggaacacaaaaccatgtatgacatccgtttaggtcatacagagtggtataaacaattaataataatagtgatatcattgctttcaataagagtagctttatgaaggcagataattatctgaaattgttttggcttgctagcatgctgaaagagtttggatgtttgtcttctgcaaatctcgtgttgaaatgtaatcccccattttggaggtgaggtctagtgggaggtctttggatcatgggagtagatccttcctgaatagcttggtgccctcctcttggtaatgggtgagttctcactccgaataacgtgagatctggttgtttaaaagagtgtggcaccttccccctcactattgcttgctcctgctctcaccctgtgatacaccagctcctcttgctttctgccattgttataagcttcctaaagccctcaccagaagccaagagtgttggtgccagcagaactgtgagccaattaagcctctcttctttacgaattatctagcttcagatatttctttatagacacgtaagaacgaactaacacacatgcacaagggttagcaggatcactttcatctcttttcccagcgtgttttgtcttcctgtaaattttacttaatgtcacattcttttttactactgtcgtcatttttttggttgtgtgtttagttaaactaaaaaatataggtaagaaatgagatggaaagacacagagaatagcagtggccagctcattaaagaggatttgcagaaaagggttatgtatatgaagtcattaatatgagtctgactatttcctgactggtgtaatagagattttaatagaacagcctaataggacactgagatcaggggaaataatgcatgggagatatgtcatatacaaatattattagtatttattcttagaataggctggaaagccatgattattaattcattaacattctatcctttggttggaggtttttgaaaaagcattcattttgtactcctcagtactagcatatatttttgtcaacatcctaaatttacctatatatttctagcaaaagttgtagactaaataagaataatacttaattaggtttattaaaactaggtatatttatatcttttccttgactaaatttataaatcttagaatcaaaaataatttgaggtttatgtagtctgtatctttgcacttgggtaagtaaagtatttttttcttctcaatagggatgaggctcagaaagattctgtctgtctataggtgttacctagtaggagaataatgggaggactgtctcctgtagcagcgcttttcaacataccagacaatatgaaggtgagacaagagaggaaatctaattcctggagccacagtgacctccttcctagacctacattaatacatatagtttttttcttctgaatcactttcagatgcttctaatgtcagctgtattgctttaaaaacaacaacaaaaggcattttttttttctctactttgaccccattctcctccattgagttaaatccattttattggaaaggtgacagtttgttccttctgccaagatgatgatgtactgttgaacagagagtgtctgtcattgataagcttatacaaatacagtccttcttggtggccgtgtggtaaattgcacagaactttgtcactgccagttagtgctgcctaagaacttccaaaggaaaatgaaaatagaagtgttacagaaaacaggtgcctgctaatataaattctgacttccctgctgcagttgagaaagagaaatggattatggctcctccatgatcaaattaaaattatgtatttgcacattgtatctgtccctggggaagttatgatgataatggagactacctctgtgtggaaacccaagttgacttttatcagctgtgccctggcggtattagacgtgtaattaatcagaagacaatttaatttctccttgtcagtgggcggtgggaactggattacctgaacttagtgagctttgttatttttatattaaaagaaaagaaaatgttaaaaggtttctataattgtcacaaattcctggggtgatataaaattaaactatcaactaaaaagccaggttcagcatcctagagaaataagagcaaatttgtgtctcagtgtattggagattaaagaaaaagttaacttattaggtcagctaaatattactttttacattagaaaatatttattgaaaaatatttttccccttgagtattggctaaggagtatgcaatgtacatcaaaagtgttttggaatctagaagatgacatggacatcatctcttctttaaactggactaaccctttctggcaagataactttcaacaataatacatccttcctgatagaagattaataattacattgattttctttattattataaagtaatgctccaataattcacattatatcaagtgtccatgagaacttgtgaatgaatgtttatattatcatttgttaagcagaaataaatttgtaccactataatactgctgtaaaatatgcttgcttatggtaagaattgttttactgcttagcacgagcatctggggaactgcctctatgcagtcatttgaataatttgtgagcaagaaaacagcttattttctgtacctcacctgttcaaattcaggtctctttggaatataaagtggaaagacaattacattcattgagcactcaagcaagcagacataagtgcgatgcagaatgcaaaggaagattcttgatctcctttatattaaacaaattttatagttttatcaggatccaaatatggattatatataatatgtaaaacgaaccatgtataactaattacaagaatgagttaaatgccatatattttctgtttattttagctctttgagaaaaatcctattttgctagccattaataaagttaacaattgactttttgaaactctgtcaactttcatatctgataatatttaacatagacatcaaccagaagatttttcttttctattatctggaaaagaacattttccattctaattttcgttatagctttcacactgaaatttgtcagagcacttagttaaatatcaatgaagtcttcaggttggtgactaggcttatagtatggctttaacctctctgtggctctagggtatgctggaccatctgaatggtccagatcatggataaacatggtttgaagtgaaaattttttatttttcagcatttgaatattttgcaattatgatttttacatgtttatacaaaagtacaagatcatctgttctataagaatagataaaatatctatctgttctatttgctgtttcatatacaggacctagcataatccttgctatgaatgcttgctatgggataactgttttttatttttattatttatttatttatttatttattttttgaggcagagtctcgctctggcgcccaggctggagggcagtggcgcaatgtggcctcactgcaagctccgcctcccgggttcaagcgattctcccgcgtcagcctcccgagtagctgggattacaggtgtgcaccaccatgcctggctaatttttgtatatttagtagagacagggtttcatcatgttggccaggctggtctcgaactcctgaccttgtggtccgcctgcctcggcctcccaaactgctgggattacaggcttgagccaccatttttaagaacttccaggctccagaatccttctattgtgtggctttcttatctcaaaatcttcactgctaaccactagtatggaggcatgatgggataactattttttaaatgaatgaaaagaaatatttactttaatttttttcttgggtttagagggacacaaactatgctccctgttgcagtaatttctggtgaagaaacatccgaataggatgaataattttacattctccaaatctgatcattctaatatttttaatataagaaataagctgagatttctttgggcatttggaaatcctactgaattaaagccatagcaattatcttagcttagttcaggggattgtaaaaacaaccaataaaaaattactaaaggcaaaagaaagaaagtaaagaaaaaaacaaagaaggtaagatatttgaatagtcaatgtcttcatcaggctgctcagcctcatgtcatccattttcacacatcactgaggcctgcaagaatttgcttcaagaggttctaaaggttactttaaaaaaaaaaaaaaagaagaaaagaaaaaagcttgggtcatatgcctctttacttgtttctctatggtaattcagagatgtactggctcacagtgccgttgctggcccaaagctatttttatttaatacctaaattcagaaagaactatttcaacctggccccaggatccttatttgttccagaatagccctgaaggaattgactgtttttaaaataggattctataaaacccaacatgcagcatttgtttcatttatggttcagtcgttcttctaagaaacatcatagctatagatagaaagtttcaagtagtcgtagcctatatactttgtcaaagatattgtgtattggggataaagattacagagatcaaaggcatttaaaaatattatttcaggtaccagttacataataattttcaaggatcttttagtataattcatttgtctgttaatttaccaagtatttattatgtgcctgctagatattttgctaggtgctaaggctataggagtgaacaagacaggcaaaatccctgtctttctggaactcacattcttgtagagaagacagacactttagcaagaaataacataatatctaataggaataattcccataaagaaattaaatggaataaaatgatagtgagtaatattgggggagatggggtggcaaggtgttattaaacatagaatgatcaagtaagttcactctgaagaggtctctaaggaaaaacgcaatgaacatggaaatacaagccacatgaatatctgaaacagtatttcaggcaggcagggaaagacaaatgtcaaaaccctcaaaaggaaacagatactgtacataaagaataactaatacagatgagagaagaatcaatacagacaaagagtctgtgacaagaagagtgataggtggtgaaataatgagatagacaatggccagagcagaggagaggtataagttaataacacgtaaaggcagcctgctttctgctttatggaaaaccaactgtccagcttgagtaagaaagaaggcctggacatgtgtaggatgctattgtagtagttgcgagagaaaaggtaacatgaagtatttagacctgtaggttttcaatggctatttgttagcttcattatgagtcagtactggtatgaatctaccaaataaggagctcacataatcttcagctgtatcaataatgcctagaataagggagaggttagatctgtattgctgtcatgctaacaatgactgattttatgttcagttccagactcagtcttataatggaaacagataatcacaaatgtattcaggggagggaaaccaaagttaggaaaccttgacactttaaactctgttgtaacagaaatgagaattgaaatggaatgactagaatgagaactgaattaaagactcagctattatttaggggaatttttgaccaaaactcaggaagcacatctttcttcttgcaagatcttcactgaattaattattgctttttgtaagtcaatgagtaaaagatgcagaaggttaagatacaaatgacttaggagggaaggcaaaaaaggtttatcataatgaagtatgggtacatatcctggtcatacttccatagagtgatttggcctgtctcttctctcatattcaaattaatcatagtgaatttcagttatagatttcttctttacttaggacatcaagagttagcctttgtatattctctaataacaagcagctatcattgtaaatgacataaagcaagctataaagactttgaagaaagtaatattttttcttcatataatatacataaatataatttcagtatcctgctctaatcttaatgagatacgaaagcctctcagttcacacagcaataatcattacatggcccatagcaagaaatctcatctcaaaaagacagaatttccaaaagttaatactacatacaaccactatcattaaatagctaaaagtttgttatatgtaagccatttagacttattttcagagatgtaaaataggaatgttcaatcctttggcttccatgggccacactggaaaaagaagaattgtcttgggtcacacataaaatacaccatcgctaacgatagctgatgagcaaaacaaaaacaaaaacaaaacaaaacaaaagctaaaaaaaatcgtattatgttttaagaaaatttacaaatttatgttgggctgcatttaaagccatcctgtgctagatgcagcctgctggccacggtttggacaagcttgctctgaaagaacaaaccggtagaagctacagaatagcaaagggtagaattagtttgcctaaaaaggtcctttttagtttgcctaagtgtccagagttggtcagtgatagaattggcactatcataagagtttttcaagaaggttcatgtcaagcctgaacttccttaacacggaaatgatcattatttagtaaatgatcattatgtaaagacaattttagcatcaaagggcttgctcagactgatgatataatgctcccctccccttgtccatagatctattatactgtaagtcagactttcagaaatagttaaaagttttattttattttgttaatttttaataattgagggttttttttaaaaaatagattatcaaatgagaaaacagtgaatgattgtgggtagaagaattgagaatggaagaatatattggcggttagaaacatatgatggacttaacacatttcagattacaggaaaaagagaggaggggttaaaatatatttgtgtttgatgttttgagccagcatgcgggagaacagtggagccagcaatagagataaaggaagactaaaaagaaggggactatttttaaatttaaaatagccaaatatgatggaatatttaatttaagaaataaacagttgttattgtcaaatggaatataattaatttagtagaaaatttaatacactagaatcagttttaaaatgaagtatgttgccaagaagctactctgttttggattccacccaaggagtgtttttttttttaaataataaaatggacctgattacataatactctttttatgaactcagataattccactctgccaggctattctacatggtaggaacgttgttttaaatagttcctggccgggtgcagtggctcacgcctgtaatcccagcactttgggcggcctaggcgggcggatcacgaggtcagcagatcgagaccatcctggctaacacagtgaaaccccgtctctactaaaaatacaaaaaattagccgggcgtggtggcaggcgcctgtagtcccagctattcgggaggctgaggcaggagaatggcgtgaaccaggaaggcggagtttgcagtgagcccagatcacgccactgcactccagcctgggcgacagacagagtgagactccgtctcaaaaaaaaataaaaataaaaaataaaaaataaaaatagttcctaataagcttccaggaatgaatttttttctattgagacggagtctcgctctattgccaggcctgagtgcggtggcgtgatcttggctcactgcaacctctgcctcctgggttcaagagattctcctgcccctgaccatttccttttttgtcttcttttcattggccatgcatgcattttggagaaacctttctagagcatatgtaattctttgaaacttctctaagtttccaagacatgttcttctaccaccgtcacacgtttcaattcttaaaagaaatcaaagctaaaattattattatttattatactttaagttctgggatacatgtgcagaacgtgcaggtttgttacgtaagtatacacatgccatggtggtttgctgcacccatcaacccgtcatctacattaggtatttctcctaatgctatcactccctataccccccactccccgacaggcccaggtgtgtgatgtttccctccctgtgtccacatgttctcattgttcaactctcacttatgagtgagaacgtgcagtgttttcttttctgttcctgtgttagtttgctgagaatgatggtttcctgcttcatccatgtccctgcaaaggacacaaactcatccttttttacagctgcatagtattccatggtgtatatttgtgccacattttctttacccagtcaatcattgatgggcatttgggttgattccatttccttgctattgtgaatagtgctgcaataaacatatgcatgcatgcatctttataacagaatgatttatattcctttggatatttacccagtaatggattgctgggtcaaatgttatttctggttccagatccttgaggaattgccacactgtcttccacaatgattgaactaatttacattcccaccaacagtataaaaacttttccttatttctccacagcctctccagcatctggtgtttcttgactttttcatgatcaccattctgactggcattagatagtatcacattttggatttgatttgcattcctctaatgactggtgatgttgagctttttttcatatctttgttggccacataaatgcctttcttttgagaagtgtctgtttatgttctttgcccactttttgatggggttgtttgtttttttttcctgtaaacgtgttttaagtttcttgtagattctggatattagaactttgccagatggatagattgcaaaagttttctcccactccgtaggttgtctgttcattctgatgatagtttcttttgctgtacagaagctctttagtcagaaatgacttcttttaaaatgaaaaatggtacatttttgggaaatagactggaaataggagggctatatactagtttcaactttgccatgaattgtgggactttggagaagtcattatttccttctctgtaacaaaatgggttaggctacattatttgaatcttcttacatattctaatgttgttttccaataatctcatatcttttattataaagtctcaaacttgggaacaacagaccttaagtatctcaatttttgaagaaatggtgttagacgtgtctatataatatttactaaaatatgtaaaatagaatcccccttaaatattcagaaaatttgatacttaaagaaagttaagagaagtgaaaaagaagtcaccaggctaaatgatgctgttggcagtggtctgagatttcttttcccctcactcagagaaaggaaaaagtgatgattttctttacctcggaataggtaccagaggaactgcttgtggtcattggagtgtctgcagagaggaaagatatgccttttactctacatctaaatgtttactaagtgacagaaactcagatttgttaagaacatgctaaaacaatcttgagaaaggctgacgtgcttcctgtggattttgagggtcgctaacatggcagcgtaagagcatagaaactagattctgttttccaaagtaagttgataaaagctactcttggagcaaaataaaattaaaaggtggtagagtacatactgaatcccagcatttggaagagcaaaggttcatgaaccttctgtgggacagaagttgatgcttcataagtagccaggcatgacccttattgatggattctagccaatgccaccagacaggaggaggtgacttcagaagaaagaggaaggtagtctccccaggggtggagctgggagaagagcaccagcataagacatcagttagagagtagatttctgtgtcttagaactaagcagcatggcagattagaaggaacttccaaagaaccaataggggcaacccactagagaatccgtacttggacaactaccacacagagggccccggtggccacatcacagctgcaccattcagctaaaacttgtggcctgtatattccagcaacattggaaggatttttcaggagaagagaagggagacaaataaagatcaaaacaaaaatagaaacaaataaccgctttttccctaccacaggttccgaagcaccacggcaagcctgatctgtgaggagaagagagtggaggaatgagagattgaattttttgtctaggcagagctggatatattagtattctcaaaatgagtcttaattgccaaaacaagctttgttttaataccttaaggtatatggaatgctgaagacccatcaagaacctcatctatggcagagaaagggaaatctggcaggaggtgtttaaagcagtaattggagaaatagaaagtgttttagtccctattataaatgcattacatatacttggatattttctccttattgacatataacccttttggtagcctttcattgatgtttttctttcagtaaaaatgtaatgaatactactctgagtaaggcaatgtccaggacagacactgtagataaaccagagaaaaaggcaacccttcagtcttaattcatagaggtaacagactctcttaatccatttgggctgctataacaaaataccataaactgggtggcttataaacaatggaagtttatttcttatatttctggaaggtgggaagtccaaaatccagttgcctgcagatttggtgtttggggagggtgtgttttgtcatagatggtgccttctcagtgtaccctcatcacttgttggaaggagcagggcagctctctggggcctcttttataagggtactaatcctattcttaagggtttcaccctcatgacctaatcacctccccaaagttctcatctcttcatactatcaccttgggggattaagatttgagggtatatgcattttggagggacacaaacattcagaccacagcacaaatctttggactgagtaatcaaatttgaaccacaataaagggaaaaaatgttgagggatttctatggtattatgaatttcttttattaatcaaagtttcggtagaggtctttattggactttttgtggcacaattgttaaataattcacaccaaaagacttcaggaaaagacagggcttaagagggaggttgaaggattgagggtatttgaataggtagagagaaaaaaagattgcattagtgcattaaagcagggagaaatgtccagcacttttcacatagagttgtagctctgcctgcttgtgtcctttgacacattacagagattcttgcccccatccctctccctttgcctcaagcactcatattctacaaccatatgctctaaatgggctcttcacatttaggaaaataaattgagagtacatgactagtgattctaccaatgattaatcttaatgtttagagaaagcatggagtccaggacaaatagatgtttttactagattaacgtacagagttatgacatttatgtttctatgaagcaatttgctgtaacttatgctaatattgtagtttgctgtaggatgtcatgattttcatttaattaaaaataatgtgtgacagatgattatttttccattgagcccgatcattaaaaatttatttctagagtaataaaataaaaaatacagtgtttaaaagagtttgtgggactatcacaaggtaattaccatagacatatatattgaaaacaaagtttggacagttctttagttattgcttctaaaatgtttaaagatgattctgcatttgtgcagatctttatagtgaggaattaattctcaaagattttcttttattattattattattattatactttaagttttagggtacatgtgcacaacgtgcaggtttgttacatatgtatacatgtgccatgttggtgtgctgcacccattaactcgtcgtttagcattaggtatatctcctaatgctatccctcccccctccccccaccccacaacagtccctggtgtgtgatgttccccttccagtgtccatgtgttctcattgttcaattcccatctatgagtgagaacatgcggtgtttggttttttctccgtgcgatagtttgctgagaatgatggtttccagtttcatccatgtccctacaaaggatgtgaactcatcctttttcatggctgcatagtattccatggtgtatatgtgccacattttcttaatccagtctatcattgttggacatttggcttggttccaagtctttgctattgtgactagtgccacaataaacatacgtgtgcatgtgtctttatggcagcatgatttataatcctttgggtatatacccagtaatgggatagttgggtcaaatggtatttctagttctagatccctgaggaatcgccacaatgacttccacaatggttgaactagtttacagtcccaccaacagtgtaaaagtgttcctatttctccacatcctctccagcacctgttgtttcctgactttttaatgatcgccattctaactggtgtcagatggtatctcactgtggttttgatttgcatttctctgatggccagtgatcatgagcattttttcatgtgttttttggctgcataaatgtcttcttttgagaagtgtctgttcatgtccttcgcccactttttgatggggttgtttgtctttttcttgtaaatttgtttgagttcattgtagattctggatattagccctttgtcagatgagtaggttgcaaaaattttctcccattctgtaggttgcctgttcattctgatagtggtttcttttgctgtgcagaagctctttagtttaattagatcccatttgtcaattttggcttttgtcgccattgcttttggtgttttagacatgaagtccttgcccatgcctatgtcctgaatggtattgcctaggttttcttctagggtttttatggttttaggtctaaccatgtaagtctttaatccatcttgagttaatttttgtataaggtgtaaggaagggatccagtttcagctttctacatatggctagccagtttccccagcaccatttattaaatagggaatcctttccccattgcttgtttttgtcaggtttgtcaaagatcagatagttgtagatatgcggcattatttctgagggctctgttctgttccattggtctatatcctgttttggtaccagtaccatgctgttttggttactgtagccttgtagtatagtttgaagtcaggtagcgtgatgcctccagctttgttcttttggcttaggattgacttggcgatgtgggctcttttttggttccatatgaactttaaagtagttttttccaattctgtgaagaaagtcattggtagcttgatggggatggcattgaatgtataaattaccttgggcagaatggccattttcatgatattgattcttcctacccatgagcatggaatgttcttccattggtttgtatcctcttttatttcattgagcagtggtttgtagtcctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatgagcttaaggagattttgggctgagacgatggggttttctagatatacaatgatgtcatctgcaaacagggacaatttgacttccttttttcctaattgaatgccctttattcccttctcctgcctgactgccctggccagaacttccaacactatgttgaataggagtggtgagagagggcatccctgtcttgtgccagttttcaaagagaatgcttccagtttttgcccattcagtatgatattggctgtgggtttgtcatagatagctcttactattttgagatacgtcccatcaatatctaatttattgagagtttttagcatgaaggttgttgaattttgtcaaaggccttttctgtatctattgagataatcatgtggtttttgtctttggttctgtttagacgctggattacatttattgatttgggtatgttgaaccagccttgcatcccagggatgaagcccacttgatcatggtggataagctttttgatgtgttgctggattcagtttgccagtattttagtgaggatttttgcatcaatgttcatcaaagatattggtctaaaattctctttttttgttgtgtctctgctcggctttggtatcaggatgatgctggcctcataaaatgagttagggaggattccctctttttctattaactggaatagtttcagaaggaatggtaccagctcttccttgtacctctggtagaatttgactgtgaatccatctggtcctggactttttttggttggtaatctattaattattgcctcaatttcagagcctgctattggtctattcagatattcaacttcttcctggtttagtcttgggagggtgtatgtgccgaggaatttatccatttcttctagattttctagtttatttgcgtagacgtgtttatagtattctctgatggtagtttgtagttctgtggggtcggtggtgatatcccctttgtcattttttattgcatctatttgattcttctctcttttcttctttattagtcttgctaacggtctatcaattttgttgatcttttcaaaaaaccagctcctggattcattgattttttcaagggtttttttgtgtctttatttccttcagttctgctctgatcttagttatttcttgccttctgctagcttttgaatgtgtttgctcttgcttctctagttcttttaattgtgatgttagggtgtcaattttagatctttcctgctttctcttgtgggcatttagtgctataaatttccctctacacactgctttgaatatgtcccagagattctggtatgttgtgtctttgttctcgttggtttcaaagaacatctttatttctgccttcatttcattatgtacccagtagtcattcaggagcaggttgttcagtttccatgtagttgagcagttttgagtgagtttcttaatcctgagttctactttgattgcactgtggtctgagagacagtttgttataatttctgttcttttacatttgctgaggagagctttacttccaactatgtggtcaattttggagtaggtgtggtgtggtgctgaaaagaatgtatattctgttgatttggggtggagagttctgtagatgtctattaggtccgcttggtgcagagctgagttcaattcctgggtatccttgttaactttctgtctcgttgatctgtctaatgttgacagtggggtgttaaagtctcccattattattgtgtgggagtctaagtctctttgtaggtcactaaggacttgctttatgaatctgggtgctcctgtattgggtgcatatatatttaggatagttagctcttcttgttgaattgatccctttaccgttatgtaatggccttctttgtctcttttgatctttgttggtttaaagtccgttttatccgagactaggattgcaacccctgcctttttttgttttccatttgcttggtagatcgtcctctatccctttattttgagactatgtgtgtctcagcacatgagatgggtttcctgaatacagcacactgtattttctttatccaattttccagtctgtgccttttaattggagcatttagcccatttacatttaaggttattattgttatatgtgaatttgatcctgtcattatgatgttagctggttattttgctcgttagttgatgcagttgcttcctagccttgatggtctttacaatttggcatgtttttgcagtggctggtaccagttgttcctttccatgtttagtacttccttcaggagctcttttagggcaggcctggtggtgacaaaatctctcaacatttgcttgtctgtaaagtattttatttctccttcacttatgaagcttaatttggctggatatgaaattctgggttgaaaattcttttctttaagaatgttgaatattggcccccactctcttcttgcttgtagagtttctgccgagagatcagctgttagtctgatgggcttccatttgtgggtaacccgacctttctctctggctgcccttaacattttttccttcatttcaactttgatgaatctgacaattatgtgtcttggagttgctcttctcgaggagtatctttgtgccattctctttatttcctgaatttgaatgttggcctgccttgctaggttggagaagttctcctggataatatcctgcagagtgttttccaacttggctccattctccccgtcactttcaggtacaccaattagacatagattttgtcttttcacatagtgccatatttcttggaggctttgttcatttctttttattcttttttctctcaacttctcttcatgcttcatttcattcatttcgtcttccatcgctgataccctttcttccagttgatctcatcggttactgaggcttgtgcattcacacatagttctcatgccatgcttttcagctccatcaggtcctttaagaacttctctgcattggttattctagttagccatttgtctaatttttttcaaagtttttaacttctttgccattggttcagacttcctcctttagctcagagtagtttgatcttctgaagccttcctctctcaactcgtcaaagtcattccctgtccagctttgttccattgctggtgaggagctgtgttcctttggaggaggagaggcactctgatttttagagtttctggtttttctgctttgttttttccccatctttgtggttttatctacctttggtttttgatgatggtgacgtacagatgggtttttggtgtggatgtcctctctgtttgttagttttccttctaacagtcaggactctcagcttcaggtctgttggagtttactggaggtccactctagaccctgtttgcctgggtatcagcagcgctggctgcagaacagcagatattggtgaaccgtaaatgctgctgcctgatcgttcctctggaagttttgtctcagaggagtacccggccgtgtgaggtgttagtctgcccctaattgggggtgcctcccagttaggctacttgggggtcagggacccacttgaggaggctgtctgcccattctcagatctcaagctgtgtgctgggagtaccactactctcttcaaagctgtcagacagggacatttaagtctgcagaggttactgctgtctttttgtttgtctgtgccctacccccagaggtggagcctacaaaggcaggcaggcctccttgagctgtggtgggctccacccagtttgagcttcccatccgctttgtttacctactcaagcctgagcaatggtgggtgcccctcccccagcctcgctgcctccttgcagttagatctcagactgctgtgctagcaatgagcgaggctccgtgggtgtaggactctctgagccatgcgcgggatataatctcctggtgtgccgtttgttaagcccgttggaaaagtgcagtattagggtgggagtgacctgattttccaggtgccgtctgtcacccctttctttgactaggaaagggaattccttgaccccttgtgcttcccgggtgaggggatgcctcaccctgctttggctcatgcatggtgtgctgcacccacagtcctgcacctactgtcttgcactccccagtgagatgaactcggtacctcagttggaaatgcagaaatcacccatcttctgcatggctcaagctgggagctgtagactggagctgtttgtattcggccatcttggctccaccctctcaaagattttcattgtgtttatttattattgactgtaagtaacagccatcattataaaattaatctcatgaaatagatcagataattttttactgggatcaaagggattaaggaggatgtgatttctctaccaaatgttctttatgctgggttcttcaaactaatttttcaatttgaaagtattaactttaaaattgaatatttaaattgttcaacgttgttcccttttgggggacaaagtatatagtacattaccgggacataacactcagagtattaaaattagctctgtattctcctacttgaaaaataattgcatggcttttctcctagctcaccatacttattcacactggccctgattactgttatatccttagtgcagagcttctcatgctgttggccacagacagaaggaccttggagatgctccagagtgtccatggtgttaaaactattttccttataatacaataatgttattggcctgctttattctcttgacattgttactaatggagcaaaagcaatggtgagaaaattcgggagccatggcttacacatggcactagcaactgtattaaataaaatattaaatcttgtctcactcaataatatctcccatgaaacaacaaaaatattaatattattaaataaaacccttaaatacacatatgttagtaatttgtgtgacaaacaggaggcatacacaaagcacttctgcttcacgcatgcagaagtacagtggctgcctcagggaaaagcattctgctttcatttgagattgtgtagttgtttgaactgtgaaacaaactagcagcagctgctttttcatgaaacactgtttttacttgaaagaaagaacaacagacaaactgttattcaggcttgcatacttggtggatattttcttaaaagtgaactgagtaggcctgttgctgcaagggaaacaactaacaagatctgttgccaatggcaacattcaagcttttgtgtaaaaactaaaatttttgaagacttgtatccaacttcatgagctagaccatttcccaattcttagagacttacctgattgttaaggatttgtgcaattcagtggacacatattttccaaatgaccaaacacacagtgttacaaaatcacacatggataaaagatctaatctataagacagatgaaaggattttaattttacagtatgaaaagttcactcaggtgatttcagattactcattacaactagcctttaagaaacttgagttttggtatagtatcaaagaagaatattcataattatctgaaaaggttattacaattcttctctcttttttgactacatatgtgtgagagcagggttttctttagctgcttcaaaaagaacaaaactacaactggttgaatgaaaaaaggtaggaggatctagctgttttctattaagctaaattcagttttacaaaacttataacaatgccactcttcttacaggctttacattttgtcttgaaaaatatggttatttaaaaaaatatatatatttaggttaacttatagtgggattttcatagttattttaagatcatttaatacataattttattttttcagtattgatttctaatatagtaaaaatacagatagatataactcacctaaacaaagttctttcaagacttccattattttccaactgtaaatgggccctaatatcaaaaggtttgagaacaactactttagcacaaagttaaatgggatcgtagacactggaatgaagatgtgaggagtaaaggctggagagttagtcatgtttgagagcatggagataatatctgaaacattttgtaattcataaagaatttggacgattgcaaaccactgatatatccaaggaaattactgaatttaaaatttccgtggtgaagcaggtgaatggcaatgacaaagtcaggattttcttgtaaaataaattgttctttctttccttccttcctatttttcttcctctgaattcagtcagctaccgtgttagtttatttcttctattataatatatcatatcatttattcctttcttgatatatatctcatatcatgtatttcattcatttaattaaatcccgttccaaatggcctcatgtctagtctgctaatttctttctggtttctgtgcaatcagtttttatttttttctctttcaacccatcctgaaatctgctgactgattaacccacttcaatccagtcttagctctattaccatcatcccacaagctcaatcaaatataatgaaaacatttgtgctaaccattggtgagatgataaatctcaaacttctcagcataataactgacataactcagcataataacggacataactcagcataatggctaaaggaccctctctgagcatgttttaccctttctctaaataaaaaatgctctaattaaagtagtttattcgttttctttttaatgtgccaaatctgttttaaccatggtacctttctgcatatcatgttctctagcctgaaatgcccgcagtctttgccttatcatcttatacagataaaatgagataatacttttcaataaattagtacaatacctgaaacataataagcagtaaattaaagccagttatttttcttattaatattacgactatactgtaaacttctggagggaagatactataccctatatcatagttgattctccattgtatagtagatgtctctctatgtaatatatgttcacaaaatatatgtggcttatagtgatgattatccatattttgactgactttatttaaagttttaaggaagggccactcatctaataaatctgtccaacaagacataatattttaacatagtcaccaaaataaagtaaaaaactctaactcagggcaccataaagtgctagatatgtaagcttatccaggaacgttaatgcacctaggcagagaatcatcaacaatagtctagtaattggcaagagtatcattaatcaacttttttccaggcaagtaaagttaaatcagaattcagttaacaattcgtaatgtgtgtgcgagtgaggatcagttaaccatttatgaagtttatgccatatgttgaaaaccaggtcatattgcaatgaagtcatgttggctactaagaaagagcaactcagaaatgaagaggttttgcagtatgggtaatccgctggatatcctgtctctgacaacagagagagaagcggctatagaagctgcctactctatactgcacaggatctcctcatagaatagaacatggaaacaaagctctatttgctaccattatatagagaatgagctttctttggaagaaagtatacatgtggaggatctaaacaaaacaatgcacaaggtaaactgacttaaagacacagtgtctcccataaaggagcgacaaattcaatagcaggtatctgctatgggagctagttccctgaaaagaagagcaaccagattcaattacaggatacctgagagaaaaacctacagtttgatgctgtttgctactaacgaggatccattttcttctggtaatctgcccagggaatcatatgtgtggctgcattagatggtacgtttcttctttccaaacaccactcagaatttgaaagatgtgtgtgggagtgaggatatgttatgaagatgggggtcatttgcaagtagtataaagatttgataaaggaaaattgctgagaatttttttaaaagtaatgatcagcttaaaaactagtagcagagttctctcttaaacaaaataaatgccatttgctagcaaaacactttgaaggattatctaggttttcaaaagagtgctttaatagttgggtcaaaatgggttcatgctgagtgacattaggagcagaatggttctgcttaataaagtggaaacatttttattttcttggagctgatctagagaaggaagaagcaaagaggaacagcataacaagagaacaagaaccttaggaaaatatgtggccagtgagaaagtcctaagactgctataccttctccactgtgagcccaaaatccatagtttaagaccaccggccgggcgcagtggctcacgcctgtaatcccggcactttgggaggccgaggcgggcggatcacgatgtcaggagatggataccatcctggctaacacggtgaaaccccgtctctactaaaacacacaaaaaattagctgggcctattggcggacgcctatagtcccagctactcaggaggctgaggcaggagaatggcgtgaacccaggaggcagagcttgccgtgagccaagatagcgccactgcactccagcctgggcgacagagcaagactccttctcaaaaaaaaaaaaaaaaaaaaaaaagaccaccatatacaatcactttatgtaaatggcattttgtagaagtcaaggcaaaggtacaatgttccatgtttgtgtcattttcagattaagaagaggaaaagaaattgttcatgggtaaaattaggaattctgggaaactgggactttgggacaaggtataataatgaaacattaaacccctagtgagctcttagggggcacgtggtggaggtaggagaatttcaacattccaccctctgtggggtgagtcttcaatccattttatttaatacgttaaagtaaaaggaaaattcctaaaaccagaggacttatggatacctagcagttgacatctgggctaacatctgacctgtatttaccttcagaaatcagggaaatccaggatggtggcaaccgtgtcaatatgacacagtgaagcaggtctcaccacagaccaacctggttgcaatattcctgcctgcgttgggagctaagtaactggaacaagtttttgtaacgtgattagagtttcttagaatgagtaattgtcacagttgctgttgtggaaaagtaattaattatatgaagtaattagttttccctcaagcatacttaggcttgatatttttgtgtatagaaatgaaaataacaaaagcaataatatatgtatcttgataggtagtgtgctggattgtagatagaaaatggcgttgatggaacgtgaaacatgaacatgttgtgaaactatagaagtgcagcaaattggtacacaaacactgtcataatacaaggggatgactttgaaggggcagctttaaaatcaatatcttctttagtagtggtaaatgctttataaatgctgtctgcctgaataacaagatgggaataagccagacaaatgtagtcatgattttacaatttcagaggaaatcaccatcaataacatgcaaaatgcaataatttggaagtgttgtaaatgtgcatatttaagttctttaattaatttcaacatataattcaataagttctaccctgattattcagtattcatgtattcaacattctaaaccactaaaagcagaaaaatactgcttccaaagaaggatctgaagtaaagcacatgtatatttagaatatgaaaacagtaattttgccttgaagaaatatactaatagaaaatgaatcaaaggtgatcttgggaatatgttttctatagtgaatacacatgttagttcaagtcacaaattccttcctataaatatttagaaagtatattgatgttcataaatcattatgctttaaatatatttgaagaaaagatatatgagtagaaagaaaattcaaacatacacatttacatgttaatatcaacttaaaagttaatggctattatcagtcaagtgtacatgaatataaaacaaatactatgtctctaacattggaatagaaggaatggcacatgtttacagaagtataaaatgagcttcctatcctcataatatttttctaatattcttgagtataggggaaagttaatgagcagaaaaattaaggtgagtaatacaagatgtgtcatattgtatgcagtgcatccacacactatctaaacaatgaaggaagagagttttacagaagaatgatttacggagagattcactgggctagtgagggtatagccagtccttgagagatgaacttcaggtatagaggaggaaggatcatccagaggaagataaacatcatgagcagagatgaacaggcctctatgtaagcggaagagaaattcagtgaatgcagtgggaggggaaagtggaaaaaaaagaggacagcaatgattatacaagtcaaataaagcataaaagcatcagttacacagagtacaatttcaaaaactaccattgataataataaaaatagataagaagagactgctggatacagaaaggcaaaagcatgagtgatgtcagagattaatgcaaaagagatccaaactcagaaaccctgggttcaaaccctggcattgttgtttattagctgtatgactttgtgcaatcactaagccactctgaaattcctccactcctcaaatggcaatgatattaattaattgacaagtggcaaagttaagataggacaatatttccaagtagataacacagtacttgatataatagaaatatctgttatacaaaggtcattgaatgtaaatctggaaaaaatatttagatctctgtacaaattatgtgttgtagatatgtgtcagtaaagccactatgcagagtcatggcaagaacattccagacaaagggaatagcaaatgcaaaggctatggcaggaaagagtttagagtaagaaatgaaaaggaggcaaacacagaaagactatagtaagcaaagggaacaatggtttgagatgattaaagaagaaggctaatgccaatcatcttgaccatgctagggtttattctgaaaagtgccacaacaccagggatgctagcattaagaaaaagttgttcagaatatattttttccaaatatgtatagaaataaatatttactatatttcaaataaagatatggtaaacatgaaatatcaaacaaagcataaactaatataactatacatgcaaataataaattacaattataatgtaaattgtgaaccactgatgactctgctttttttaacttcagcccactgtgtgtgaggatcactgagctgctgctgcctttgatgtaacatctccacgttggcccaggctttcctgccctgtttagaggctttacgagacgtttagttgatcttttatcttaggcccgtgtatctttttgatggttctctggagggaggttgggatagctttttcttggacagcaaatttaaacccctgctaacaccagcagagcccatctcatgatttacctcttctcctctccaccagacatctgcttattttagagtactctttttacatgactcaacaaaaccttttttttttttttttttgagacagaatcttgctctgtcgcccaggctggagtgcagtggcgtgatcttggctcactgaaacctctgcctcctgggttcgagcaattctcctgcctcagcctcccgagtagctgagactacaggcgcgtgccaccatgcccggctaatttttttgtatttttagtagagatggggtttcaccatgttagtcaggatggtctccatctcctgacatcatgatccacccacctcagcctcccaaagtgctggaattacaggcgtgagccaccacgcccagcccctcaacaaaacctttttatttggcagctggtgcgggaagagagataacgagatactgtcatggatattgtaagaattgtggagtaaagagaggctgggggaacttgagatacaggtgtcctgaataaggataagagaaggcaggaaaggggagagtaagaaaaatatacagtgccaaacatttgcaggaaaatgcccaaaataaagattttatgcaaactgaaataccagtattttgacacttaaaattgcttagtataatggaaaaataaaaatcaatattgaaattccaatagagatggagaaaagtaacaatttttttaagaatatggaaagaaaacaagggcaattcctaagtttttgccttgagcagctaagtatagttttaaacaggtggactgtttactaaagggtgaagattggaagcatatgaaatttgaaagaaaaactaagagctccactttgaatatcttaaatttgagattcctctaaacagaggttgcttaggtggttggatatataagtctggagtctccagaagtcagtgatagaaatctacacaaagttgactgttttcaagatatctctggctttaaaagccatggaacaggatgagatttcctagagaggggttattagatgagtaacagtagaagttcctataaaatctgcagataagtttaaacaatgtccggggaaggaatagagataaaaactcaagaacaagttgccagcaaagtagaaagcaagccagcagagcataagtcagagaaaccaagttaaagaaatgatctaaacatgaggaagacgtcagcatatcaaatgctgcaatgatgacaaatatgatggagatggagacacagccatttgagtatgataacatgggaagacgccaagctggagttggggaagtgaaacagaggtcaagaactggacatcatgagtagagaaaattccccttaaaaattctctgttgaagcgttcaaaaaattagacaaaaaagaaagaaaagaaaagggaaaaaaaggtaccaagatataagagtaactaaggggaatgtaaaattaatatcatgtaaatatttttgtttgttttttctttgtaaatttgaagtagaacatgatcatatttcaaaagcagaaggattgttttgaggaactgtaggaggtgagtgggaagaatgtgaggaggtgaatatagtagtctgagtaagaaatgatggtgggttggacaagcatggtaacagaggatgtggagcttaattgtcagcttctggatgtatgttaaaattagaagcaaaaacattttttaatgttttgcaaacgaaatgtgagagaaaaagggaggcaatggtaatagatatgacaactcatagaatatgacaacataggctttcaacaaatagatttttagcaagaatgtgtaaataaatgatttttccctaccaagactggcttttataactagcttagatacctctctaacttttggccctggatttccctattctgatggagagtgttttctctccttcattataaccctaaaatccaaatgcatattttagctgtttatggattaagagcataaagatttttgatcttatcttgtaatatccccttgattgctagaatgcctgaaggatatgtaataaaaataaataaataacaacaactctgtgttccaggccaacaaggcacataagacataaaaatggaatgtaaactcttgtcactgatttgaaaggaactgtcagttgtttgattctttaagtgattctgtcacacactggggacccccgtcagtgcagtttcactcctaaactacttttattaaaagtatgtatcatcatgtggccacaaaagcatgctatgacagaatagtaattttttctttctcttatcttcactatcttcatcatagaaaagtgttgtgtttctatggttgcaggaactaattaattctatatcaagcagatatattaatagaaaatactttttgggtattgaaaaacaaagttagtattttaacaaattttaggttgttttgttcttcccatcaacaaaatcccaccatttaaaagctattcctgtattattgttttcaacctctccttcttctgtgtttacagaggatctaggccagaatgtgtaacttctgccagattcccatgatgtggattatatccatctctacttctgagtgttttccagaatctctttcttattcccagtgtaatgccaagatgagatcaatcactggaatgtgccaattatcttaatatatgcctttgtcagaggtcaacagcgtgaagtgtgtcctctcttttatatacagagattgtggtgttgttagggatttttccctctttagaattggtgcattttaactgggatgttctatggacatatctgatgattacaattactatataggcctgattgttgttctgcctagaatagtctctatttttcatgcatgctctatccagtattgttatactttttaatggattcagcagatagtgttgctttattgtgaagaagcattttatcctcaaccttacatgacctagccttgtctactcttctagcattgtggaaagtagtgtttatttgctacaaacacttttgctgagtggagtgctttggttggtagctttttccattaagtgcagtactgtgaaaagctgcagctaatgcagacaagtgaggctttaacactctgcctgtctgggggatgttgctgatatctggacaaagcttgcactcagaaggtagtcttggtctgtttctttgcgtttagaccattgtgtaagctcaattcatagcatgcagttgttcttcacctgtgcactgttaagaagggtcctgtactttaggaacaggtaaaggttaactattagaatccacccagcacataataggatacagtgggatttgtggttcactttggccggttctatcaatatgagctcttaacttggagtgcaactgtgaaaagaagtactttagtcacaaagcaataggtagcatcaggtttgcccagcacaaagctgcaggtggttaacgatggtttgccacaccgctgttaatggtgctgctttagatcagtacaaccctgtaagtggtagcatttaaatccagcacaacaatgtaaaaggtggtgttttcatctcattcagaaagaccctggtgtggtaatcctcactttctagttgatttttgataggacacataggtgataatatggactgtttccatcattattctcatcaagtcacagatcattaaagacaacattaagtgaaataagccaggtacagaatgacaaacactgcatgatctcactcatatgtagaatcaattagttgatttcctgaaagtagagagtaggatagtggttaccagaggctggtaaggtagtggggagatggggggaccagaagagggtggtcaatgggtacaaagttagttagatgggaagaatgagtttcagtgttctgttacacactagggtgactatagcaaagaacaatgtactgtatatttcaagacagctagaatattttaaatgttgccactacaaaaaaaggtaaacgtttaaagtgattgatatggtaattacaccaatttggtcattatactttgtatatatgcactgaaacatcacagtgtaccccataaatatgtacaattattatgtgtcaattatatattaaaaaataaaataagggaaatatttttatgtatttccttagtaccaatgatttccttacccataactcagtctttgttttaagataagtggacttaatatgaaaatattctaaacctctcaaacatgtctcttttaaacaagtatcaacatgaaatattagtaaaaataataggtaaagtgcaatattaaaaagcgatttgtggaaaagcaaaggtaaatatgccacaggaatcaggaacatatgataagccataaagcacacagtttatgtatgaattaccagtgtttttctctaataccttattctaaataaagaaaaactaacaatacagaggctttgtcctcgatgtatgaatctcaatttttataatgctgatacttcactgaattcctccttctgccatatatatatatatatgactgtatatactattagttgcaagaaatgtgtgatctttataattaaaatcaataaatattgaactttagtgtggtgcatcatatccctcataagggtttaaggccttttaaagcctttgtgcttcaagtctaagtccctaaccagccacatcagtatcacttgggaacttgttagacatgcagaatcttaacccaatctacagactccgaaatttgcatttcagcaagatccccctgattcaagacacgctttaaagtttgaggatcactgatctaagagacccagataatcttttgggtcttgccttggtgaagatactttccaaggctcaggcatcacaatctaaattaaagcttttgcaggatagtcaagaagaccattactaaattttggagccacttcaggactttgctaaaaattacagagatcatttactttgtggctgagaaatgtcgtcctataccaaaagataggattaagatatgagtttaagtaacctggaatcctgctgaagagatgaattcagtcattgactatcctactaatagcatagtaagagcaaggagttctggaaactcagaagacaatatagatttttattcatagaaatgcaatgtgaagaaaagatcacagcaaactaccaagggctactatctcttatgtgaatctcttatttaacacacattcattcaatcagcattttgtaaacatctcataaacacccactaatcacagatttagggaaaaagctcataagcttcataaagaagtctgaagcaaattatcttaaagaaatgttttcttatatgtctttgcttcagaagtaaaattaacatagactgtatattagtatacttggtaccattacataaacatgtgggaggaaaaaacatatttgttccgattgaattatttgtgttggcagatagccaattctcttttcagaattccactactggaatacttgaagttgaatgaaatataaagcaacttctgtttgccaggctataaaactaaagatgtccatcaggccaaaggattcaaaactttataaatagacaataataatcgcaataaattatattgggttgaaataggcatacatataaaactaatatgcttgaaaaatgatgacctgttctggtattattattattaatcctgttatacatgggaagttttcttcaatcaatgattagcaagaaaaatgatcagcacttagtttttgagataagttttctttatacatctaattttttagaagctatacatagtattcattttcagatctcaacttcttgatgcgttagagttaggaaatggtttctgatccagaagactctcctactgttgtaagaggatatattaaacaataccaatcatatgattcatttgagtaacaaatataattgaatatttagcatcagatataagcaaatataaagctggagtctcacggaatgttcttggttctgaagcctcagcatgcctcacccctgtagcaagtcgtctacaagtgattctatcccaattagttaaattcagtccacctttgtatgctttcaattccttcaggtttgagtagtctctagtagaatagaggtaggaaaattaagctattttgaattcttctccttcctattgcacgttctaaactcccaaaatatttcaagcccgtccaaagagtagtgaggggagcttggaaggagtggaaactctatttatgtttaagactgaaaaaaaaaaatataggttgtttgtttagtgtgtgctcagttatctactggctctgactgtcagggtttttacccagcctgttttccggtactggttatatctagctgtttaattttaggtcctctgctttctcagatatcttatactaactcttttgtgttattataagactaacttgtggcacattaagtgttcctccagtgcccagctggccacacactccataacctcagggtaccaagaattctacagagaaatgattacttctacctcacattttcaatgagtaatcaccccacagctttctccggtatttttcacttctggatgccttcttggtgtggggccatggaagtggcaagcttatgaatgccatagcatctccttggttccttgggtgtgtgggaagcccagggattccttcccaggttgcatcagctacgcagaaatagtaagccctcattgacaccttccttcttgtaataccactctgtcatctctttttggcatttaccacaattctgagccattaggatgtgtctagagattctgttgattggaaaattccatgtagggaatatgataccagtttccttcacttgcaaatattcctacatattgtggggaggtatgtcaagaataacaatttttgctccctaaaactgtatccatgctacccccattcctcaggcgggaaccttttcttccttcctcccttctttccttcctttttcttagctttccttttcttttcttttcttttcttttcttttcttttcttttcttttcttttcttttcttttcttttctgtccctctctctctctctctctctctctctctctctctctctctctctccctctctctctctgtctccttccttccctccctctctccctcccttccttcctccctccctccctcccttccttccttccttcctttttcccttccttctttccttcccttcttccttcctttctttgtctctttgtccctttctttcatggcagaagccttttgcctccttaatatcttaagggagatttttgaagtttgccctttggaaaggtacttctttttaatttaggattaaaaagatagcttttttttttttctcatatgtgacctaacagtccagcacttccagtttagcactcagatgggaaggtgccagtgatagctgagggaagcaggaaagggcatatgtaggtgatatttcacatcatcacattatatttggccataaacttttgctaatattactgtggaactttaggacttttacagtagggaataatttatattttaatatgcaggaaaaacaccatttttcctgacaagcaatgacatatttcattttaatctatgataaatgttagttaaagtcaatttaaaaaatactgtaaagctcaaaattatgcctatgatatatatgtctttaataatgtcttttattaatgagataagattaggagaatttgatatgagagctaacatttaagaaaatcaaaattatgagtcatagtttcactttttaaagttgatttttgaaataatgtagatacatggttaattgattttaaagcagtgaaatattgtatcctcataatatacactgtgtctaaaaactacctgtaaatctcaatttgttacttggaggtgttttttttttaacataaaataagatatctacattctgaggcattgaggaaattggattttataaaataactacaataacccttttaagttgtttttttgaaaatgtctccacctttcataggttgcttattgacacatagcttgagaagagaacgattttctgagagatttttttaacattgatttagccatttagaaatggattttaacttgttattgatttgtgtattattttacatattatatctgtaagattttataagaaatcaaacatcctttaagatgccagttgcctgctaagttacttgtcattttgataatatttcggtgttatttccaaatagtgttctatgttgaagggcacagatgttattacattatgtattttaaagtaaagtgagttatactaattatatgtaaaacattttatcacatattaatctcccttcctcctgatataccaaggttaatatgttcacatccagaccaaattctttgtgcaaatgttcctcaaaatctttgggtggccatcatcaatgcatcaatgacataataagaatttattgaatgtttacaacatattgaatggtgtattatttgatttattaggcacagacactttgtcagaagtttaaaatccatataggaaaatgacagatttacaaaaagacatttaaaagtcaataaaactagatcattaatatttaatatattatacataaaagctataggaatgtggagaaaggaaaccaaatggggtcatctactttaaaagtaaagagaaaaaaacctttcctgatgacggcaggactgaagttgacttttaagaactgatacgaggatgaagagaaatgagtttaagggtacaaacaagggaggaggaataaactcagtcgttgatagcagagtaaaatggctacacttaacaaaaatgtgctgtacacttaacaaaaatgtgctgtgatggacaccctgagtaccctgattttttaatcactatgcattttatacctgtaacaaaattcctcatgtactccataaatttgcacaaatgaagaaaaaaactgacatgtaaatatattttctctaattttaaacctagtaaccaattacttgctatgtgagcaatataagaccagcgtagaaggttcatgttccctgctgaaataggatgttgtgagctaatgcaacttacataaaaattaatgtgacacatttaattatttgcataatgattattttacctcatgttaattaggtataaattgtaatgggtaagggaaaggccaaggactaactttgcccacttcagctgttgcctgagtacatctaggctaagaatacggtcaccctcaattcatcccagcttcccagggcaaactgcctctccttacccctaggataagtgttggactccggaggattggggtactgttctctgaagttctcagccagccctctacaactataataccagctcaataggaagatgggtagaagccagttttttcaaacaatttttatacaaggttatccaccagtgttggagcacctaaatgaggaattttagcttctcctttctttttttcacctttacatattaaaggagaaaatattctgtttaccatggaaatgaaaaataaataaacacataggatgacattttcaagaagctcaaaggtattttgggtccagttgatcattgttaatttctaagcatctcttcactgaatttcgttgacactgaacttctactgtatcaagcagcatttatatctactgcaaatgtaattggcttaggacccttctctccttgttttgtcttaaatatttatttactttttgtgtttgtttgtctctcctactaaacaacaaggatcacatataccttatttccctttttatctccaaagtttggcacttggaaggtttttaataagtatttgttaaataaatttctgatttcatctgccatctctctataaattatttccaaattacaacaaatgtgactttatttaatctttactcaagatgttgaaagtggaactcattgcttcttacattttctactttataacctcaaaaaatatagtcctttctgagggttctgtcttcccttctaagtccacttagtaaatcatcaaactttgttttctttccttcgggctgtcttggtaaacctctttttctttctacctgctagtcctagcagttaccacttcctgtcaatatttgtcatccctcaagcctcttctaaacattaataatagaaaagatccttaaatcacaccttctaaactttgcctagaaatatcccttgagagtaagaaaataatctaaattaacttgatattcaaagtactccacagggatttccaccacaacctcctcaaattcattatacataaactttttgacaaagcaaactttactaaacaacgaatttgtatttctccttctttggtgacaccacaccctaaaatttttctttccttaattctcatcctgctctgagactaatcaatcccacctcatctctgttctccaacgcccagtaggatactggcttcctctttaaattctgtgctgcctgctttctgagccagccacctggcaactagccataaaagactgtgtatgcttttttacatttagaggtatatgtcacacttctgcacataaagttactttgctcaatagtagagagtatgccatatacctttttaatcatatcactttacacactagcttatatctacaaaatgcataaccattttacctatatactatatatacctatatacctatatatacctacatactaacaaatgttttaaatattacatatacagagatatgcatacatatataataactgtgttatagaaattccaaattcatcagataaagtacaagttcttaagaatctaataatagatacaaatcatgtagattactgaagaggtgcagacaaaatagttaccatgagatagagacacacttttatacgaatatatattatgtatacataatatttgtgggggatataattttgtatattaacttctagtttctatcttgattatttactttattgaataataataataagaaacatatttttgatggagaatagaaatagatttagttagtagaaatagtacttgttaacttagtgaattcagaggagatattaaagaggaaagcgcagtgtttacattcatatgaactcaagtgttaggtgagccaagaacacagcagaagagccaataaaaggagcaaaaggttcattgacaattgtattgatcaggcacatttctggctacttcaattgagagcactacccatatattaatatagttataataaaaaacacatacaaatgaactgtggccatttaaggaaaacaacacatggtttggctcccactactttatgggaaggtctggggaggagtttgtgcaatgtaaaaaaaaaaaaatgtatcaaaaatcacagtgttgaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacatggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaatgcagttcctcaccagcaacagaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagcagaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccgatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctctcagcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcaggagttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtatgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacagtctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactagcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtgcaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaattaaagaggacacaaacaaatggaagaacattccatgctcatgggtaggaagaatcaatatcgtgaaaatggccatactgcccaaggtaatttacagattcaatgccatccccatcaagctaccaatgactttcttcaaagaattggaaaaaactactttaaagttcatatggaaccaaaaaagagcccgcatcaccaagtcaatcctaagccaaaagatcaaagctggagacatcacactacctgacttcaaactatactacaaggctacagtaaccaaaacagcatgttactggtacgaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggattccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaatgaaactaaagagcttctgcacagcaaaagaaactaccatcagagtgaacaggcaacctacaacatgggagaaaattttcacaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcaccatcactggccatcagagaaatgcaaatcaaaaccactgtgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaagggctataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaagatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaatcacagtgtttgtgaactcaaaacttctatactgccaatctcttttaaactactatattatctgctgaaaagtcataattttcaataaaatgtttaataaatatgtgttgtcccatctatgctgcatactaggaattggaagtccttttagttactggcagatgttacagcccactaccttgtttgcttgcccaggaaactgatgtcagcaagaatgatcaggtctacaaaacagtaagattagactaggtagtaagggcaatgcatgggttgaattttgtcttacaaggaaaacaatgttgaccttctaacctccctggtcagaatgtgactttatttggagattgggcctttacagaggtaatcaatgtaaaatgagttgatgagattgggacctaatccagtaagcctggtttccttataaaaagagaaaaattgtacacagaaacaaacatgcataaagtgaagatgatatgaagagacacagggagattaacatagtcatctacaagccaagtagagagaccccagatcagattttatcctcagagcctccagaactgtgagatgctaaacttgtgttgcttaagccactctatttgtggtccttcattacactagccctagtcagctattacaggcagtaaacttaatcatctagctttccattcttctagttcacatatgtatgtagattattatgacaagaacaatgtgtgtctatatgagttctaagtctcaatagttatgaatgttcattaagtggcgatcatagaactgtaggagtattaaaatctagcaatggacatagacattgcaatctgctctattaaaattaatttcaacacttattctcctttctcactgataaatatgcaccccattttcttaaacttgtcctttagctttgtatgccagtttcacatgactattcccaaatgtctccctttcttcctggaaatgacgtggttatgacagatgatccatatagcttagaatggatgttttggataaatgtataaaactccagttagaattcaaatttgtgttctcttgccttgtgcttatttatacttatggttgtttaaacttgtgttacaatactgatgtctctttgtatttgataaacaacaaaacagtagataaacaaggatatatagacccaaagagataagtggcaagcaattattctgagcaaggatacacagaccccaaaagatgagtggtaagcaattattctgagcatctgactaaggaagggctcctcataatactagtggttatgggtgatacctgtgcagatcagaaagaccccacctgtctaggttctttttcttttcataaggttatggctgatgcctaatgtaatcattaatgtattcagggagccgtggaacacacagaagtccaggaagacacaagtagaaaattaggaattgattattagggaaaagaggaaagaaacaggaattggttgatatgcctatcctggttctggctgatgaagcaggttcatcaggaacataggaacagattctcaggctcattcacttaggaactttagattattgagataagataggtatcatcatctctcagagccactgttgaggtgatgtttatattgggtagaagattatagtggaaagaatatagactttgaaaacagaaaaagaaacaatattagtgctctggctcaactgtttactgggtgtagttctttttgcaaggtccttagttttactcagtgccattttctttttcttagggttgttagaaagacagaggtaatagcagttaatggaaattcctcatgttctatgtgccaggcactatgtatagtgattcacatgtgttaccttattcaatccttataacatgtttataagataaattgcactgttaatccttttaatacaaatgaagaaatcgagattcaggtacttgttcaatgccacaaagacgatatatggtagagctttgtcagtctagttcaaaagtcaaaacacttaaccctgctttctaatgtgtgcaaaacacttagcataatgtatgacatacagaaggattaagcgaatattaagtccctttttcccaactaactctaaaatattcagactgtaggggttctattaatgggttctctagtctgccaataggaaaatatcactgatgtaatggcctatttgagtctggccctgatgcatcatattctatctggtgttatttctcagtcaggtatagattctcagtcccacaccaatatttaggaccaggactagacataacatgatgagaaataatgggatccaaatgatgaatttatggaggaaggtggatagggatcttagaacatattttgttttccagacagtgctttaatcagattcaaagaggtaaaattagtttgtaagaagtcgaactattacttcatgacatgggtctctgtaagagaggatggtgacatttatataattatcaggtgaaagcaaaacgtagtttcagtgcagacgggaaaattactacaagggaacatgtgaagaacatgtgatattaaaccgagcagggattccagtggccgcatgttaggaaatgataaaagttagatagatagctataatgaaaggtcgcaagcttagtttaggttgttttcattaaatattccaggtaatgggagcaagtgtgagagatttccccaaggtaagggtatagcagggatggaagaagcaatggtttcagaagcaaaagagaaatatttgttaaagagagcaataaataagcagcgctatgtgcttagaaaaaagcggggagtagacacacaatcctaagtacccaagtacgcgtgcacaccaaagcaaatcattgaaactgcttactaatgtagttgagccttcatggtattttgcactcaaggtgctggtgaatgatcacaaagtaaaggtctccattcacttttttaatgtgatgcaaatgatttcaaactttattttcaaggtgccaacaaagacagcttaggctgtcattttcctatagatgctgctgtaccttcatacatcaaaaagtttatttgaataattacatattgtccacattcttatcacaggagtttcctaacccataataactacatcaaaagaatactcagctacagcatagtgcatttcaatagtgtagtcagtaacagatacattctaaaagcttttcaaacccaccagtatttagagattcccccaaacagatataattcatctgagtaaaatatatacagctgtaatttatcaggttgactcaagggagataaatcttactaaagacgtacaattaatcacagtccttctagtatttatctggcggcttagaaaagttaaatgtaaaataagagtcagttcaaattctctaagtgtgcattaatagagtctgtggttgagtaaatacacagaggaaaatggatttgtgttcaatttaaagtaaactatatttaaatcagtagtcctattcaatagctatgaatttaccaatttcaactctttcatgattcatgtatattataatcaacccaagtagttgaaaaaggtggatggaggaatacacaatcttcactacaaaggtataatatgcttccttttttccgtcattctaatagcttcatttgaccaggaaacaaaattacatatggaaaagttgtcttaacagccaattggatagactggcagttttatacttttggataactttaagaaaggtctttgagaatagtacctgaacacctaacatggataatagaattctataatcctacaatgaaggaggtattttgtggaatttattccatatgggagagtaaaaagcagagttaacaggggttgtcatccatactcatgattgcattttgtatttttcaagggctcactagagccacaaccttcaaaatagatcaataacattactcagcaactgatatgtaggaggcacttgcaataagaatttctgagtctttatactaactctgtgaggtacatcatattatttagaccatccctacgaggaaactgagactcataattgttcaacggaatgttcaaaatcagaaagctactatattgcaaagtctgaccaggttttctgatctcaagactgatgtaatttctacttgagcaagatgcagcagaaagtgaatgggtttttggagtttggggtcagatgcacctgcttgaaaggctgtctcacttatcacctgtggatctaaggattattctcttaatccctctgaccccatcttcctcttacgtaatttaaattgagtaggtaaaaagttaattttttataaaagcttaaaaattacaccacctgtactatgtaaaaaccctattgaattcccttcctagtatattgaacatctattatagtacagtaattaaacccatattgtcttctttagtctttttaaaaacttttgatctggaggattctaagtctttcatgaaacaacaacgtaggagcctgagctctccaaagctgcctttacaaaattgaaaggttctctagtttctcaaaacacaggcattatcatttattaatctttttaacttcactttatgcattcaatgactcattccctttttcatataacatttcatatgattccctctttcaactatttattattctttatttgaaaggcactctgccagattcagaatgcactaagacaaaattctggccttggagatgtcaacactgttgtgaagtgaagttgacacaccagtagacagatgagtggtataaagaggagcgggcaaggaactgagagcactggacccagaaacaagaactgaggttagaaagccaatgcaagtgtggagcccagggaattggcaggtttcagagtcacttacactccaggaagtttggaagccaaatggcaaagtagagctagatttctggctcaaggtctttagtccacaaccacgatgctcacaggcaccatccatcattaaagaaaaaaagccaaaggaggatgatatggttaggctttgtgtccccacctgattctcatcttgaattgtaagcaccataatgcccacgtgtcaagaaagagaccaggtggaggtagttaaatcatgggggcggttttccccgtgctgttctctgccatggtgagttagctctcatgagatctgatggttttataaggggctcttcccggcttcgctgggcctgtcttcttcctgcagtcttggggagaagggtccttgcttctctttcgccttccgccatgtttgtgagtttttctgaggcctccccagccgtgctgaactgtgagtcaagtaaacctctttcctttataaattacccagtcttgggcagttctctatagcagcatgaaaatagacttatacaaaggacatagcaaaaagtaaagcgagaataaaatcaggcaagaagcaggcaataaagatagcagggataagaagagagagaaaaagtaccgataatatgcagcaaaaagattgaaattttaatctttattttggcattaaatataaaaaactaaaatccttatagtaaagtaatatcaggatgatatatttgacaaaataatgattcaccatttttattctgaggataatagatacttgcatttgtgatttgatggaattaaaaagcatccactaaataaagtttgtcagatgaaataaaatgaagggttatttgcacaaatatattttagaataaatatttttgatgtaaactgttaacttgtactttatgtttggctaattttagatgtttaaaatctagattttgctaaaaatattggaatgagtcaaaatgtttcctgaattgttttctgcattgttataactatagaataattataaaactctgttatagctatatagcatgtgaattatgtttccaaaagattagcaaagttttatatgtgtttgaaatattcattttctgtcagtcaaaataaacttgaaagtggaagaatttaggctaggcagctttaatcattttttatccaaatgtagcaacaagctgtaattgcattatttcatataggtattacactcctatgtgcttgtttttactatatcaattccaaatatctatgtgaagtattttcattcattgtttatttttgtcatgtacatacaatcatttctcaggtttccgaatcaagtcataataacagtgaaacaatccagagtaaagggaaaaataaacatggttttctcaagttcaagctttcatacttatattttgcttttttcattgcaccacgagtggagggatggtgggagccacaaatagctgacttaaggactccatctgttagcaaggcttgtctcagtggcttgagagatcacatacaccctttggctgtttaagggaagaaaaaggcactgaattggattagtgattcttagccttaggggttgggaggagttagagctgggaggtggaaaaggaatccagtatccactgtgcatctcccagttctctgggctttgctggatgtttctgcgacaatctgttacagatctttgctcctcgatccaggtgcttaaatgctaacaataaaaatttgtgttgtgaggctggaactgtggaactgatggaaagtaaccctattttcctagtccattgccttatttttttttattgtaccccacttgataaataacttggcagccaatagcaacacaaagcacaacctataaagaagtatcccctttttctgtaagcttataatccttacgatgaactttctcaagaacaaggtagaatttaagtttttcctaagaatggccgtactgttgtttatgtgtgtgtgtgcatgtgtgtgtaggtaggtagggagacagataaatatagaagtaatactatatctattttattatatatacctattatatataacaatataatggtatatatcataaatatataaaaatatatattatatagatataaaatgtgtatataagaaaatgtatcttgccgaggaagagtgaataagaaaaaatttaccaagattaattatttgataactaagaaatcataaatacttgaaactactacttatatttgttcttgtttcatgcaaatgagaggatctgcttcatttgttattgggctctaattgtacttttggcttttggacttctctaaactgactatttttaccatcaaaattacattgttttgttaatagatttttctttataaaatcacaagattagaatttaacttcaagttagtataaacccaactttttaagaagaatttttattgaaaatttactcaattattactgattttgtgaaacctaatccacaattttcctacctatatttggatgaatagtgatatcccttcttctgatgatgacagcttagctactgaaactgacttgttcttttgatttacttttcttttggggctttttgttttgaaataattaggaattcacaggaagttgccaagaatagtacagagaagtcctatgtacctttcaactagttacccctactggtattaatagtatgttgtgtaattatagtacaacatcacattcaggaaattgacattgataaaatccacacactttatttggattttacacatcttgttttttttttttaattttttttggagcagagtctcattctattgtccaggctggagagtagtggcatgatctcagctcactgaaacctccacatcttgcactcaagcgatcctcccacctcagcctcctgagtagctgggattaatttttgtgctttttgccgagacagggttttgccattttgttcaggctggtcttcaactcctgggctcaagtaatttgcactcctcggcctctcaatgtgttgggattacatgtgtaagccaccatgactggcctagatttcacatgttctacacctgttctgtatacacttctccatgtaagcattgtatgtttttagttctgtgcaactttatgacatttatagatttgtataagtcaaaatatagaattattctatcacctcaagaatcactcttgctacccttttataagtccgctctgttccctctacttcccctaacatttgccattccgatgtggcagtcactagaaataaaaataacacataagatatatcattaagaataataatagtctaagctctaaagtcagactacttgattctgcaccctggctttacacttcctgccatgtgactttgaacttaatctccttaaacatcagttctcttaactataatgtgagtatattataccatgtacttcatggtgttatgataaaataattctgataattcactatgatagaaattgctatgatgtttgtccctgactagagaattacccatatcctcgaccagattataagatatagatatgaatagaatatggatattttcttataatctagtagagaatgtggataataggctattatatagcagtttatatagcagtataagagttagtggaggttgctgtggcaaaacctatgaagaaatttaacttagaatttggggaaagaatgtgaggaagtgataaaaactgatatagatgatgatacagatgatgactacatgggaggtaaagaaggtgaaatatttttcacagagggtagaggctggaattaaggaaagcataggtcctttaaaaaactgtcaattatggcctggtgcagtggctcacgcctgtaatcccagcactttgggaggccgaggcgggtcgatgacctgaggtcaggagttcgagaccagcctggccaacatggcaaaaccctgtctctactaaaaatataaaaattagctgggcgtggtggcacgtgcctgtaatcccagctactcgggaggctgaggcaggagaattgcttgaacccaggaggtggaggttgcagtgagccaagattgtgccattgcactctagcctgggcaacagagtgagactccatctcaaacaaaacgtaacaaaaacaaaaacaaaaacctgtcaattgtttgatatggctgcaactcaaagattgagagagaaggaccttttaagatatgctaactagtctaatttccaacctgagaaccacgtagcatgatcagttcagatctgcatttctgaaaaaccatcctggctgcagtgtaagttattattgaaggggatggtgacaggtatgtttctttataaatgaaacatttataaagttctaagaaggataatagtacattttcaaggaatattagtgcagatgtttgttacatgatttttgatagacacaatggaggtgatttatccattatcttcccgaaggctctgacaaagtttccataaagcttggctatattagtccatagaaaagtgacacataaactttagtagagactaatgacaatttttctttgaaaagatactctaatctcttattttcctcaatgacaacttatgaaacattttagaacttgagatccctatagttctagaggagattttttcgatgtgcaaaggaatattgagatcaatatattaccaaattctgtgcattatccattggggagacagaagaacttaacacatgaagacaaaccaaaaggaagtatgaataaataaatgtataaaatgaaaccactgagacaaatgagtcggtaaaatgaatgttgaaagacaaattccacctaacagttcatctatagtgccctacacatagttttatcacagaatttattacctactttgttcattattggttaacattcccatgtcctgtactagagaacatattactcaacaacaaagcttttattttatctgtaattacagcccctaatacagtatctcacacaataaagtactcatagaactttaatgaaggagtggagtagtgactgaatggtgtcaaagtatgtgggggtaaatatttttaactatattcaaggatgagaattttaaaagaaatacctaaaacttggcagaggtctggaaagtggttttcaaatttttggtctcagtatacctttaccctcctaaaaattgtgtttacagggcttctattaagactatattagatgtcaaatttcagattataaaacatgtattgattcatttaaaacaaacacattaatataaaaattgttggaagttgaatagtcttcatgaaattcttataaactaaccgaaggcaggaacatggtgggtggaagcacttttattgctttcaactgggcaatgatttgatgtgccagtcattttacaaatatatggtaagtatattgattcatcacttgattaatcactcacagtttcatgtactaagcttcatcttctgtgtaatctacgtgaaagcagataaccaaatttaactgttctttgtcacctaccagaagaggaaattggtatcctaagaatttctatcttcagcacaaagtttcactcaatagatgttgccattattctttttcaatcatagtgatttactgaggaaaactacaatgattaagcctgtcatcagttcttctaatacatggacaataaataagataaacatataatctagttaacctgggactgttgctgattgtgtctgttataccaggctaatactttcactctcagaatatttgggttttctaattttccatgatgtgatgattatgcattgcatgcctgtaccaaaatatctcatttaccccataaataaatgcatacacctactatctgcaaaaattaaaaataaaaaatttaaagagaatatctaggtttagatattaaactgtttggctaacccagccataatgcacaactttgtcagaagttttattaatcaatgagtctgacttcacatgccaaatgcacatctagatcatgtagtgaataaaataatagacatttcaatgaaagcttataaaatcatttaatgtcaccaaatggaaaaaaaggtgcagaattgtcaatagaatgctttagttatattatcccatttgtcccattcaagatcaaaactgactccatcaaaattcttaaaatcagagttttttgttaaaacaaaaaaatcaaaaaactatattagattttaacaatgttatttatatatcctaaaatatttctaattggagatcaatagagcctatattaaattctaaatttttcacaaaagtttacaaatttaattctgagtttgtaaaatgtattataatagctcaatgagcaactaattaaacataatatatatttctgtctggtttttcgttatgtttctattgtggttaaatacatgtaacctaaaattgaccattttatgatttttaagtataaaattgcttccatttcacatttccatggagctgtcatcaccatctatctccagaaatttgttactttactgaagttctgcttgattgtgatttttaagagtagaaaaagtatttttatacttttttgcatcaaaacgagatttaaatacattactcaaaaaataaactataattttggaactctgtgatcgaggcctagtaaataagttggtttttctttagagtgagtcttaaagattaaaaagttctttcaggtcttacataaaatgtgaaatactaagaaacaaagctgtcgggcgtggtggctcaagcctgtaatcccagcactttgggaggccgaggcgggcggatcacaaggtcaggagatcaagaccatcctggctaacacgctgaaaccctgtctctactaaaaatacaaaaaattagccgggcatggtggcgggcgcctgtagtcccagctactcggaaggctgaggcaggagaatggcgtgaacccgggaggcggagcttgcagtgagccgagatcgtgccactgcactccagcctgggcgacagagcaagactccgtctcaaaaaaaaaaaacaaaaaacaaagcttagatcagttgagggctctaagcaatgttaatctataattacttttcattaaacttaaattttaatatttttataagtgcttaaagtaaatctgcaggatacatattggttaagagacgaaaagtatttggctgcagaagcttgccacttttcagcgttaagcttgtcctcaaggctgagtataattattcccagttgtgttcattgttattttatccataatgagttccagaacctctttttaatatttttaacctcgtctttatctctaaatgtacatttaaaaatatcttaatagtatacaattaaataaaaagtaaacattcattgccagcatataatatttaattataaatattgcaaattcttatgtctttcatttgacatttcagtagtattttgctttctgagtagagttaatgatttagcaggatcttaaaactctttttttcttttcttttttttttttttctttttgctctttaactacatgaaaagtaaaatgaataaataagctatgcctaaaatagttaactgcatgcctggttttaaaggctgatggccaagcagttagtatcagcagaaatcccaggaaaggtaacaagttgcatatcaaatagtgggcatagaaaatcaaacgatggaaagctaggcccccgctcccccccggccatcagcagcacacaattttatagtggttttcattttgaaaaaaataggggactctcaaaaatcagaaagcaggttcctgagactgtgagttatcaagatataaaactgtgaaatcatcaaagagttgaaagtaaatatacaccaatagagacagaaaaataaaaactttagagaaatttaagcatctaactatacttagaattttttttctttacattttctaataaaataattcaatggatacttgtatgcctattttttttcattcaaacaatgtgaggcactatgttaggcaaaaggaatacaaataacacacataaagtctacctgcatggagtacggcgtctgtggtagaacgggcaactataatacaaagatacttattgtaagggccctgataggagtaggcacaggatactatggagcatgtaggattggaaccattgttcagtcatggccagtgatgaaagactacccaaaagcattgcatttaagttgaggtgttaaattcgagttaaccagacagagcagaaatgagaaaagcaatcagaggtaatgatgtggaaaagcctggagtcaggagatggctaaattggagtcaaaaaacaaataagcaaaaccagtgtacttgactgatgaatataaccagattgtaaattttaagttacacacaaaaatatatcaaaaaaggatattttttcatatttaaagtgaattactgtatagaaagatgccaagattattaaaacagctacaagtagtgagaacactgttttcatttcaagaataatatatctttataatacaaaaatagtaaatattaaaatatttgcttgcgatatttgggataatttttgtactgctctataatctatcacgagggctttgagcaggtgaacattactcctaatttttgcattggtaatatttttcattggtaatagaacaacatatgaatttgttcataatatttaagattgcaactgtaacatttctttattaaccttcttttagtaggcaagttatcctgaaaattagaaaagttgatgagcacacatgcgaaattgtcttcccagcactcttatatttgcccacataagtctaattgaaaagttagaacatttaccagtgagtatagaattatatggcatggttctatagcatgcctttaagcagaaatgttgaccacaatttttttgttggcactgctatccactgaccatttcctaaatagctgactgaattctctaacatcatggataaaatctgactcgttttatctggaacactttagagctacacacatttgggtggttaatatctaattgagtataagcccttacacctccccataccaaggcagccattgagcacatcttctatctgttgcctagtacttggctaagtgaaaatcctttttcatttacataactttttcattcacatgtagaattcagcaagttaataactgtatatttgcaatagcaggtgactgttcccctaattttgttgtatcatatattccaacgatttaaaataaaatttacaacacgtggctgtcttaaatgtaaacaagcttgcaatcaatttggtttaatgaaattaaagccctatagtatgactaaagagaagaaagcttttggttctttcctgaatttgtaatggaaacaactgttttggtctaaagagataatgaaaaacatgattgtgccaaaactctaggaaaagatttattcggtattagtcaacaaagtagaaaattctgattatctggggaagattatagagactgcattttaaagtggtgtggtttttcaggtactttatattgctcttgtgtgttaaggtgtggaataggatcaatcactttttcaatgaaaggaagatttaagcatagatgctgagccaacttctctgagcttttagtagaatgctaattaacagagatggtaatctaaatttcattgtattcttaaatttgggaacaggtgttatagcattgattattcaatgaaaaggcccgttccctggaaaggttatacacatgacttttgctaacttgttaattgatttttccccatggtattctgtttcacctttttattagaaaactgaaaaaaaaagtgccaagtgaacctgcatgctctttttcaaaaaattttaatggctctccaaacataaccctccaacattactgggaccctacacagtcctctcgctttaactttaaattagtgtctgtctcaattagaatgactctacattctgtaaaaatcctcgggcttctcttactcttgaaagtagcattgccttctttgttatagatagcagtacattgttcatttttttaagattcatttcaatgtaacctctgtttcatgaaggttttcctgataatccccctcatcctagtgatgtcttctgagttacaagtgtccttggtacctatttaccgcttaaaattatattagttagggtcttttcagctgtaggtgataaaacctcactaaaaataatttatgccacaaattatgtggggagttattaacccaagttagtgggaagttcaaggagtagcaataacttaagctcaactggatcccagggctcaaattatatggtcaagatactatctttgactaagttttgcttttctttgcatgaacttggctctcagccacttcatccccagtaggatggcactgatagtcaacagtcttgccaagcttacattcttaggaggtagcatccattttcccaaatatttcaacagtgtatctaagaaaattgctgattacattagcatattttgacttacataacctctccacagataaattactgtgacaaagaaaatgaagaaggccatattctcacccacaaacccagggtctcgggtctaatccaagaatgtcatatgagttgagaaaagggaggcatagttccataaaagaaatctcaactagttttaccaacaaacagtagtggagaaaaagaatgtttagcagagaaagatacaaaaaataaaaaaaaaaagataaaagctgtgcactaaggtatctgtatttatttgtactgatatatactatttgatttataaattgatattggggtgcgtagtaacctggatagctatcaaaacctttgtttctgacatacatcatttaaataactgtagttctcatttaaaaatactgtttaatgaagatgttacagaaacttgtaaattaagggtgagaagttgatattctgtcttcagttgttaactttgttgatcaaaagataaaattgtatctcaatatactaagaactaaagaaaagttaacagggaaatttgatggtaatcttctgaaccctcatttggtttatcagcatgtctcctcataggcttattctcattacaatagtttaatgaatgtattttgtactgtgtccttaggaatactgagtggtctttgaaagcagaacctatttctcggtgcccttctgtgtatgcattgcctagatcagtaccttatctatataatagttgttttaattgttgatccttttaaaagtgaaacattttcaaataaaagtacggcctgtattaaaggattattttgtttacttctgccttaagtagtctcactgttgacatttgagcagtttagaagctgtccttctaattggctagtcatttcttagctactgataatttacaagttgcatttgttttttgagctcacttcaaataatgtttgagtttctaggtaagtgttaatcctccttatcagatgaggtggtgggttttgagagtgaacataaaatttgagaaaaataacaatttttgaccatatattgccagaacaagtttttgctttagtcaatttagttgactaaagttcattttagctttcttttctcattttcaatagatagctgtaacattcttatatatttgagaaagcataacatggtgaaatccattctgagaagcaccctgccacaggcagcacggttattaagctcttggcaaatgtgactgatacatgtctgatggtgatacactgttgcatgtacacaaacttcatctttctccaaatatagctcattgcttctgcaaatacaggccatcagtcaggaagatagaatatggagatggtttaggaacccatcacccctaaagggagaatgtagaaaaacagctcaaacccttgcctgctagtgctgacaccatggtgtttgtttcacttgacgtgatcagagagcattaccagttacctgagatgctgttttgtttaccatgtggtgatttccatttcattctgcctagtatctagtccagtgttggacacatggcagaagagtaaataattgttccagaattaatgaaagattatctattggttaaagtcaccctgcaggacaggaaatagattaagtgcctttttcttttatactcatctgctattgaatttcacagtgatctattgtttgtcccaaatccatttcttgtttggcttttctactgaatgatgagaattaactttgtggaagaatgcaggtgggtgctatgagtgagcaaacaacttttgttacctctaagtcactaagcctcaaagcaattgtgtttcagagggataaaaaaacacattatttggaaagtcatgagtctaaatagaagagtaacatcaccagtaacataattctttccccgtcagtggaggttctactaatactggttatttcctagtatatctgaattatttttaaatgtatattctgtgagattcaatacagaaaaaggaaatgtcaattttcattattgtaacaactgtaccaaagggtttcttaattaatgaccaaaatacattaagatatgtacatattttatctaatcattagaagtcattttcatttctccagaaatttaacagctattaataataaatgactatggaagtacatcattaaatcttataaagaccttttttctgtacatacatcccatcacttttcttcaggtgaggtaatgaaactattgactcctttatcatattcaattaaaaagatattgattgagagagtttcatgaaagatactttttagatatttcacgatgacgtaagaagtagaaagatgagtgaaatatgatctttatgtcaagtctcatgagctcatgataagggcaagattatatatatatatatatatatatacacacacacacacacacacataaatctaatgaaatttaggattaatatgtattctcaaaacacataaaaggagatcaaagcagggaaatatgtaaaatgggagcagaaagaggccaacttcatgaaattatgagggaggccgtgaaggacacacagagatgtgttaaggggtgaatgggagaatggagagaagcgctgtagaaattgcaggaagaaggagtcatgcaagcgaagacatgcacagagggtgacattgagcccggctctatggatggggattaattcagcctgatggaaacatagattttctgtaggggactaatgagaattgacagtggaaaggttgcttggatccaaattgttcagtgcctccgacttggtaaagaggttttaagaaagttggaacatgagaaactgttttttaacatcacggaataatagaaggacactttaaagactgttttagtggaagtattcagagtatttatagattttttttgccttgttcatttagtttgatgcagctgaaatgcctcttctttacatctctgtttctccaaatcctgcctatccctcaagtccagtgcaaatgttgcccttcttcaagaagtcttctattgccccaccagactgaaggaatcactgctagagattgcagtgctggctttctgcatgtaattgcaaacatttttagtatgtcattttattttttttgtataaaatactatatatgaggataaagatctatgtaatctaaaacatgaatcgctgacattttaagggagacctagagagtactacgctgttaagaacatactgtgtatttcaaagtagttagaagagaaaacttgaaatattcacaacacagtgaaacgatactcaaggtgacagatgccccaaatactgacttgatcattatacattctatgcatacagaaatgtatgttcttttagaaagtattcctgtataattgcacaatgatcaagagggtgaagaaaatggtaaattaaagtaccatttctctgctatattatccttagtcagctcagcctcattgttcaattttccgtagtttccttttctccatgtagtttcagatgagaatctgccaagaaacattcaaggcttggaagggagaagtggagaggttagttgcagaaagattggtggatagaagcctgtcccctgagaggctcgctgttcgtgttgcaggcagcgaaaattgttggtgcccacactccatgagattgccaagatttgtcactgaccatgtgaatgactagattctagcagctatatccctcgccttactttcttagcccttccaacagtttttaaagcctctgtttctccatattgaacatttccaaactgaactacctaaagtggcttgtagcttttatttttcttaatgaaaatttgactgatacaacttctgttacaaaaactattcttaccatagttgaaggtttatctgatgagtaataccaaacatgattaatgttacgaaatggaaaaatatggtttttaatgtgagaaaaaactacaccgcattaaaatagtaaacctcagttcctgctacaagtgaaaataatttaaaaataacacttcaaggttatcatgtagactataaccccagtggggaatttagaagaaatatgtgtctcagaattaatttattatacgagtaaggagaatgagctggttacacacccactcaagtattaaaataagctcaggtggcattaattaccaagcactgccctaaaaatgtagttggaggccagaaaaagctcttatgcacttgttggtctttaatatctgggccagccaggcattgaaaggacaagatctgaaaggatataaatagagcactgacaagtcttgtgcagacaggttaaatgttttatttatctcaggattccccatatcatgcagattattcccctgttcctaggtttgttgaccattcaccaaaataaaattgtgtatcagatgggtaacttggctactagatcagggaagcacattcagctacaaattgtaggcatttcattcttatttgtgttggattactttgacttaaactgaacatgtttggtagaatgaacccctggatttaatcaggcaaaagtcttaatgtattcgttggttacacaaggtctcttgcagccttaaaaggagcaattagagtattcatttcagcatcaacttggttcaaattgcagacaaattgaagtctaatttattctataatttatcatcattatcactcacaatgtaactaggaaacttagtagtagtatttttagggtaaacatttgacccatctagaaatttcattacctatgcattgtattttctttaactgtttttaagagacaacactgcctaaaaggaaagacaactctagattgaaacaccacatctttaatgaaaacataacctcacttatttctggtacttgggaaattatgccagtgttaaagtaaagcatctgttattcctgagatcatgttgcattatttaatcaacctccaatgctttgtaaaactggtctcccagttggctgcaatgtaccgtgtattatatacaggtattaattcaaccaaaacgtgtataaaaatctgaattatgtctatctacacacacttccattggccaagaaacagaaagctaaataatgacacacacacacacacacacacacacacacacacacacacagaaagagataaataatatttatcaacattgaatataacagctcataaatcttataggtaagaaaatatttagagagctaacaaagggcacagggaaataaactggcatcaattacttctgtttgatttttttcctactttgtcagggaaatggaattgcatctaaataatggccttcccttatattttagaagcaaagttgtttacaaacctcaaacatgtaaaagctataaccagttcatttataaataatttgctgttaagataattgagatagtggcacttgcttgtgagagcattattggaaaaaatctggtagactcagcacatattcacaagtacaaattaaatactaaaacaaacaaaaagtcaacttttaaaattattaactgctcctgaaatttgccttactaaatactcacagaaaaaacaataaatatgttgggtcaatgccagaaattacaggcctactaatgaaaagaatgtaaagcttattactgttagcatagtaagaggcaaaaatggtgatgataatttaatttattttgtagccacaaaattattatataaaagattgaattaaggcattttggattgttcctttgctttagaaacttcagataagaaataactaatttaaaacaatgatatttcactaggtggtgagattttattcttgtctctatttggactagagtcccaaagtttaaaaagtaatttcctctaaattctaaaaaccattgtttgaggtctttactcttctggaacagacattttctcaggatctattaagaaatggcccaaatggtcttattatcctacagttatctatgaatatcttaacatccttgttcctagtctatacagttaaataagtattagcatattaaggggataagataaaggaatgatcaggggtacaggatttatggggaaagtatattaaaaataaaaattattagatttttctcatcatcaaaaaattaacaattgatgtacatataattttaaaaaaccttaattcttactactcgatgtttatgtaaatattctgatgacacaattatacagagcctattgctaggttccgtaaaaatataaaatgagatactcaattcatttcttagcattttgtatatataattacagtcaaataaatgttagagtggagactgatttgtattatattttaatatggtaatatttgatataaaatataaaaatacttgatataaaatatttgataaaaataatacttgatataaaatatttatgctcagattattattaaataaaaacattccaatagatatatccaaattagttttaatttaattgaagtgaattgatgatacgcatggatttacacggtgggagatataaaaacaaaacaattggtaactcccatgctagactgaaaaaaatcaagtgatttaaatgcctatcagtaggtatataattaaataaattacgataaaataattcattaaaaataaagatggatttgtactgattaaaaataataattgcaaaaatatttggttttaagacaaatttcaaaatgtactttgcttatggatgtgtgtgtgtatatacatatatatatatatatatatatgtatatacacataatatggttggaaagatcatttaaaaagttaacagtaattgcctctggagagcaattttcaggacatcagggtggcagggtttataaggagactttcctttagtctaatctctcctatgttgatttcttctaatcatgtgaacatggtttacattaattttctgaccatggattcataggtgactcaaatgattacattagctgtctttcaccaccccgcacccccatagcaactatcatgcctcaccccccgtttcacacagtccaggcacatggccacatgtgataaagaacacaaatttctcaagacaaaaatcttcctatttcttagtcacaattcaggtctgcttttaatatttaactattaattctacgtgctggagttcgcaatttacttcaacacattctctgtccggggtatacccttgggcctcagttatttgtggattagacagtagaaactttatatcaagtccttgaccaatctcttaattatttaccatgtcaaagattcttcagtgttgttgcttttattgcacccttgtggaccatttgctaaaaagcaatttgctattttggagataaattagctttattacttcctgttcatgcacattgaaaagcaccgtggactgttattttccctaactcatccctcatcctcagcatcaatgcatctattaaatctaaaggcgtttatttttcacatcataaaaaggtagagttaggttatttgtcctgactaaaaacacaaaatacttttgctaatttatcctgcagagttgctgggttttatttccatgaaattaatcatgacaaaccaacaagcaaagaatcacactgagtgcttttcagtttattgaaatacagtgttagtttattctttatgtatatggagtataagattttgagatttaatactgtactaaatttctagaaacatagaattattaaaacatttgatttttaataagagataatggatacaaatattcctcttaccttaaataactttgatgtgtttcagacccatataatgagccatttatgtacagtgtaatatcaacctgtatagtaatagcattagtaaaatacagagtgcactttcagggtacttaacaaactgcttgaattagtaaagaacgaaatcaataataatataaatgtttaattataaaaacattattgaaaataattataatgctgaaaattgtagttaaaccaaactgtttattatagactaaagtttattgtattctatttatttccttttaattcagttgtatttacttttttgtgataaatgttacattgctaagcagtagtaagtttttagtaatatcatgtcagtcatttcaaatacttttttttttactttgttaaaataaagctgactaattggtattgtcacactcattgggaaaacacacacaaagacacacacatacaaactgaggttcagagaagttaaatgatttgtataagataacagcaagtaactggaatctagtagtctccccttatcagcagttttgctttctgtggttgtagttacctgtggttacttgtggtctgaaaataggtgaatacaatacaagtaggtattttgagagacagaccacattcgtgtaacttttattacagtatcttgttataattgttctagttttattgtcagttattgttgacttcttactgtacctaacttataaattaaactttatcataggaagaacatatgtataggaagaaacatagtaatatagaaggtttggtgcatccatggtttcaggtatcccctgggggacttggaaggtataccctgcgaataagtggggatactgtatctgaaatacaaactaagatttgtctgattatacaaaccatcttaaaattgtcttacaatttagtgctaaaatgtaataatgtacaaatatgtacatgtaatctaatgtagctaaatatgttaattgaaataaaattatatactgtaaatgttcatagtaattatcattaaatttgtaataatgcaagtatctttatagcttttctcaactgaactgcaactagagttctgtgattatgcttagggtaaacatgtcatttttcccatttcacagctaaagtacaggggttggaacagtcagccaaggtgaggatgattttgaatgactccaaaggcccaggattacacagacagaaatctaagggttgtgtcttactagggagtcctctactcttgaaatccttttctttctttacttgtaccccaaattgatttttactctaatactgcaggcttgtggcctgaactcatggctttcaacttcacaaaattgaaagtagagaatatttaaaaattagtttcccacatatatttaacagtgttattaaccactgaatcagtagagtctagatctaaatggtatagatccagtaatttttaatgttcccattatgtatagagaaaagtctgagatgttgttttgcattgattggcattagattttcagatttgaaaagtttttggggtaaattattcagtttccatatattcagaagagttttgttgaaaccatccaaatgtccttaattacttaaggtatcttcttgggggggttacaaaaatagtcatctttgagttctgagacaaaatactgcaaaataatggatttattcattatctgaacggaaatgtaactgtttgcatgctaaaaagatacaccctctccctaagttagttcacaatttttaggcatgaaggactgtaaaagtatgagtcaggtcatggtgaaatggggaatcagctcccatttgaaacctccagaaataactctcctccaagtaagtggctacagaattcttaaaaagaggaaagaactttcagtttctcagtggccattttttattgcataataaacctgacaagaatagacttctattcctagaattgtcaatttgtcatatctgatgagcacaaagtgtcctatttttaaactgacgcatacaggccttgctcctgctatgcctgcattgtatagtaatggcatatttagaaatactgtacaatagaaatatttctgctaattttcagatctaaaaaggagacatttctcacatgtctaataaagagcaaggctctactgaatattagtcagaaaaatttgcccagtatcattggatattgcgatacatatttatcaagcagcttctacaagcaagatcatctaccaggtacttcatactgaaaggtgacataagacaaaataaatatttatcaagcagcttctacaagcaagatcatctaccaggtacttcatactgaaaggtggcataagacaaaacaacaacagtaaaacacccagaaaagtaaaccatttaatagagatataccctcggtgctataaagccacaaaagaaaagcccattgctttctcctgatcaggaaaagtgcagcaatattagggtttatgtttgtttgtttgtttaaggtttcacataagatgtgtagagcttttgaaatactgtgagaaaacatgggcaaagtgagctaggcaagaagcatctaaaatgcacataggcctggaaggagcatgacccacatgggagacaagaatttcaggagagagtacaggacacgtgtgccagcgggctgcagatcaggtcgaagagaaacgtgaggtccagatacagcaaaagtttaatactgcttgagaggttagcatacactttgtctcattccaaagcaataaagagtgttaagtaaggaagagatcctcgggtttgtgtttagaaaagttaggcagtaatatgcaggatgtattggaagtggacttgggagattaaaagcaagaaaatagtgttagaaagtagtttgcatggttgaagaaaaagttgtaagggctaaattcaaaacctgattaacgtctacacttcatgggtatttaaagataaatgtgtacaactttaaatgggataaaataaccagagaagaagagggaacagtgatgaaagtcaagggatgagggagatttaaggaaatacagtgttcaccagtgcacatattactaacaagtcaaattagatgaaagtggacaggctttattggatttagaaattctgaaggtgtttgattattgctggcaaaatttcgggggaaaggtagagagggaagactgactgcagtgggcacgaacggtgtctgaaggttgtttctatgaataagatatactaaaatatttacttgtattttaatcttggccctgatacttagtacttgattctgtctatttaaatggaaatatggttgaattagactatgctaatgttcctgttagtctctcttagtctaatctatacactactcctcagataagcatctgaaagcaccctccctctgtcaaacaccttacatttgtgaatgtattcctaaggattaggaactctgcccagtctcttctctgtcactccactttgtactttccacagtcagtattgggcaagaacggagatggattggaacagaagtaggcaagatgacagctctcctggtgaaaggtgacccgtgtcatcaatgtccctccacccatagcacctgtttgttccaccctattgtctagcaagagacagatatggaactctcaccggtgtaattaacgtaaggtttgctcattgcaatgaaaataggaaatagataaatagaagacaaaatatatactaatatctgtatacatttgtggggaataaagaaggaatgcttctcacaccattaatgtttattcctggacagaagtggaaatggtgtgggtttgactagaaagagaagtcttttacttttcacttgctataattgcttttctcctttttaattttcagtatttttcaaacaaaatcttcaacatgtaggttacttatgttgatatataaatgtgaaaattacagagtgttctgaatcaaaagcatgaaaatcagcaattgcaaacttgggagatcagcacaccctcatggaaatctcagtttagctattttttgcttatgcgagtcagttaaattctttgaggcccagtttctttaagatgaggaaaatgttaacaaaatttcacagttcctttaaaattagagattacatatttttaaacagcctggacagcgtagagcaggagcttagcaaatggtagatgataaaattggaaatcctagcagaagtaataaaacaaattgagcctactacatatgactgctctactccctacctttctgcttgccaattcctgagtcgaggaaggtttttgtgttctgagtagtaacctctgcagggaatttgaatcccagggatgtggtggcatttttatttttacaaatatatttatcagctatgtgtataggtgtgaaaacaaagaggagagggagaaatgtcctttaaatgacagcatccctagggaaaatgacaagctcatggtaggtaaataaattatgtttatgtatttgtatgttcatgtcagttttgttactattttcaagctggcatttgggggttcacagctttcagtttattacagtcactttatttataaaagtataaaacccaggaaaaaatttcccaagtggtgcactaaaccagtactctgaagcaagaaaaagcttttgtctgctttctttgactatttgcaatggaaaatgaatttgaaaaaagaattagaagcctttttacatggataaaatttaattaaaatttatttttagtctcttgaatatgcttcattcttaaaaaaggactgaagtagaaaactatataactaggaaagcatttttttttaatgttctgtaaattcctgacctaggaaaatagatacccatatgcatataccaatggacacttcataaatcatctaagaacaaaaaagaatgggaattctacttttatctttaactatttttacattttcagtactatagttatatgggggagattgggtggcctagccaaataattacccaatgaaagtgaaaaagcatcttccctaatatatgccaagatatttagacatagtttgacatgagcatagaggaaagttgttaatcaaatgagttctttttttttttctttttttttgttgttgttgtttgcaatttgctcttcagatccactttccacccttttctgttctggcctatcagtgttctaggaggctgggtctttgtcctgtaccaatgacctttcttttccttttcctccaggttttatttgggttgatgctatcagtgacaggagtagaagattgaagggcaaaagaaatgtaggattagaatattagttccctggtgtcctccagaccaagtcactgttagttgcctgtgttcttctactaaaggccaaaacttgatcaggcaactcttcatgtagctgtattttccagcatagtaacctgttaggttaaaaagtaaatgactcagctgggcgcggtggctcatacctgtaatctcagcactttgggaggccaaggtggggggatggacgagatcaggagatcaggacgatcctggccaacatggtgaaacccgtctctactaaaaatacaaaaattagctgggcatggcggcacatgcctgtaatcccagctattggggaggctgaggcaggagaatcacttgagcccaggaggcagaggttgcagtgagcgaagatcatgccactgcactccagcctggtgacagagctaactttgtctcaaaaaaaaaaaaaaaaaaaaaaaaaaaaaaagtaaatgactctgtattgcagaataggcactgtcactttgatggtttcctatattctagtatctctttggcaaagtgtcctattatttaatgataataatcattaaaatgtaattgttttctaccttaccctgtccaaattctgagacagtttatagtagcaaaattttagaaacaacttaaaccattagctatgagtaaagtatgctaagcctcataaataatatatagccatatagaataccttatagcatataaatgaataaagtagatgtacacagatcaacatggatgaatcacaatgtcatgatatcaaaggaaaaaaattagcgttgtatatagcataatacttgtataaattgaataaacataagcaaacacatcacatggcaatcatgtacatgtatacatagagggtgaattgggagaactcacatccagctcatcttggagaatttcaggtggttgatgaagactgtgccaattactaaaaaataaagttacatataggggttactgaaaaataattttaaaaatcagtatttttttaagtagtaggaaatgggcatttctcatattctttttagtttgtttttaaacttctcacgttttttgagtatattcacataatgtcaaaaatagaaaaggtgctcaaaaatatataactatttattttactttaaaattaactattatatcagtcttgcctttacatttcctatttgtctctacttattacttatatataatattatctacatattattttatacatattcaaaagactccattttatattcatagctctggttttaatcctcctgtgtctctgagccagcctttcagcatttcctctctttagcctagccttcatgttaagtgttaagagggctcttgtaggttgtttttatttttggtttatagtcatgcatctcataatgatgtttcagtcaatggtggaccacatatgtaacagtggtcccttaagattattgtatttgtttttacactgctgataaagacatacctgaaactgagaaacaaacaaaggtttaattggacttacagttccacgtaccttgtgaggcctcagaatcttggcgggaggtgaaaggttctttgtacatggtggtggcaagagaaaatgaggaagcaaaagcagaaatccctaataaacccactgaatctcatgagacttactatcatgagactagcacgggaaagaccagcccccatgattcatttgacctcccactgggtcccttccacaacatgtgggaattctgggagataaaattcaagttgagatttgaatggggacacagccaaaccatatcattctgccctgacccctccaaacctcatgtccttgcgtttcaaaaccagtcatgccttctcaacagtcccccaaactctcgactcatttgggcattaacccaaaagtccaaagtccaaagtctcatctgagtcaagtctcatcttaactcttctgcctatgagcctgtaaaatcaaaagcaaactagttacttcctagatacaatggtggtacaggcaattgggtaaatataaccattcccaacgggagaaatcggctaaaacaaaggggttttcagggtccatgcaagtccaaaatccagcagggcagtccaattttaaagctccaaaatgatctcctttgactccatatctcatacccaggttacactgatgtaagagatgggttcccatgatcttggccctgtggctttccagggtacagcctccctcccagctgctttcacgggctgcgtttgagtgtctgtggcttttccaggtgcatggtgcaagccatcagtggatctactgttctggggtctggaagatggtggccctcttctcacaactctactaggcagtgccccagtagggactttgtgaaggggctccaaccccacatttccatctgtactgccctagaagagattctcgtgaggtccctgtccctgcagcaaacttttgcctgtgcatccaagagtttccatatatcttctgaaatctaggcaaaggttcccaaacctcaattcttgacttctgtgtaccttcaggctcaagaccacgtggacactgccaaggcttggggcttccaccctctgaagccacagcctgagctgtacattggccttttcagccacacctggagtggctgggacacagagcaccaagtcccttggctgcacacaacacagagaccctgggcctggcccatgaaaccactttttcctcctgggcctctgggcctgtggtgtgaggaatggccgtgaagctctctgacatggcctggagatattttccccatagtcttgaggatgaacattaggctgcttggtacttatgcaaatttttgcagccagcttaaatttcttcccagaaaatgggtttttattttctattgcatagtcaggctgcaaattttccaaacttgtatgctctgcttcccttataaaacaatgtatttaacagcacccaagtcacctttatgtttttttttttttttttttttttgagacggagttttatcttgcttcccaggctggagtgcaatggtgcaatctcggctcactgaggcctctgcctcctgggttcaagcgattcccctgcctcagcctcccaagtagctgagattacaggcatgagccactacgcccagctaattttttgtatttagtggagatgaggtttcaccatgttggtcaggctggtctgaaacaccagacctcaggtgatccacccacctcagcctcccaaagtgctgggattaccggtgtgagccaccacgtcagtcccaagtcagcttttgaatgctttgttgcttagaaatttcttctgccagataccctaaatcatctctctcaagttcaaagttccacaaatctctagggcagggacaaaatgccgccagtctctttgctaaaatgttaccaagattcacctctgcttcagctcccaggaagtttctcatctccatctgagaccacctcagcctcgattttattgttcatattactatcagcattttggacaaagccactcaacaagtctctaagaagttccaaactctcccacattttcctgtcttctgagccctccaaactgttcccagttctgcctgtcacccatttccaaaattgcttccatgtttttgggtatcttttcagcaaggcccctctctactggtaccgatacactgtattagtttgttttcaccctgctgataaattcatatacaaaactgggaaacaaaaatttaattggacttatagttccatatgcctggcaaggcctctgaattatggtgggaggcaaaagagaaaatgaggaagaagcaaaagcggaaacccctgataaacccatcagatctcatgtgacttattcactaccatgagaatagcaagggaaagaccagcccccatgattcaattacctcctgctgggtcccttcctcaacgcttgggaattctgggagataaaattccaattgagatttgaatggggacacagccaaatcatgtcaattataatactatatttttagtgtacttttctatgttttaattaccattgtgttataattgcctacagtattctacacagtaatgcacatgctgtccaggtctttagcctagaagcaataggctataccatacctatagtctaagtatgtagtaagctgtactacctaggtttgtgtaagtatactctgatatttgcacaataaaattgcctgacagcacatttctcagaatgtatcccccttgttaagcaatgcatgaatgtatttttaagatgcagtgtcagctatttctgtaaaaacacaactcttgttctcaaagatttggtctctttttcatacctaccttgatgttcctgtaattgtttgcctagtcagactaacatctcactgatgaccatcagttgatgcttaaacatacttttgtaacttaattattggaggagacatgaaatgtaatgagttaagatttgaagtaagtacacttaaggaggttaaaaattgggagggggcaaagttgggagaaacagatggctgtgaagagcttgatcggataatctttttccaacaaattgagatttaaactatcaggtgtagccattacacttgaaataatccagctattgggatttcttaaaaggagatgcagacaaagtctgcacactgaattatcagaagaaatactgagtggaacaaaagggccaagaactacctgaacagtgaggatcaactttgataataataatgaaacaataggaaaagcaacctggaaaagtttataatacctcaattctagttactaaactgtgaattggttccaatcctcctcccggcctggttctcaaagggaacaggtagaagttctcacctctgtatgggactgaagacagagggatttaaaggaggagacgtaggagggcatgtcctggaagttcacgggtggagaaatggcaagccaccccatcttaggaagtagaaatgtgtagtgaaccggaaattcctacatcattatctggaatctggcctatgaaagagatgtcggctaatggggatttctggagtcagtgccattattgtcaaagtcccagccatcacaggatccatagtattccattaatatttaagcaggagaggtggaaccaaacctcaacttaaacctgggcagatctgatctcatggtcagcttagcttccctccctttgcctatctcccaacttttccaaccctgctcaatcctgctattaaatacataatagcaacaatagctaacattatttgtttgccataacttccagtatttgagagcgttacttcttcctcatcccacctctttggttcagttgagggttgccaggactgtaccctagctcccctaaaagcagggaagcatgtgacctcctccctttggatatgataattgggccaaagattgagatgaaacccacattagatcttcaagcatccttttctgggatttttctaagtgtagctgatagggaagatttcattctacttaagagaatgaaagagtgccagtcttgagtagcctctggtcatgttccctgctgtgctgaaaaattccatttgatgtgttatgtaataggagaaaatggcatgaatacagaaaaacaagattcagagagaaattgagagtcctgagaatatccaggtttcttgtttgattgtcactgattctacagtggtattctgtcatttggttttatgaagtaaaaaacctccctgtttttgaaatttttaattcttaatatctttcaagttggatctctgtcatttgtaatagaaattttcttataaacactccatatgtgcgaaatgctgaattaagctttttttattgatctttttcattgtttactttgtattttgtcattagttgacacatagtaattgtacatatttacagggtacagtgtgatgttttgatacatttatacatcgtgtaatgaacaattcaggtaattagcatatctgtcacctcaaatacttggcatttcttttggtaagaactttcaaagtctgctagctattttgaaatatgctttatttttaactgtagtcacgctactgtacagaacaccaaaacttattcctcctgtctaactataactttgtacacattgaccaacctttctccatcctcttctcccctctaccctctcagcctctggtaaccactgctctactctgcctctgtgagatcaactttctagattccacttatgaatgacagtatgaggtattagccctgtgcttgacttatttcacttaccataatgtcctctaggttcatccatgttgttgcaaatgacaggttttattctttttcatggctaaatcgtattccattgtgtatgtataccatgttttttcacccatttacctgattgatatatatttaggtctattctgtatcaacctattggctattgtgaatagtacagcaataacacaggaatacagatatctctgtggaacactgattttatttcctttggatatataaggttttaaaaatggattatctcatacaaaacttagaaatactcctatgggagtattttatgcaaccaaaacaaggatgtgcaaaatctcaataatggggaactagaaaagtcttgaatatgtgtgtgtaggtgttggtatgtctctgtaaaaatgtaggtgtatacgaatatttgattctttatataatacacatgcacagaggtaatctgaatatagatacataatgaggcaataccttgtgattaagagaatggatatgtagctgtattacctcagacattatacattctgtttcgagcatttgtaattccagcaatgtattattctggaaactcttctactacttggtatttcaatttttatatctataaataaggatgataactatacttatctcataggtttgttgagtattatatgagtgaatgtacatatattatttagaacaataaattgcaatgcataaaacaaggaatagagattgccaagacatattaatgttgttaatattaacaataattataataatagctaccactggctgggctcttactgttattccacatatattctaagcacagctggtatactttctgactgtgagccacacaaaccctacatagatgggaaccctatggtccttctaatggaatggaattgagtttctccagtaacatatatttagaaaaaaatgaaataatgtttcctatgtttaaattcttatatttcaaaataattttaattaaaaatgtaaaagaactatattaactttttgaaacaatatatgtggctttaacaaatttcagtaatttaaaaatataaacaattttttcagtatgccagaaatacatgtcccatgcaaagcccatattctatatgcacacatgataattttacccttaaaatattttgaattaaatatgtaagaatttctatatacaaaaacataaagcttcacatataaagctacttacaccttcatgtgttagcctctaaacatatgcccatatgcccactgaacttgtaaatatcatttccaaaaaagactgtctctagcgtagaaagaggaaatttgacccatgtcttggagaggagtcaaatcagaaactcctcctattacgtctttttcctttgctcgttttgctttgagttccagttgagcactttgaacacatatgtgaagaaggaaaactgctacctcacaattggcaaggtcttagtttcttttttaatgttgcctttggattgtactgtccttgaaatgtggaagaattgaggaagcaaacagtagaaccatatttagctctatatcacttcataactaataatttagaaatgaatctcaagtcaaataattaattcttcctatctataggatttcaaatgggcaaaacgatgttctcaccattagaattctgacgtttaaaattttttcacagattcccatcaatattgtaaaaaaatccttaaaaatatgttgtaaatataagcgcaagaaatcagtcaaaattggccatttaaaacatgttttgcttgttggtcaattcaactaaatttattttggcaaattatattaaatatttactaattaagcaactgagcaaagcactacaagttattgatatatttgaacatttagcctagtagatttttgttctaatatgttgtttttattctgatactcaaagaataaacactaaaggaactatacaacaggattccttttaaaagacattttcttttaacaataaatacagctttagattcttatatgtaaaattgcacttcgtattttaaataccttccagaaactgtttccaaactttaacattaagaaacaaacaaaaagatatgaaaaaaaaaattttgaggtcaggcgtggtggcttatgcctgtaatcccagcactttgggaggctgaggcaggtgaatcacaaggtcaggagttgagaccagcctggccaatatggtgaaactccgtctctactttaaaaaaaaaagccaggcgtgatgctgggttcctgtagtcccagctgctcgggaggctgaagctggagaattgcttgaaccagggaggcagaggttagagtgagccaagattgcaccactgcactccagcctgggcaacagagcgaggctccatctcaacaaaaaaaaaaaaaaaaaaaaaaaaagattgagaaaaagcctatgaatttctgagacttaaactactctgaggatgtatatgtttgtcaataaaataattgcctaatgtatatacccagtacccagtaatgggattgctgggtcagatggtattcctgattctagatccttgaggaatcgccacactgtcttccacagtagttgaactaatcattctactataaagacatatgtacacgtatgtttattggagcactgttcacagtaacaaacacttggaaccaacccaaatgtccattaatgatagactggattaagaaaatgtggtaatatacaccatggaatactatgcagccataaaaaaggatgagttcatgtcctttgcagtgacatggatgaagctggaaaccatcattctcaggaaactaacacaggaacagaaaaccaaacaccacatgatctcactcataagtggtagttgaacaatgagaacacatcgccacagggaggggaacattgcacacttgggcctgtcggggtggggggctaggggagcgagagcattaggagaaatacctaatgtaaatgacgggttgataggtgcagcaaaccaccatgatacgtgtatagctatgtaacaaacctgcaagttttgcacatgtatcccataacttaaagtataacttaaaaaataattgcctaatatgtaatgtattccttgattggattcctgacacaataagggttaagcaatagcagagcaaaagtttactgaacaagtccaagtcactagtgcagttaatttgtttttgtggagtccatctctcagcattgatttttgatctgggcatactttgccaggagctggagttatttgcagtcgaaaacattggctctgttttgtttattttgtcgggcagctcatgtctatgtacaatcactgcctggaataaaaaatggaaaagcctgttacaagtgaagaagctggatagcaaactacataagtaccttctttctatctggaaggattacatctaccctaatatacatatgcattcaacttgttttcccttttttgctataagtcaaatatgagaaatttattctatctgcattgacactttgcttgtgtcttcagctagagaagcaaatgtttttaaggccatgcttttttctacaatctatcagaatattcaatgtaagggccaaccaaaaggtaagatggaaaaactcaaggcagtattttccacatctctgtcagaatatacaatcaatccactcacacacgtttggctgactggtcaatatgactatttagaacataaagttggcatgcacttatgtccttagaaggtgtgtcttccctaatattttgagagctctttaaggaaaaagagtgcattttatttactaatgtaattcctattaagtatattgcccattagtatatctcactgaaattgacaatatgtgtaaatgacaatatgtgataaaagactgaacaaaaatttaaaaagaacttgaagcacttcatcaatgtcaattcttaaaaaaaaaaaaaaaaaaggaaaaaaaccctagacttgctattcagatcatttgcccatattacaagtagatgattggcttttttgctactgagatgtttgtgttccttacatattctgggtattaattccctgtcagatgaatagtttgcccatattttttcccattctgtagttgtctttttactcttgtttcctttgccatgtacaagcttattagtttacattaaccccatttgtttgtttctgcttttattgtctgtgcttttgaggtcttagtcatcacatctttttcacagatcagtttcctgaagcatttcccctatgttttcttctagtagttttatagtttcaagtcttacattgaggtcttcaatccattttgagcttcagtctatttagtgcttcaatacatttggtaaagggtgtagtttcactcttcttcatttggatatccaattttccccgaactgttttttaaagagactgtactttcccccgtgaaagttcttggcacctttgtcaaaaatcagttggctacaaacgtggatttatttctggcttctcttttctgttccattggtctatgtgtttgtttttatgccagtagtatgctgttttgtttactataatcttgtagtatattttgaaatctagtagtctcatactttcagtcttgttctttttgctcagtattatttttcactattaatgatcttttgtggttccatacaaacgttaatttttttctatttttgtatagaatatcatttgtattttgatagaaattgcattgaatttgtagattgctttgcatagtatgaacattttagcaatattaattcttccagttcatgaatatgagatttctcttcatttttttgtgtgtcttctttgatttctttcatcagtttgttatactattttttttttggagggaccttttacctccatcattaaatttattccaaggcattttattttttttttgtatctatactaatggggttacttattcagctactttgttatttgtgtatagaaacactgttgattcttgtatgttgattttgtatttgcaacttgatcaaatgtatttatcagttcccaaaggtttttcttagggtttttaggtttttctatatataagatcacatggtctacacagataatttaacttcctctttccctatttggatgttccttcttgctttctggtttcctcattcagtatgatgttacctgtgggtttaccacagatagcctttattgtgttgaggtactttccttctttgcctaacttgtcgagtgattttatcatgaaagaatattgaattttagtaaatgctgtttctgcatctattgaaattattacgtggtttttggcttttattctgttgatggtgatgtatcatgtttattgatttgcatatcatgaactagccttgcattcctgggataaataaatcccacttgatcatggttttggccaataaatttgtaaaaaatgttcagcattactaatgatcaggtaaatgcaaatgaaaaccacaataagctgtcatctcacccaagttacaatgactattatcaaaaaggcaatacataacaaatgctgggaaagatgtggagaaaagggaactcttgtatgctgttggtaggaatgtaaaccagtgcagtcactatggagaacagtatggaggttccttaaagaactaaaaatagcactaccatatgattcattaatcctactactggatatttatccaaaagaagtaagtatgtcaaagagatattctcaccctacgtttattgcagcactattcacaatagccaaaatatggaatcaacccaaatgtccaagaggaaacgaataaagagaatgtggtatatatttacaatggaatactatgtggctattaaaaagaataaaaccccatcatttctggtaacatgaatgagctagaggatattatgctaagtaaaataagtcaggaagaggaaattaaacactgcatgtcccactcatatgcagaaaaagttaaattcacagaagtaaagactggaaccgagaattctagaagttgagaatggtaggaagaagcagggagggggatagggagaaatttgttaaaggatacacaactacagctagattggaggaataagttatagtattctataacactatggcataactatagtcaagaaaataccaaatattttcaataagagaagatattgaaagttcccaataaacaaaaaatgataaatatttgagaatcttgatatgctagttgtgctaattactatacattttatgtatcaaaacatcactgtatgccccataaatagaaacaattattgtgaatttaaaaataaataatattgaaaaatagtcttgctaattacaaattatttcgcatgtttatatagaagtatctcccaaattacttctattaatttaaacttagtaaaatactctggatttatttattcaaccatttagttttatcctgatcaaaatgagtcagaatcccactgaaattctgaaacaagagaaacatcaataaggtagaattgtcattaggagaaaattcagaatttattggctatcataaagatgaaaatgtcaatgttgcaactttattttccctggaataaatctcaggtattttactgacacaaatgggcacagaagtctttgaataatgagcagatactgaaagaaaatattttttggtgacctgcagaacttccaaaaccacagtatgtgttgtaaagttactttgggttgaatatgaagacctacaatatagtaagatatttattgcttaaaagataaaaaatgaagaaagcaaaattatctggagagaaatttcatttgtttaagaagggggctcactgaagaaggaaatttttagtgaaacattaagtttttttcctacagagcaaatagttttttgaagaaaacagtctggagacttgattcatttggctctgtttactcaaggttatctgaagtattgccaatactttatgttggttacttgattacaaaaattgtttgtattttcaacctttttataaatgagtctttacagcaaacctataccacttctcattcccacaggaatgattcttggaatacctatatgtatgtcaggatcctctctcacatcaataagagttgtaatctacctgaaatgtgttatttttccatgcatttggagcatgcaaaagacataaaaagagtatttttttctgaactgttgagctatatgccaatctaaaaaatgaaagctacttctgtaataaattttttggtatggaacattattactcaagttgaatcttaatattacagagtcacaagagaattgtaaaaactgtgatctcaatgaattaatttatagtgagaaatataactatcaagtaggctactcatgttcggagtcagtgttttctttcctcatcagcaaatctaatggggagtcagatattattcagaaagtgttttggtaggcatgaactctaagcaagtggagttagttcattcacctgaacagatgattataaagctatgataacataaataacgcatcagtctctattatactaatcatctctgctacatgagtaagacccaggcttttgtgggataggctactctcagccagatagcaccataagaacattactgattttttttaaaacatagatgttacataaactactttcatttttgttctttccttagacaaaaagcaaggcaacttcctgtgataaaagttttcttagttaaaaggaacaacattcagttgctcttctctaatactcatctctctttagctgaattttggaagtacactggcaatctcttgtgtgatccttctactacaaatgaaataatactcagtagtagttcaacattccaattatgactttttcattgtaattatttttaaactgatatctgaaattgtacacatttatggggtacatggtgatgctttgatacataagctaaatgccctaattattatatattgtatctgtaatctcaaatatttagcaatttgggcaattaggcccaaaacacagttcaataatgttcttatctatgtctttccacttaaggatttaaagaaaccaagtttctaccttcagaaaagatgttaaatgagaagaataagagaaattgtctcatcgtttctaatttattctcaatatatgctccaacttagaagttatttgttatttaacatgcacaatcaagatgggactctgtcctttttagaaaaggaaagttgcttagcataaaatgcaagatacaggtgaataatttgaggacatatatcacagctcatgtagcctgaaatttgaaaaagggaaacagttatgttaaaacagaaatcccacaaacaatcatcaaaaatttagtaaaattgataacatagtatcttagatcattctattaaatgtttattgcatgtggcaattggagagtgcagaaaggggaaagaagttaaaatataagcagatgagaaaaggttaaaaaaaaattctaaaggaacaatatcttccctaaaagcaattcatcctagaaaatgatagaaattctaatctgtgggtaggcaatttgatccaaagcacatttaaatgtaatatcattgaacaagctctcttcatgcccctagtaagaatcgaagtgacagatataaagtgttttagctattagactttcatgaatcatactccaaattgtaaaatattttgttttatttttatcaaatctgtgtttcatctaggagaacagactggtttaaaaaacccatctagttaaaataaaatgaagtgttatataaattaaaatcaagtcacttccctaatatgcttttatcagcacttactttttaaccctatcaacggcctcaggattatatgtaaactttctttaacatgaaaatcaactataaaattaaaaatcctcatctcaagatatccttttgttttttacttacccatatgactgagacaataactgaataagaattacagaaaatggataagatttcatataaagatttgaaaaaaaagttctgcgttagaaaggaatgaaatttactgactacattagttttctactgctgcataacacgttgccacaaacttggcagcacaaacaccacaaatgcattatctcaaagtttctgtggttcagaatctccagcgtggattaaggatctcctctgttgagcatctcacaagactaaaatcaagatgttgtctggggctgcagtcttatctctcatctgaaggtcttccaaggtgatttaggttgttggaagaattcagtttactgaggttaagactgaagtcttcattgtcttgctacctgtcagccagagtgactttcacctcctagaagctgtcctcaggccttagtcatatagccccctctcacaacatgactgcttacttcttcagtgccagcagggcaatctatcttcagttggttataatagcatcttacataacataaaataatgacaccatcatctatactatctataccatcatctttgtcatataaagtaacctaatcaagagagtgactgttctatatgattcagaggttctcccaacatttaaaaggaacgctttataagagctgtgtccaccggaaagcggtattacgaagtacatctcacgatcctgtcaaccagagtgatttatttgaatcttacaaggctgtagtcactatcccaattataaattttgaaagctctgaaaatcaaaaccttgtctaacttatttggtgaaaaattttgatcagaacttacacataatttatataacttagtccattttgtacaactatttaagtttgcagtcgaaatactaacatgcttcagaatgaagtacattatgtatacactattatataatcattattttgtgtgttattaaacaactcactgaaggtgttcagtaatatactgaatatgtgcagcaaagtagtacctttctaaagtctaaacaatctctaaccctgaaacacatctgcccccaagggtttcagataagaaattttgggccaaatttattaaagttctttaaaaaggagttcattgagaaagggtttatttcaagaatatataaaccttggggtaagctcaacatttgctgatttaaatgaccttcaaaaggataaggatgaggaaagacaaagaaaaaacaattgtttatacatcaaatctgaattcactggtttcaattttattggtgacaactttgaaaaatagggcaataatgacagggagatccatattaaatacaaggtaagggaaaatatttattttactaatttgttcaagttactaaatgagtgaactcatagacagattggatttgtactactaaactgtagtacaaagaattgtctctttcattttcccaaaatgcatggtacatttagggcaagacatttttttataagcttgtttatctcatctttttccccataagcacagtatctggctcttggggcaaaacctgtttcacttaacagccaatttatccatccagatttgagtcaactaataaaaattttacatgttcatagctcccccgtctcagatttcaaccttaaatcagtaagtagttctatttattgaagaattaccatatttaaagaaagtgtgtatcttggtgacaatagctaggaaaacggaagtcctcaatccgtgtctatcaatactaaatgtaaaatgtgaggggggaaaatgcttataggcaagaaagaaatgtaaattggtctgtcaccaaagtccctctcctttgaaatgtcttataatttacatgtaatatatgtgaatttacaagcagcactataacttgcactttgaaagcaatgcttgagttaattaaatgagctcctaggagagcatggatttctcatcagatctttgctatagtcaggtttgagaatttaattgaggatattcgcttcttcataatgaacagagtaattttatagaattttttttaatgatttctacaatggattgttaggcagcttctaaactgtaagttaaaatgatatatccctctttgtctaaatactgccaaagcagtcagtcaaggcagttcaactgctgttatttctattaaaaaaaaaatccatcaagttgtttaagtacaaaacaaaatcaaaaaagccgttaatgaatatttttacccttcagtgatgataaatattttattagaatgcaaacaagcagtgaaagcacaaaaggaaatttatcagaactgagtctttgcttgaattttgagtgattactaggtatgttttcaaacagcactgcctgaacatagcttttaagtttttcaaattaaaatagcagatgtccacagtagctgtgtgtattagaattgtttaatttatggagctaaaatatatggtaggccaaatctaaacagtgttagaattttgagattggtagcctcctcttcctatggaaggagcttgctaaggggtgtatcagcttcttaaataggccattggcattcttagaggtttagcgtggatgggattaggcaaaggtggagttcaatttggaggttctgataatgcaaaagaggcaagagaggatggctgtggaacagggggtagtatgggaccaatggatatgaaatggtccttcagaaatcacattaaaaatgatgtaggtttcaatcaaatcagattttctgatctacatctactggtgaagttactgagttgggtgagaaagaatgaagacctgagttgttgttaaattaaattgcttattatgtaagcaattgcctgcctaaaatgatgtcccttaagtgcttaaaaggtctgaacattaattgcattttctataatgctcgtttagactaaaacaaattaaatcaattaaacaaatcttagaagatgtattgtgtaaaaatcccaagtcttttttagtagaccttaaataaaagttttgtaaacataatagatttgttgcctgatgtacacagcaagtcagtgtgttgagaaactaggttgcagcagaaaaaaaggtttaatcttagtgtccctgaatgaggagatgggaggacacatcaactctatctcaacttatatgggtttagagtttataagggttttggaatgggctgcagtgtgaagatctctgattggtggaagagtgctgcgtgaagtcatgggccagggagatgaagaagctgtattctcatgcagatcccattcctctgtgggggtcttcaaactggtaggtagaatttggggtcttcaaaaaatcttaagtggtccttaagtaaaatccttgtgattctaatgtcagaggtcctgtctgaagggacaatgagtatcaaatcaattattaaacagtcttacaagcctaatgtcagaaatcctatctataggaacaatgtggatgtgaacagtatctagtgctacaagactctcggcaagaagaagtggtccaaagtacagcctgactaatactaagttatgattatatttctgtccagaacttggcaaacgattcttgtcaactgcatgaggacaattccagttctatagcttaaaagttagatatgcagactgggagacttcttcagaaaaatctcttgcatgcttccttcaggctagttgtctgtcccctcaaggtcctaggtccatagtcttttcataaaggtcagaatctctttggaagcaaacagttgcagtgtcagtaaattactcccttgaactgatcttggggactgtgggattaatttggctttgaacacggaatactgaaaatagaagcatcagtctttatttatccagtttctgtataataaattccattgctgctttatccattttatatacatacatacacctatacacacacatagatgtatatacgcacacacatatcacacacatacacacataggtaatgaggtagtagtagaataaagaggtaggatgtaaagacaggaataaatttatccatgactccaaataaatgtgtgaacttttaatattccatttagctattcagaggctccacaataatacacgcataaaatacaaatatatacacacacgtgtatatacacacatatatatacacatatatgcatgtgtgtatatatatgtgtttctgtattgtagcacctctgaatacaggtatgtgtgtatgtgtgtatataggtataagtgtgtgtacatatgtgtaagtgtgtgtgttattgtggagcctctgaagagctaaatggagtattaaaagcccacaaatttatttgcagtcatagataaattaattcctgtctttacatcctacctctttaacctcttcatttaaaaatgaattgtaaggtatgaaaaagagatagattaaaacaagtgtgtcctaataagcttttggcatattaatttgcattttattgctactctttctccctccaccttcttaatttcaaagagatagctagacctttcatattttttttccctcaggaaattttccagatcacaaagtagaaactgttggaaaacaaagctttctcctgtccaaaaacttaagttcatagaaatgatgatgcaaagcgccaggcgtaagaggaaagaaagctaaatgcctgccctttaaggcaacacttgagaagggcaaaatttctggaaaatggaagaaagatagtttagtaagtttctagactgtcctggacccatgcactagttaatggaccttaagagtgggctgataaaatcttagaggtgacagttgtgcaaggtacccaggaagctggcacatttgcccagagatgccagtctcagcaaagatgcctgcactccactagagacatggaagactggaagccaagagcaacaaggctgcaaaacaccaggaaaacaggagatcagcaaatgaccacagtggactggatagcaaaggcccttcctttcattatcaggcagcttataagcctctctgactctgttcagggcctccaaaatacccaccagaacgtatttctttagaaaattgtctgtagaaaacccctgtagaagtacaggagttcagtatctaatttaacccagacattttgaaaaaaaaaaatgtgtttcttgcatagttaagtttgtggaccaaaaagtatgttgcctggaaaaaatgtcaaagttcaaaagagaagagttccctctgtcccagtgcccaacaaaaaataagaaaaaaaaaaaagagaaaaaaaataaatctaagtacagatagcttaatgaaaaaatcgcaaacctccaacaaaatctatacagaaagcctcactgaactgttgtaaattacaaaaaacattcctaaccatctacttagcaccttactggagctcggcatgttaaagggaaagtctttccagaagtgtttgaaaaacatcaacatcacaaaaagcacataatggatatatagaatagtacaacaaatgtataaaataaatatacctgcatctattttgggaatttgggggtttgggggtttccatatccaattccatatggtctaaggaccggaagtacacattgggcagggctgcctaatactcttgaaacagtctccatggtatccttgattgctgtacacggtgacacaaattccttgtatatcactgtaacctgcaaaagggattcactcaactgattattactacccagtaatgacaatttatttaaaaaaatattttaaacatttttgtgtgtttcataggaaggtttcgcttttgtttgtttttttaaaaacctgagtcttttaaaaagagacctgagtagtttttaggtacttgacaagttgcatagtcctgctgtcaattatgacgtattataatgaatggtaacacaaatgaaacatctgtttgatcattcagtgactacatctgttatgtcacatttgacacattgagcaggagaacataaaaaattcaaggaaaatttgtaaatgtgagtgctagatcattgattttgaaggatgagatgtgttaagattactagacccattcagaatttattataaaagcactaaccctgtaaattggccttctttcaccactgaggcccactctaatggatactatgtttgtaaatgcaattatatgcttttaaaacaaagtttaaatataagttcttaaaatttatattttattaatttaaatatttatgaatctttaagttgtatcaaacacctttttaggtgctaggatgtagctgtgaacaaaacacctcttgtggagtttacattctaaaacaagagtgtgcaaacacaaaagcaaaacaaaaaaaaattactcaggttgcaacaagtaatctgaaaagcagagcaaggtaagtggataacagctagtgtgccaatttatgcagggtgtttagagtatatgattctgttcattatctactgcaaaacttttaaataattgataatacaaaatgaaatcaaatcccctctaattcagaacaagtgaatagagtcagagctaaaagtctgatttgaaaggagaaatgcttcgtgtaggctgtctggagaatataaaattagaactaaaattttatattccagttttttcttaatatctcaggcaatgtctgataatttcagcaagctctccaatctacagagtatatagtaaatatttactcttgcatcacatttaacaattaggaatttagacagttagcttatttactgcttccgaaaataaatgtaaccagtgggcctagcgcagaggctcatgcctgtaatcccagcactttgggaggctgagacaggtggatcacctgaggtcaggggtttgagaacagcctgacaaacatagtgaaattctgtctctactaaaaaaaaaatatatatatatatataaaattagccaggcgcggtggcacatgcctgtaatcccagctactagggaggctgaggcaggagaattgcttgaacccaggaggtggaggatgcagtgggccaagatggcaccattgcactccagactgggcaacaggagtgaaactctgtctcaaaaaaaaaaaaaaaaagaaaaagaaaaatataatgagtgccattgccctgtctagaaccctcttcctttaggatcaatctcctacacaacatttacagggctgcagcacaaacatcattttatattgtgcctccaacccctgccacagttgatttacttggagatgggcacctcacccaagctggtcaaagacacttactcatgggctttggagggttgggaatgaaagatacatgatcatttactctttaaaataaaagttgtaaataccaagctggcagcagccatatcctgttaggtgaggacctctgagaagcagagaaagtcagactttctgaatgagtaataaaagaaaaagggaaaaaaattatgaaaggaagagaatcataagatgtggagagatccaatggcatttgtattccaggctctagttgttcctgagagcaggttttctatctttggataccataagatatataagtaaacataacaaattttatgtttaagctagtttgttttaggttttggtaactgtaaaccgtgttttaattaatataaatacactgcgtatcaatatactagtcttagttcttcagaaaaacagaacaaattgggtgtgtatatgtatatagacagatttattataaggaattggctcagaggattctaggagctggtaagtccaaaatctgtggagtaggctggcaggctagagacctagggaaaagttgatgttgcagctcaagcccaaaggcagtctggaagtagaattctcccttcctctggaaacctcagtcttttttatcttaaggccctcatagactggaggagacccacccaatcattatggagaataatctgcttcagtcaaagtctatggatcctaatgttaatctcttctaaaagataccttcagagaaatgtaatgacatatttgaccaaatttgtgggtaccatggattagccaagttggcgtgtaaaattatcttaaccaaatctagtaattatttaactttgctgttattgattgaaacaagaaaattatgagccacacatgtgggcagctgaccttttagaaaggtgcaaaggcaactgagcagaggaaagataatcttttcaacaaattttactggaacaaattggttaccagtatgcagaaatatgaacattgatccatccttcattttatatagaaaatttcacccataatatattatatagctatatataaaacctgaatctataaagttctggatgaaaaaatacaagaaaatctaggtgaccttgtgttactcaaagaattcttggatctcaaaataatcttcataagtgaaaaaaattatttaattcattctgtttgcttatatgtatgtaaaccttagaaagtacaagctaatttatagtgacagaaagcaaaatgttggttgcctaatgattttgtgaagtggggccaaggaagattacaaattggcctgaggaaagttttagggttgatgaatatgttcatcctctatattgtggtgatggtttcacaggtgtatctatatgtcaaaactcagaaaattatgcaacttaaatatgtgcagttttattatatgccatttacacctcaataaacctgttataaaactgacaaattatttttatagcctaaatagtaggtgatgactgcctgaattagggtagtaacaggggatcatggaaagaaagaaatggattaaggatttatgtatttttggtagagccagcatgacttgtttgaaataaagaaaataatgggataaagatggttcttacgctagaggagctgtgtaaataattgttccaatgtaacatatttattctttagaatccaaattctatgcagccgcctcagtagtagttacagtggtaagagaatctcagtgaatagaaactcttagttaatagttgtttttttcttctctacatttcaatgggtagaccttagttccttggtaaagttttctatattaatatactatataagattttatttagataattaatttcactgccaaacaggagggttgaaaatcactttactagcatctgggaaaatacattgattattcttgtattcttccttggcaaaaaatgaaaataattatatgaaaatattgatattttagtcaggatagattgatgttcattatatgtccagctcaattctaaaccatttaagtgtcttagattgtattctcataatcctataatatgggtagtattaacctcagctgataaaggatcaagatcagaaaggtcaagcacacaaatggttgggatgatacttaaattaggtctgataacaacatttatatgtgctcatctacagcacagaaaattctcctagactgaataatagaaaagtttaaactatattttctgatacatatctttgctgcaaagcagtaatgaaattaaaataagaacttagcgaagtgtcttacagagggaccttgttaatttcaaacttccttgaagttatcactaattagtataaagtgcctgtgtacagagttattacaattcatatttgtcaagaataagcaatcacttaataatgggttattttaataatcttagatccatttattatatattagattttcttttaaagttactatatgtgtatatgcatatatgtgtgtacgatgtgcatgcatttgtttgcataacaaccactatcaccaaaactgtgtccccactatgccgggtatccagcagtgtgagaatggactaatgcatatgcatttgtttgcgttcacatcatacacacatatatacatatacacatatagtaactttaaaaaatctaatataaatgtatcaaagattattaaaataaccccagttattaagtgattagttgagattggaacacataggtttcagaggtatttagaaattgcttcaaaaactaggtacaggtactccacgatacaatacttaaatgttagaagacttacttgaagagcatacgtattttcaatttatgtagaagcaagagaaaactcagtaataaaatatcatacatatagacagactatcatgagagcaatagagcaaattgattgtgtttacatggtttttttctatattcaggatgacaagtaatacctacaagtctataggaattatccaagtttttcaatatctagttcaaattgtaggtgaaaaatctgaatttacataaacattttttaataattttctactaacggggtttgcccttctgaactatatacttaaaagtgtttaaacttttactaagtactgagaatatttcaaagaaataggaaacaaagttgtttttcacaacattgttaataatgacataaaattagcagcagtgcaagtgactaataaggggggattgattaggaatatttggtatatcccatatgctacaataatcgacatccattaagcactgtgtagacaatcatattgagaaatgactgtatccaacataagatttaagaaatgtaaaacagcatggataatgttatcgaaatttcattaaaacaagctagataaaagtagtatacagaaatacatttaaaacgtaacaatggttatcaatttctgaagtgatgatagattatgctcattttcttcacattttctctttgcggtgttataataaacacgtatttatcttcaaaatttttaaaggaatagattaagaatctgatgtaataatgacagtaataaacctttaacatataagctaaaatacttcagtgtgtgtatttagcatcattatattctaattttaggagctcaagtacatttgaacactgctgtgatctggaaatttacaacttgcaatgtagtcccagagcagcaacagcagcagcatcaccagggcagtactttttagaaataaagaatctcagacgccatccagagcaactgatttagtaactgcatttttaaaaagctcctcagatgcatgtacattataatttgagaagctctgctctagaggacaaaaactctcttaagtagaaatgttgtttcctgatttttgattaaatgaacactgaatatacaatagaacatttaacaaaatattttataaaacaaaacaccagctaagttgtattatgtaagaaactcattagttcacatgagtagtactttgagtcatcttctagcagtgcaaaagacagtaagtaagatggtcttacagacaatagtctgatagaaagctgcaatgttaactctatagacaaatttaaatattttaagacttgcattaagaaaagaaataggcagagtgcagtggctcatgcctgtaatcccagcactttgggaggccgagggctggcagatcctgaggtcaggagttcgagaccagcctggccaacatggtgaaaccttgtctgtactaaaaatacaaaaaatagctgagcgtgttcatgggtgcctataatcccagctacttgggaggctgaagcagaagaatcccttgaacctgggagacagaggttgtagtgggccaagatggtgccactgcactccatcctgggtaacagagcgagactccgtctcaaaaaacaatgaaacaaaacaaaaaagaaacaaaaagacacgttaaatgaatttaatggtatatggttgatatggtttgactttgtgtccccatccgaacctcatcttgaattgtaatccacacatgccaagggagagagggaggtgattggattagggtggtttcccccatgctgttctcctgatagttttcacaagatctgatggttctataacgagctcttacccctttgctctttgctctttctctcaattgccaccgtgtaagacgtgcctgcttccccttctgccatgattctaagtttcctgaggccttcctgggcatgcaaaagtgtgagtcaattaaacctcttttctttatacttacccagtctcaggtagtatctttatagcagcgtgagaagggacaatgatacatttaggccaacacaatcaaagtattgtccttttaatagcaatcaaaaattattaatggggaattttacatttattgtacttattgttcaaactctgttgtgtatatcttaaggtcagactagccacgtttcaaatgctcaatacatggctagtgtctacagtattggaacggcgcgggtagagaccatggcttaatttgtaagttataaagtctattaagactgagccttatgtctttcagtttgtactctatcactgtgttcattatattctttggatgtgggaagacatgctttgtacaaatggctccaggagttttcaaaatctttatgaagacatgatgacattccagctacacttaataattgcattattgtttacatatgattgtgctgcccgagttcccactcagtggtccagtaacaaccacactcactaaaactgcatccccactgtgccgggtatccagcttgaatttatacaagttgtaggttgtggtgattttctttccccaccagtagagtagagagatctccaggatccagaaaaggccgtgctttaggggcaagggtgcaaggaaaacctggaccagagttttcagttctcagtaacaacattttcagtaattcttgttctagaaatacaggatatcaatggcatttttcgctatagccatcgttttgctataacattttattacattagaattataattttctctaatattagattaatttgaagaataagtatggctgcttaaggaacaaatactttgttggatcactggaactattatgctgattacaagttgaggaatttatatttagtcaatgcccaaatgtattataacttaaaataactcagagatgccacattttttccatttatataatttgaagaaatatttattactactgaaatttatgaccacatggatcttccagggtaccttattaatttttaatttattctttaatagaaaaaatgtgcacatgctaatttagctaatatggtataatgtggaatgccaaatgttgtgtctaacacagaatctttttcctggtagcactaaagctgctttatcaggacagactcatattctgtcctcaattccaagatacacaataattgaataagaatatgtaattatgtttagaaaataaaccttgaagtgatacttcattgaatatatagttcgctataagaaggatttcattttcagaagtgtaaaaatgtgaataataggaagaaaacttttattttcaaatcaagaaactatgtattaattgggaagttaacacagcagcagatgctaatttgcataacttgccttactgtattctagcaaaagaaatatgtgaaattcaaaactgaacaattttgatgtgacctggagttaagaaagttagagagcatctacatatttaaggaaaatgtctgggcatttttgaagagtagtaatcgtggaggaggagaaacgtaaccagagagcaaggcaagacatgtgaaaaaaatacacattaatgatactataggaataattgaatcttcaaacacaaattttgattttattacgggagcattgaaactacaatttttttttttttttttttttttttgagacagagccttgctctgttgctcaggctggagtgcaatggcgtgatcttggctcactgcaacctccacctcctgggttcaagcaattctccctgtctcagcctcccaagtggctgggtttacaggtgcccagcaacttgcccggctaatttttgtatttttagtagagccggggttgcacaatgttggccaggctgatctccaatttgtgacctcaagtgatcagtctgccttggtctcccagagtgctgagattacaggtgtgagccaccgcgcctggcctagagtacgatgtatcttgtaacaaaacacaatataaaacaaaatgctagtggatttttctttttgttctttaaaaatgattgttttctaatcattctcctatatggtggttgggagtaaaaacctcaccttagaagaagagcacaattatcaaattgttaactgtttttttttgtttttgtttttgtttttttgagacagagtgtcctgctttgttgcccagcctggagggcagtggcgtgatcttggctcactgcaatctccacctcccaggttcaagcagttctcctgctgcctcagcctccccattagctagaattataggtatgtgtcaccacgcccggctgatttttgtatttttagtggtgacagggcttcaccatgttggccaggctagcctcgaactcctgacctcaggtgatccgcctgcctgtgcctcccgaagtgcttggattataggcatgagccactgcggccagtcaaattcttaacttttaacttaaaaagttattttcccagtctacaacagaaagtgaattggagatgcaatggggaagaaccaatgggtttggtctcttcttgactttttagctggagagtaggctggagactgttagaaatgagcaaagagactttctccgaggttggtttggatcctgagctgtacattgcttcctttgctttcctattgcttctgcaaagggaaacatactaggtcctttttatgtctgggaaaccaagagtagattaaaaggcatcatgcttcacaaaattcatgctaccacaatagcacagagagaaggatgttgacaagctccgaaacagtcttacagagtctccatgctctttggtggagttcggagacagccgcaatggcatggatgtgtcatcagaagaattacaagccttggactgctgcataaaactaaagatacagtgtgaagacaaaagcagcagaaaccagggcatgactgggaagtggacttttttttcctatcttagcctcagctccagtcagaagggagagctgaaaaaacaaattctgaatgtgattaacattaaggttctccagggtattaagattaaaatccgttacaggaatctttattttttataattagttcagttttattttttgaaaaatacatggtttttaattgatatgtttatatctctttgaatgagtgccaagtaattctaataatagaattataatgctttaataataattagaataattattagtatcataattaaattttgtgatgctattaggatgtgacacatttagagtagtagaaaaagccaaattctctagaaattatgttgtattattttatggatttaacatattttatccttgaatcatagttgtttttttaaaccaaaggtcagtggtatgataatatttttaattgtatgaactttattttaaatattttaccatgtgtacctctcttttctctgtaattgcttacaagcattttgttttgttttcattctaaagcaattaataaattttgtaaatagcttttcagctgtttactaaaactcaccttcctgagttatgtataataaaagtaaatggcatttataagacgtgattatgtggaaattgacttttaatacaaattgcttctttatttttacacctcaatggctaatgttgatagtaaagttgtatatacaagttaaataaaattttggctctgtttattgtacccctggtaaagaagcatggtgtttgacccatagtgagtactcaataaatgtaaattgaaatcgataaatttcaaagctattaaaatacgtgtaataccatgcactcataaaaaggaatgagatcatgtcttttgctatgtcatggatgaagctggaagccatcatcctcggcaaactaacacaggaacagaaaaccaaacaccacatgttctcactcataagtgggagctgaacaatgagaacacatgggcacagggagggaacaacacacaccagggcttgttagcgggtggcgagtgaggggaaggaacttagaggatgggtcaataggtgtagcaaaccaccatggcacaggtatatctgtgtaacaaaccaccatggcacccatatacctatgtaacaaacctgcacattctgcacatgtatcctgaaacttaaagcaaaagaaaaaaaaaatcctggctttggaagttgtaattataatttctctgatattgcttaatgtaaaaattatgaatatccagtatgatagcaacaacagatcctactgtataaccaacatctttctcactgaaactgaatactgccacacgcaggattcacatagtatacttgtcatttctagttgaatgttattgccacttcagataaagttgccaagcttggcataaagaaaagggggaggtaaagggactgctagtaggacacaactaggcagtgtccacaccccagagtaccaaggtagctgtgcaagaagaatacattctattctatgatgcctcacgctgaacagagggctaattgatcacttacctcttgctgtgtggtctgattcagacagcagcaaagagggactcagtggatgtcagtcctggagtggtgattctcgtatccttcttgtctatcataagggaagaagtgctgaccagcgcccatgggaacggtaatctttgtgaacagctgtgaaaggaccacagcttaagaaactcaagggtggtactaaaaccaggaaatgtggaagaagctttgtttcctgccatgcttcaggtgggatttgaaccagaaaaaaacattatactactagttatcgctaccacatttattatactctcagacggttttcatataaccattatctgtctgggagcagtggctcatgcctgtaatcctagcactttgggaggccgaggtgcgcagatcgcttgagttgagaaattcaaaactagcctgggccacatagtggaacttgaactctacaaaaactacagaaataaaattagccgggtgtgggggcatgtgcctgtggtcctagctactcgggaagttgaggaataactatttattatcttatgagttggcattgttaaggacgaaaacacagactgaagtaagttttctcacctcattttgtgttgcatggctcaatatcaactttaaaatgctccaactggggggaaaagctgattttctatcaccacaagactacaattttgaaatatgtattttctatttcttgtgaaaattgatgcacgcgtggatatttgtgctttcttttaaacatgatttatactcttactttgtctagttttgcagagcatcttcagttctgccaacctctacatttataattttattataatagtgtgccatggcttgaaaatgtcttattggtcagtgaaggtagacatatggaggtttttacttatgctataatcaacgaaaataagacttgaatgaatcttaagatgagaaaagctataaaagattgagtcctgaaatggagatcagaaaattaattttaaaccttcattgccatctaaattattgtagtctacttatgcaacttcgagtaacctggctatttctcatttcaaactaaataggaaagcctagatgagcagttcttgactaccttttccagctattaaatatggtgtgtgtgtgtgtgtgtgtgtgtgtgtgtgtatatgtgtatacatatatacacatatatttttatgctagataatattcatgagcatgagagacttccatggggcaaggaaatgtatgtaggaaagtgagtaaaagtgttaggattacactatttccctgtttgatatatttttctagagcaaacaattgtgacagcaatacattattgttagtaaagacctacaacgaatcctaccacacttttatgatttagctctactggaatatctggtctctcttatcttacccagttctagaattccgtgattctgatctacttctttaatgaaggtttgtccctaagccaagtatttaagctactcctagaaattagtgccatagggaatgacattttctcattcaacaccctgtctgtgtatttaatgcatctatcataagcaataatgaaatattcagttgccaaaatccaatgagggttttgggagtttgacaactaaagtctataaactgctttaaatatttaaggagacatttattctcttaaattcatccctgtgaggatagatgcattgttttatgtgccatgttggtgaaaattagactctttaaatagaattttattaatgtctttggttcttattattctacttgtcagtttaaaaaatcttctaagggaaataccattaaacatgttctcccatcccactccccactatttatgtattaaattaataggaagtattcttaggttatgaagtcaccctattgcaaattcaagtgtaacccaacagcataaggtagataacataactgaggttgctacaactgagtgatgactgcaggtttttaatttatattaggctatttaaagaaatccccattgaagaattatgacccttttgtctccttgaaaaactaggagtcatccatttatctgcatctccggtttaggctgtcaacatttctcaccttgattattgcaaagtcctcttaactggtgtctcaacaccagcctatcactcacctaatctgacattcacactgcagccaggggattagactgaagacacatatacttactctgcataaaatgattgagtggctgcatgggaaaaaccacctcactagtatctaacatccttcctgatttaggctttgcctaactctacagtcccagtgatgttcaccattttctctactacagccagaccgagtagaggagatcccacaaatgtatcacatactttattctgaagatctggggtgtggggggaccaaatggccctgcaaactggtaaaaagcacggtccctggacattcaccataggtttgcatcttatccatgctgccaactaactgtgctgcttggacgcattttgaactctctgtgttactgtttcctcgtctctgaagtggtaattaagcagtgcctacttgatagtttatgcatgtaaagtgggtagaatcctgcctggcatatagtaggcactatgtaattatcgatactgttgtttcccttattctggaccactgtttgacactccccaggctagttctaactttttaaatggtttctttagctctcattttaaatatcattcacgtgtgcttgcgcttgcacgtgctctctctcgctttcttgtgagttctctcgctcgctcgctcgctcttgctctctctctcttggcttcccatgtagattgagtttttttttttttatgtgttacctctacttctcatactgtatggcaaggcacatttttacttagctgcctttcctaacaaattctaaacttgtaaacacagagattgcgtttatcttggtcgttatgatattgccactgcccagtacagtgcctgaaatgtatgagatcataatatttacgacaaaaagaataattagtgattttattaatagcagatgtttaacttattgaaaaacaatgtgaacatacataagcactctaagtgtatgaatatacggttgggtaaactgctggtgaatttgtgtgcatgtgtgcgtgtgtgtgtatgagagtgaaacacatgcaaatagcaaatgttttcaaaatttccaagttcacctgatacatgaagacaggagttaataaagatttttaaagtaacgtctaaacaagtaagaaaaataactttgaagggctgaggcacattatcgaattttttggaaacataaaaaatgctgtcaggaaagtgtcttgctgaaaatatgtattacttagcttttgttctatctctgaagtgtcccacaaaattcttcagaattaatctattacattttttgaataaaaataaaaattacttctgagaaattcagatgcttattggtaatagtaatatattcgagtagaaaataaattttaagtttagaggtataatacaccctctccaagttaaagaaatactatacctgtgtgcgcacgcatacataataattcacacactcacataaacacacacacctggtttgctgaggactttcaatcgttgcaggtgtgcgtgtgaaaaatgttactttccttgtaatcattctccaaatgtgctgtgtcatcatctcctttcctgctaatcagcggtatccaaaatgacatgaccagattgtgtaatttcttgtcacttttttcttatctaacagcctctttcgtattcttatgattcagttcagtttattttaaaattgtaatttcaccctcttcgaaaaccctactctgccccatcaaaactgcccatgacagctgtctgtggtttgcacttcactcaaacttttttccttttgctctcttaatgagtgctacctcctctggtattagggaagaaaggaagcagaaggaaagtaccagtgttgccaccacgtcctatagtttttttcttagtaggcttgacttgctgatctagatgattgtcttgcatgtgggctcactgtagataggtgctggctatagtgtgatgatggagttctggtaggcttctcctatgagctttagcaatccccttagagatttggcccccagagggtggctgcaaggcttacttctctgatatgcaccccaaacagaagctgtccaagcaaattcttacttacaatgtcatactctgcacgagcaagaggatgtgtccagaatcacatttctattaggaactgagaattccagaagaatattcctggaccctggcaactagatcacctgcctctgtgtcaactctctccaattttctctctctctttccagtagtatcactgggaagtgttatcaagccctttgacttaataaccttcattttaaaaattacattctagctgctgcttttagacttgtccagtagttaccattctttctttagacctgttttcttggctatggggaggagaaacaattccaaaaacagaaagggcaggtggaaaggaaagaagatggaaaagaaaaaaagtggaagggaaatttaagagttcctcttgtagtctttcataggtacctcatagatggtagtaggagagggctcagggagttggtgtttcatggtgggacacattctcttaggttaggctactcagggagccttacagaatggccattgaccccagctgggagtggttccctgaatatagaatgtgacacacttgaaattcttgatcctcagcttataagtttagctgcagttttagaatattagaaaagacccaactcaataccatgctatgcttgtagctgtaactccagttacagatctcagagagaggatggacatttgacaagctttcgacagacagctgtgtcaaaattgaaaaacattaaagtctaattttatgggcatcatagcattttgataggaagcacagacttatagccagatggctagatgcactaccaatcttacagtcctttgtaaaataaagataataagaatgattatacagagtcatggtacggattcaatgacttctgtaaagcatcaagaacagtgtctgatatatgggcatttctccttttttaagttcagggatatgtgtgcaggatatgaaggtttgttacataggtaaagtgtgacatgggggtttgttgcacagattctttcatcacccaggtattaagccttgtatccactagttatttttgctcatcctctccctcctcccaccatccactctcctctaagccccagtgtgtgttgttcccctctatatgtccatgtgttctcatcatttatctcccacttataagtgagaacatgccatatttggttttctcttcctgtggtagtttgctaaggataaaggcttccagctccacctgtgtccctgcagaaaaaaaaaaaagatctcatcctttttcatagctgcatagcattccatgttgtatatgcatcacattttgaaaaagtcagtctatcattgatgagcatttaggttgattccctgtctttgctattgtgaatagtgctgcaatggacatatgcaatcatgtgtttttatattataatagaacaatttatattcctttgggtatatatccaataatgggcttgctgggtcaaatggtatttctgtctttaggtctttgaggaatccccacactgttttccacaatggttgaactaatttacactcacaccaacagtgtacaagcattcctttttctccacaactttgtcagcatctgttattttttgacttcttaagcatagccattctaactgatgtgagatggcatctcattgtggttttgatttgcatttctctaatcatcagtgatattgagcatttttttcctgtgattgctggctgcatatatgccttcttttgagaagcaattgtttaagcccttggcccaccttttgatggtttttttttcttgtaaacatgtttaggttccttatagatgctcgattttagacctttgtcagatgagaagtttgcaaaatttttctcccgttatgtaggttgcctgttcactctgttgatagtttcttttgctttgaagaagctctttgctttagttagatctatgtgggcatttcttctgtttgttttttattttgttggttgcttgtcactccccatgtttgccctgctcccaagatctactaactcttcacacagaacctctggttgcctttgtgaaagctgcaaataccaggatgcaatcactcttgtcagacccaaacgaattgcagctgaaaaagcacaaagtagaggaactcatgcttacatgtctgagacaaggattgtctcgaggcttttctaaaataaccccacaaaaaatcccttctttaggactgcagcaattcagataagatgctttctaaagaacacttgcctaataacaccatcttctccagtgaattgacagcaaccttagctttgaacctctgaaaccaatgaattctgtttccaagaagcttatataaacttcccctttttgcccttgctctgagctttctcttacccttccatctttgggtagatctgtggcttgccatggatgtgcatactggattatgatccttcttgattattcccaaataaattcattatattaggaggcatttttctggttttgttttgttttgttttgttttgttttgtttcaggctgacactagggatgcctcttcagtgtcctttgctcagagcaaatcactctattgttcatcctactaactaattgttggagtaaacattgcttcatgtcctaaatttctctgaataattattgactaactagtgctaaatgagtacaatctagtaggatagtcactttaatagagagtaaacccataactccaagttgaaatctcgcccatcagtactgggtgagggaatggatttttgtagatttctgagaatttttaaatcccagcactaaagaagtcatctgtgggaggggcccagtgttatcctaaggttatagatagattttggtaaaagagtaaaaaaatgcaggctgggtgcggtggctcacacctgtaatcctagcactttgggaggccgaggagggcagattgcctgagctcggcagttcgagaccagcctgggcaacatggtgaaaccctgtttctgctaaaatataaaagatattagctgggcatggtggtgggcacctgtaatcccagccacttgggaggctgaggtaggagagttgctttaacctgggaggtggaggttgcagtgagctgagattgtgccccactgccctccagcctgtcgacagagcaaaactctgtctcaaataaaaaattaaaatagaaacagataaatctaaatggaaattctttaaaattcaagtgttttatattaatgggaggaaaacgagagaaggcacatagcccctgcagttgttatatgggtactaaattgtgactctgtcaacaagtagttgtgttaccttagtatatcatttcatttccttgcaaaaaggaaacaattgtatctgacttgttactctctagagctgtgtaatattagataatatgtgagaaaatactttgaaaaatacaaaattctctatagatattatgattttcactaccatcatctcagaactctgagagtgtttgtagatgccactcttgtctcatttctgccttccagcgatgttgtaattttcgaatgggataatatgtaaaactatgaagtgtccaacatgtaataaatagttaattattacttgctattcatattgtgatttataattattgattttattacataattttcatgctagaccatgagttcttattactctgttttactcagccctgcaccactggtgctcagaatatcttaaagatttaatatatgattgttgaattaattggctagttattgttaattacatcaataccatagactacaacataaaaacgaaaacattaagtatcacagtggagcaatagagaaggtaaaaattcagaagccacctggtgataaaaagctaaaactaacacagaaataaatagactacatgctttttgtcacattatgggatttttccaagaaatacatttctttctcataggcccctcaccaggcctctgcagtcactgcatggtgttctggcacatgtgaaaagcctgctgcaataaaatttcaagggcttctgcctataaaattttatatactgcagactttgaatctgcattactttgcagaaacaatggattttcgtttcataatttggtagtcgttaagaaaaaagaacttaagaaaaacatatgtaacaaacctgcacgttgtgcccatataccctagaacttaaagtataattaaaaaaaaattagtaagttctttaacttgccactgtggaaaaataaatctatacaacaaagtatgaaacacaaatcattacaaaggaaaatttattactgaaataaaagtgtgataaattaaggaattctgcagtatataaaatcttaaggccctcggatcttcttgtatgctaatcacactgcttaaagctttcccctaacatgcaagggtgttgctaggttattaaaatatgtatatgacatgtttgactacacttttagaaactcaaactcattatcaagctaaaaatgttgttatatttctatctcctactcaataactatttttaaaataaaaacgttctaaatctcagcaaaataagatttttgtgagataaaagtatgttttctgatgttacacaacaataattgatactaatccaccagaagtactaggcaaaaatttgcttattgaattccaaaatgaattatgttttattggccgtcgctcagacaggagaaaataatgtatcttgttttctctaattatcttctctgtttaacttatctcagagacctaaaagctaccaatggtgaatgcctttacatgttcatgggagctgtttttattatagccatctgagataatgtttgtccttgtccttctgatccaaaggacaagaatgtaactaacaatggaacattttctaccacatgagcagtttgaggatgttgatttctgaaccagccggtcaagtttacagcatttatctcttagttaatacatgaccttgatattttggggcacatatggcaacatgcagtctcatgctgatctagttacttttgcaataagaataacttaactgtgtttttgtcttctcactctgaagctattattcactagttccactaaacaaaaagatttcaaagtccacattaaaaatctagattacatttcttaaaaataggttttcctcgttgttcaaaactgtttattttattctacatccttctttttccagaaatgggatgggttggtgattacagtataaatacgtgtatgtacctatgtgtaaacattttcgtactgatttttatgtgtctgttgacttttttcaaaaatccatttatcatcaacctcatgacctcgcaattaccaaaagcttactgttttctaaacataccaaacaccttttcattaccgcttttgccctttttattggtaaaacatggattctccttggtactctcgaaaaaatcagatttccaactattatgcttctactgaagcactttatttctgcttcatacactcacagccctttgtctttatgatttttgatacttatatgtttttatttctattatttgggtacatttgactctcacaaaataagtacaaattatgtaaataattgttgaataagttatatcactacacacacacattataaaagtattttaaagtggttccctcaatattcagcgaatttctgaatattgcttttctacaaaagaacttaactacctggttaagtagcaagtaagttttttataaaagaaaagagaagttaaaacataagctaaaaccactaggcaaaaaatgttacaaagaaggattatatactctaatatatatatatgattcaaatatatggctacacaaaacaatcattgcaacatatgtttaaaaaatacttattcctggatgatggacacatgaatctaaatctctccactaattattttccccagacatccaggaaggaatgcgaacgggaaacatatgtaatcaagaaagtcagcacttatacgagaaagaaaatgccatgaatttcaaattaactctaaacagaaaattacacacaaaatcacatcagtgctttgaccagagctccaatggccactgcaaaacctgtgagtgtgggagggaagggaaagagaatccatgaaaaatgggagaggatagtgaaaagtttagagtatagagaaagttatctgtaaaaggataaagtccttttagaaagaggtaaattaatgcacagagttctgtggcatggtggcacagcgccaactacagtaaagaaataaattactaggtgtccacatgagaagaatacaaataaaatgttaaagtaattaaaggcatataaacaaccaagagaaattaagatatataacctttttttgtattccattccaaccactgtctctttgaccacattttttattgtatctgctattcactctctctctctctatatatatatataaaattccataaatatacatatttatttatatatttcttttaaatatatatataaaatatatgcattttatatatacttatatatgtcttctatatataggaaatacatatacacacatatataggaaatatatatatgtatatacttataggaaatatatataagtacatataacctctatatagggaatatatataaatattttatatatagggaatatatatatatataaagagattatatgtacatagtaagaatatatgttccttaaaaagggtgaaattaaaactagagacaagcctcattttatcgcactctgctttattatactgtggagataccttgtgctttacaaattgaaggttgtgataaccctgccacaaacaagcttaccagtaccattttcaaacagcatgtgttcactctacctttatatcacattttggtaattctcacaatattccaaactttattattaatattatgtctcttaaggagatctttgatcagggatctttgatgttactattgtaatttttttgagttgccacagactgcacccatataagactgtaaaaattgctgaacactgcatgtgttctgactgctccactgcaggccactttttcctgtccctctccctgtccttggccttccttattccctaagagacaacactattgaaattaggtcagttaagaaccctaccgtggcctctaagtgttcaaattgaaagaaacagttacacttctctcacattaaatcaaaagctagaaatgattacacttaggcgggcatggcgaaagccaagataacctgaaagctaggcctcttgcatcaaaccttagccaggctgtgagtgcaaaggaaatgcttttgaggaaaattaaaagtgctactccagtgaacatacaaataataagaaagtgaaacagctgcattcctgatgtagagacagtttgagtggtctggagagaagatgaaaccagctacgacattcccttaagctaaagcttaatcctaattctcttcaattctttgaatcctgagagagatgaggaagatgaagcttagtacctagcaaaagttgattcataaggtttaaagaaaaaagccatcttcaaaacacaaaaatgaaagatgaagcagaaagtgctgatgtagaaactgtagcaagttatctgggacatctatctaagatcatggacaaaactatctgaaaaaacaaattttcaatatagatgaaacagccttttactagaagaagatgccatctgggactttaatagctagagaggagaaatcgatgcctggcttcaaagcttcaaggcccaggttgactttcaacctgtattgttaagttgtaatgcacctgatgattgtaaattgaagccagtgctcatataccattccaaaatcctggacctcttaaaagttaggctaaatctattcttcctctgctctgtaaatgaaattacaaagtgtggatgacagcacatctgtttatagcatggtttactgaatattttaagcccactgtcgagatttaatgctcagaaaaaaagactcatttcaaaacatgacggctcattgacagcatccctggttacccaaaggctctgatggagatgcacaaggtgatgaattctattttcatgcctattacacaacatccattccatgaatcttgaatgttcttaatggcatctagagtggtgaatccttatcagaaggtttttaccttactttgcccaggaatattagaagaatcaccggctgtagctgtatggcagctatagtcttatgcaacatatttcttaataaaacttcaaaatcaaaattactccttgatccatagcctgtgattctgctgatgttcttatgcaaagtaaattaaaaaccttttgataaggattcaccactctagatgccattaagaacattcaagattcatggaaggaggtcaaaatagcaacattaacaagagtttagaagttgatttcaatcattatgagtgacttcagtggaagaagtaactgaagatgtaaaaatatcaagaactagaattagaagtggagtctgaggatgtgactgaattgctacaatctcatgataaaacttgaacggatgaagagttgcttattattggtgagaaagaatgcagttccttgaaatggaatctactcctggtgaagatgctgtgaacatggatgaaaccactacaaagtctttataatattatataaatttagttaataaagcagtggtagtgtttgaaagattgattccaattctgaaagatgccttacagtgagtaaaatgctatcaaacagcatagcattctacactactaagaatttttttgtgaaaggaagagacaaacatgtcgcaaacttcactgttgtcttattctgagaaattgccgcagccactgcgttgttcagcaaccgtgaacctgatcagtcagtagctgtccacatcgaggcaaggcccaccagcagcaaaagatgaccatttgtggaaggcttagatgatagcattttttaacaatgaagtattttttaattaaggtatttacattttttagatgaatgctactgtatgcttagtggactaaagtaaagtgtaaacatgaattttataagcactggatgccaaaaaatttttgtggctgtattgcaatatacacttcattgcagttgtctagaactaaacccacaataattcccaggtacacctataattatgttcatttataatttaataaagctttctagaaatgatcccttagatctatatattgaaaaactacacttctgtagtttacctgaaacgattaactccaaaacatatcttagtgaaactattaaattttaaagataatttaaaaatatccttagaatcctctaggaaaagagattaaattataacagtgagaaaattagactggctgtagacttctcaggaataactcacaaagcaaggagttaatggagtggaatttcaggaaacacaaaaaagggtaagccaagcattttaggtctaggcaaaaaattttcttcaagaatcaagtgtacagaaaaagaatatgcaagaaccaaggaacattatatacacaaattgtttatgaataatctatcatataatgagtttcatctaaataaaatgtcctggtgaaacttcagtaagggaattgatgattagcattaatatatttatttcttgaaatatgacttaaaaggggtgaggatatgagtgggtgaacaatatgtaagttttatacattctggcaaaataaagtattcaagtgtaaaatgaaaagagaagagagataagtgaaaatagaaagatattaattgtggggtacgtcataggtgagtcaaagaatactactaaaaatgaaagccagttagtacaatgctaaaaatatgaggcaggggtgggaggaagcagctttagggaaatggggactatataaactataaatacaaaaataatccatagaacaaacttgtaaacttttctaaataccaaagtaattttttaaaaggagacaatacattgagaaacacagtaaacaaaatataattcaaacagaaagtataccaaaaaatgaaagcaccaaacccaaacacatccgttctgtgtaataggttgaactcacctattacaataaaaagattttaaaattggcacataaaaccaaaatctatgttgtatgccagacccatctaaaatacagtcattccaaaaagttaaatgaatggaaaaaacacatcagtcaaatggaaacaataagacaacaaacctaatatgagaggaagtagaatttaggccaaaagcattagatgagacaaacggtgttgtttcatgttgctcatagccacagttcataagttacataaaacattactgatatctgtgcactaaaaaatacaaccacacacatacagaacataaacttcagttggtgcagggaaatataaagacaaaataacactaacaatagtgttgccttttattctgttgaattgtcttattgatctggaagtatttgttatttattaacatataattccatggttgatttcatgtattgtaaatattatctatatgactacatgactagtatttttacttctacagtagtatattttgataataaaagtttctaattttattgaatccaatttttttattgttagtacttctctatcatgtttcagaaatctcccttcaccgcagctcataaagatattgccctgtgttattttatggaaactttcctgttccaccttgcactttttcatctagtctccacctcatatcatgtatcatttgaggtaggaattaagttttatgttttccatatggatatgcaactaatccagtactatttcttgaaaagattgtcttttcctcaccaagtttcattgccttctttgtcacattttaagtgcacatatatgcaaaaataaatttatagatttttaattttgttccattggtttatttgtatatcgttgtgccaatatcatactgccttggttattgtgcctttataataaatctttttacttggttggccactttccaaaatgttcttcttcaaaatcattttgcctgatctgggtaatttgcattttcataaaaattgtaaaagtttgccagttttcacacacaaaaagaatgaggtttgtttgggagtacattgagtctatatatgaatttggaagataactgttttaaaataatgagtctcctagtatatagtgtatttctcttttacattatttgtcttactgtagtcagtaatgctttcttaaaaatctatttctaattggaaattttaaaaattatatatttatggtgtacgtgatgttttgatacatgtttatacacacactgtggaatggctacaccaacctaattaacatatgtagtatctcacatactatttttttggtgacggaaacaatacttaaattgtactcttctagcaaatttcaaatatacagtatattaactgtagtcatcatgaggtataatacatatcttgaccttaacttctcataagtgaaattttgtttcctctactcaacatattcccatgccccaacccccgtctggtaaccacactttcactccctgtttctatgagtttgacttctttagattctgcatgtaaatgagatcatgtggtatttcacctactatgcctgtgagtcaataatgctttatagttttctatcgaaaagtctagcacatcttctgtgaaacctttttctaggtattcagtgattttcactataccatatatactttttaaaactcatttttgttttatttctggaatgtagatataaaataatatgggttattgaatacatgtattatgataatactaagtccacttaacaactgtaattatgtaattgtacaaagttaaaatccttctcttccaatcttactttgtgtgcattcattcattcattcattcatgccttattgcactggctagaactgccattataatattgcataaaaatgctgatagcagatacgcttttcctctttctgaatctttgttaatgttagttcttggtttcttttcacacaccttttataagattgataaaacttttacattcccagattcctaagttttgcatcatggataggtgctaaatatctattgtttttgttagcttagtgttttattctagaaatttgtccatttcaaataattttcgtatgtcttgtcataaaactattaatatcctttcctgttatttcatatctgagggatctatattgatgattctattttggttcttgatatgaatttatatcttctctttctctttttttccattggtgattcttcaaaaattttagtaattgttggaaaaaacaaatttttgctttattgatctcttttctatgtaattgatttcaatagtattaatgtctgctcttattttttattttttagtttattatttttgtaatttaaacatgtttttgagagttgatttttaatcttttttctaaggtatgtatttaaacataaattttctttgaagtatagtttagctgcatctaacaaatttttctcacatttttgtcataatttcaatttttttccattttcattataattttttctttaacatgtgggtacttagaaatacattgtcaaatttcaagtgattactttctatgttttttctattgctttaaggctttgatttactctgtttagagagatacattgttttaatctattgttatcgagaatatggaaaattttagtaaataatgtgtttactattacaattagaaaataatgtgtaccatagttgctgagtacagtctttcatatatgtcacttaggtcatattgttgaaatatgctgtttaaatcttcccttctgattttctttctatttgcttcttccattaagagagaaagtaaaaaatattccactgttgttgtcaatttatctattatttttgtcaatttcagctttatatattctgagattacataatttgataaacactaatttaaaattattttatcttcttgtttaacagttgtctaataaaaggtctctctatttctggtaatcttgcttacttgaagtcttgtctgatagcatagataagcaagctttctttggtcagtgttcacatggtgaataatttcatctttgattttcaagctgtgttatattttgatgcctctcttgtgtgttgttttcattttcaaggctgacggtccttgcattttaatatattttctgtttaatttcctactgaaatacttggattcaaatcatctacattttatgttttactatttgtatcttgtatactccttttttccttcttcatgtaaattattttggattgaagttctttttaaataataattacctctattcccacttcatagtttattagtcatatatgcctttactattcttttacagataaccctgaagagcttaaaatatacatccttgactctttgaaagaacaaaaagaatttgtacagtgaccatatttcaaacaaatgttggaacacttttccattcattccacctgtgtatatatatatatgtgccattgtttccatgtattttattatgtatatatcttttaatctgcaaatggctttgttaacatggttttatacagtcattacttgaatagattgacccaccaatttatccactgctctctattccttcctgcgtctctaatgcttatttagagtcatttttattctgttgacagaaatttctttaggatttttaatggaactgctgttgatgaatcttcttttttttgtctaaaataagtttatttttattttgaatttttttctgtggttaggtagagaatttcggtttctttttgcttccttttattttctatattagttctttgatacagttcttgaatttgctcttttaagttagtagcaaacaaacatcatttttaaaacaaccatataactttttaattagaatatttaattatgttttcctaacccacaaatgcttttgcaatgccgttatttaaagttttttttccggaacttttatctctcacatatgctttcactgtaatgcatataagcttagagagattattgtgattttcttggctttttgggtttcgggtgtatattttcggggactttaggtgtcaacagacctaaaagcaaagagaaagtgtgggctgtcttcccactgtggccagtaatggagagcttgtggactgctggtctccttctagaatcatacagtttcccatttccaaaaactagaggacacagctcattggttcagagccttcttggtatcctgagatgtgaacctttattttgccagccaaattcttcccaggatcctcactccacagctcaaatgctggcctgctttttctctgcccaaaggtgaacaactttctcaccaattatttctgctcagactctcacagaaactgagttctcagaaaccacttaactcaggagatgtagatatactgacactgtcagtctacgtgaagagctctattcaggctctagaatcctcatagttatttatacaagaagaacttgaaggttaatgtacttacgtatctaccattcaaattcttcaattgttgttttgtacactgttatttagttgggtattataacagaaacgaaagaaaagaatgtactgacctgcccagttggcaaattgcacccaagaacccctcaacccacagagacgcttaatattatattaacaaggtcaatataatacctctcagtgtactggaactgtaatttactaagtaattagatgtctgacaatacaatattctgggtaaacataaagtagtttagtagccactgaatttgcctcattgtatgtaaaatcttcttaaaaatgttttgaagtaattttctagatagttaatttgctacttacccaactttaactgtcccagttcttatcttacagtgcctctcaaaggtcaaggccagaaggcacacattgaattttcaaaatgctcacttagccatactttatgggctgtagctcattctaattgctcaagttacatagtagttacttcatggtattcttccttaggctttatgaaaatgaatactacatttaggtggctcagtgataattgataccactagagacacagattatagggaacataagattctgctgcctttatgtacctgtacatttctcctaaaatatattcagttacttgcaaaagtcttggtaatatgtcttgatgtagcatattgtatttcaacaaaagtgaaagtagattcaggtgctggttctgtcctgtgacatgataggaatcaaattatattcccagtctttttttgcatcaattctcatgcctatatttaatatttagaagcatatgcttggtcagcagcattctgaactacagctttgaataatcctctgattagttattttccagatttccaggagctgtaagatggatttaagtaatatgttgattggttagtaaactacttgttttataaatcagcagtggattccctttgcgatatattcaccctggttatttatttcttacttgaagaatctacaaataacgcagatgagttaaaggaaacagagtagtcatatagtaaatcagcaaaacaaaaaatctgaaataaatgtatttagttttaataaatgcagacagcatcttgctatgttgcccaggccggtcttgaactcttagccttaagtgagtttcccatctcggtctcccaaagtgctgggattacaggtgtgaagccatcatgcccagccaagaaatttatttagaagacaaacaaacaaaaaaacacacttcagggactacttgaagtcagccaaagaacacaaagttattttgaacatgaattatttacaaagtcttacaacaggtgaggttgggataagtaaattggtgtaatcctcctttcaaggagtttaatgctaagtaaggagtcaatcgtgtaaactactctatgtgacaggtagaaagatggaaatttttttttccacagtgttttttaactttttattattattttgtcttcatcttttaagtccagaaatacatttccaggatgtgcggttttgttacataggtaaacatgtgtcatggtgctacacagtcatcccatcaccgaggtattaatcccagcattcattagctattcttcttgatgctctcccttctccccgccaccctctgacaggccccagtgtgtgttttccctctctacacgttaatgtattctcatgatttagcattcacttataggtgagaacatgcagtatttggtttactgttcctgggttagtttgctaaggataattgcctacatttcaatccatgtccccgcaaacaacatgatctcattcctttttatggctgtagagtattccatggtatatatgtaccatattttctttatcctgtctgtcattgatgggcatttaggttatttcacgtcttttctattgtgaatagtgctctaatgaatacacacatgcatgcatctttataatagtactatttgtattacttttggaatatacccagtagtgggattgctggatcaaatggtatttctgcttctaggtttctgagaaatcgccacactgtcttccacaatgggttgaactaatttacactcctgccaacaaggtaaaagcattcctgagggccgggcgtggtggctcacgcctgtaatcccagcatttagggaggccaaggcgggcagatcacaaggtcaggagatcgagaccatcctggctaacacagtgaaaccccgtctctactaaaaatacaaaaaattagctgggcgtggtggtgggcgcctgtagtcccagctgcttgggaggctgaggcaggagaatagcgtgaacccgggaggtggagcttgcagtgagccgaggtcgcgccactgcactctaccctgggcgacagagtgagactcctcaaaaaagaaaaaaaaaaaaaaaaaaaaaaggcattcctttctctccacaacctcagcagcatctgttacttttttttgacattttaataatcaccattctaactggtgtgagatggtatctcattgtggttttgatttgcatttctgtaattatcagtgttgttgggctttttttcatatatttcctggccacatgtatgtcttgttttgagaggtgtctcttcatgtcctttggccacttttcaatggggttctttgctttttcttgtagattttttaagttccttgtaaagtctggatattactcctttgtcagatgaacagattgcaaaatttttctcccattctgtaggttgtttgatcactgtgtttgatagtttattttgctgtccagaagatctttagtttaattagatcccatttgtcaatttttgcttttgttgagattgcttttggcatctttgtcatgaaatctttgcccatgcctatgtcctgaatgatactgcctagttttcatctagggtttttatagttttgggttttacatctaagtctttaattcatcttgagttaatttttgtatatggtgtaaggaaggggtccaatttcaattttctgcatatggctagccagttctcccagcactacttattaagtagggaatcctttccccattgcttgtttttgcctggttcatcaaagatcagatggttattggtatgtggctttagttttgggttctctattctgttccattggtctatgtgcctgttctttcaccagtaccatgctattttggttactgtagtcttatagtatagtttgaagttgggtaacatgatgcctccagctttgttttgttgttgttgttcttgttttgtttctttgtttgcttaggattgccatggctatctggctattcgggctctttcttggttccttataatttttaagatagttttctctttttctaattctgtgaagaatgtccatggcagtttaatgagaatagcatttaatctctaaattgctttagtcagttcggccattttaaaaaaactgattcttcctatctatgatcatggaatgtttttctacttgtttgtgtcatctctaatttctctgagcaagcagtcatttgtagttctccttgaagaggtccttcacatccctcgttagctgtattcataggtattttattcttttatgtctctgccaggtttggatattaggatgatgatggcctcatagaacgagttagggaggattccttccttctcaatttttttggaatagtttcagtagaaatgataacaactcttttttgtacatctggtacaattcagctctcagcctgtctggtcttgggatttttttggttggtaggcaatttattaccaccttaatttcagaactcattttggtctactcagggatttagtttctttcttgtccagtcttgggagggtgtatgtatctagtaatttattcttttcttctagattttcttgttacttacataaaagtgtttataatagtctctgatgacttttggtatttctgtgaggtcagtagtaatatggccattattgtttctgattgtgtttatatgaatcttctcttcttctttattagtctagcttgcagtctatcttaattttttcaaaaaaaaaaccagcacctggatttgttggtttttttgaagagtgtttatgtctctgtcttctttaactcagctctgatctttatttcttgtcttctgctagctttggggtttctttgctcttggttctctagtttgtttagttgtgatgttaggttgttaacttgagatctttctagctttttaatgtgggcttttattgcagtaaatttccctcttaacactgtggtagctgtgtcccagagtttctgatgcattgtatctttgttttttattattttcaaataacttcctgatttgtgccttaatattgttatttacccaaaagtcattcaggagcaggttgtttgattttcatgtagttgtataattttgagtgaatttcttaatcttgagttctaatttgattgcactgtggtctaagcaactgtttgttatgatttcagttcttttgcattttctgaggagtcttttacttctgaatatgtgaacagtttttttagtaagtgccatgtggtgatgagaagaatgtatattctgttcttgggtgcagagtttgtagatatctgtcggatccacttgatccagagctgagttcaggtcctgaatagttttgtaaattttctgtctcgatgatctgtctgatattggcagtggtgtgttagtctcccactattattgtgtgggagtctaagtctctttgaaggtctctaataatttgctttatgaatctgggtgctcctgtattgggtgcatatatatttaggatagttagttcttgttgaattgaaccctttaccatttgtaatgcccttctttgtcttttctgatctttcttggtttagtgtctgtattgtcagaaactagaattgcaacccctgcttttttaggttttccatttgcttggtaaattttcctctttctctttattttcggcctatgtgtgtctttgcatgtgagataggtctcttgaagacagcatatgaatggttcgtggttctttatccaacgtgccactctgtgtcttttaattggggcatttagcccatttacattcaaggttattgttatgtgtggatttgattctgtcatcatgatgctagctggctagtttacagacttgtttatgtagttgcttcatagtgtcactgttctatgtatttcagtgtgtttttgtagtggctggtaatggtttttcttttccgtgtttagtgcttccttaggagcacttgtaacaccggtctggtggtgacagtttcccgcagcatttgtgaaaaaggactttatttctccttcacttacaaagcttggttttgcaagatatgatattcagggttgaaatttcttttctttaataatattgaatatttgccctcaatctcttctggtttgtaaggtttccactgagaggtccactgttaatctgttgggcttcccttttttcatgacctgacctctttctctctggcatccctcaatattttttcttttattccatcagtgaaatgtttttatagtcaaataattttgcaaaacatttttttcataattcacaaaacaaatgcgtattttaagtgttcctatagtaaaggagaatcctttaatctgatatgacaccaattttgattgactatagtataccctaaactcatttttattccaaaaaatttattgatatcattagaatagtacacatttgtgggacacttaagtttgtaattataatagctgggagaaagggttacagccaataaatcctgattgtggaatcaagacagcttcacagagttggtgattgggcgtggaagaatgaaagcaatatttaaataggttaatctaaaacaggaagtacatataaaaatttgaagaaaaaattttcaagctgtaaaaattacataagcaagcagttgaaacatttctgcaataagatgtaaatatgtacttctagctatttttgaaagtaatgtagtcttcaaagaaaaacattaaaaactgagtacatgtgtgttttcagtacctgtgtgcacagcacagaaaatacaaatatatttaaggctcatttttggcatcagagaggaaataatagtctttaaataatattactacaatggaattatagctaaattattccaattaaaaaattcctttctgtatggagcttagagtttgtttttaaaacaaacaattatagaaataaatgtgaaattatgatacatagtacaaaagaagttacaacctgtgatgattgtaagggttttaaaggaggaggtatttgaattgaggggttgaaggatgagaagctgatgaggtaaaggttatgaaatgaggcatgacaagcagagggcacacaggcccagtggaccgtgaaacatggggtcttcaagggtggatagagtaatggacagtagagctgggacaatagaggatagtgagagacatggagtctctgcaaacataatacccaaattgagtagttgacaagaaaaacaaattttatttctgaaatagaaataccaatatgtcagtgggattttgacagacgagattgtttctttgatttataataatgtgacgtgtatgtttttagaatggataaaaattgacaacatgaaagttcagcttaactcaacaagtattcattgaatcaggttccaaaggtaggtaaatgaatatgatacattccctattgatgaaggagatagaaacataaatatgtgcatgtatctaagatgcctaaaaggccttttgagtgagaggaagtctgagctgatacataatgtataaacattcagatcttgaatctgagatcagacgggtgattcagatagaaggaattgcataaacagacacgtgaggcttaagcaaataatgttgccgagaaccataagtactttgatgttgttggaatgtaaaatgtgagaaaggaagaaaaggcagagaaagctagaaaaaaaaaacatgaaatatatcacaatacggctctgaagccaatacggctcatgaagccaaagacttagagttcgtgctatacttcagggctgtgcaaacttcagacagtgagccaaatctggcttattgccattatttggtgagtaggcattggaactcagccaaaattatttatttaatgttatctatggctgttcccacatttcattgtcagagctgagtagttgcaacagagtgtgtgtagtacacaaaggcaaaaataagtatcatgtagcctttacagaaaaaaagtgctgaccctgctatacataatatgccaagcacagtcttcaagtaagtgagtaacagttttagactttttcaaactaaaatacgtagtcaccacttttttattattatttcactttaagttctgggacacatgtgcagaatatgcaggtttgttacttaggtatacacgtgccatggtggtttgctgcacctatcaacctgtcatctacattaggtatttctcctaatgctatccctccccgagccccccaccccctggcagtcagcagtgtgtgatgttcctctccctgtgcccatatgttctcgttgttcaacttctacttatataagagtgagaacatgcggtgtttggttttctgttcctgaggtaccactttgtaagtatctaatatatgttaaacaccagactagatgatttactcacatgaactgcgtctcaaaaccattcttcctggtagatatcaaaattccccattttactgataaatatagagattaaggaaggttaggtgcctttccaaggccccataattttgacatttttgaatcaaatttaaactcagttctgtcgaacacaaaatacattacttttttacagtctggtagcatattacaaaaatgaatactagaatcaaatgaagtctaattgtgaggaatttgttgcagaaatcccaccaattcatgatctgtatctaaattaggtagaagggtaatagagagaaattccagagtttagtatggaaaataagtagatcatctagaatgacttctttattcttgacagattgggtgactaagtcagggaagcaacttcccactttctgttttgggtggttagaagaaagatatattcatttctagatacagggaatctaggacagcaagcaggcccacaagcagggtagcattgatgagtgatgttttgtacagtgtgtatattttcaaatgtctgaattagatccatgtgaagatagacaccagggtgttgcctgcaaaaggctaaaactcagagacatgggatacaagttggagattattcagctttagcatagagttaagaagtagcagaagctgacttttatacaattttaggaatgagtataaaatattttatatatcttatagaaatccattagatttagaaagaggcactggattatggtgcttaagaacactaagggccaggcacggtggctgacacctgtaatcccagcgctttgggaggcctaggtgagaggaggtttgagaccaacctgggcaacgtaggaacatagactccatctctacaaaataaataaacaaataaataaatagaaagaaagcgaaaaaataaaactctgtaaaagctgacaacctgagttcaaatcttacttctactaattttctataaccttatgcaaattactagatttacttgtgctttggaaacctcttctataaaatgtctattactaacactaaaagcacttaccttgtagggttgttaggaggattaaatgagttaatacatacaaaagttttaaaataatacttgtatatggtaagcaccatatagatgtttacctgtatttattaatttaaaaatattttttacatttcatatatttaattaggatttttcaacatagttttctcactacctcatataccaatgtttattctaaactgaaaagggatgtataagggtctataaaagagggctgacctgaatccaatattttctttatacctgtatatcagccataagcctggagcattgtgtgaggttaaaatgaatgaagtgctttaaagatatgtttgccacaatagagcttccttacatgtctatgaggaatattataaccaagcatactctcacagagtttaaactcaaatcatgaacatttaaattaagtttttccttattttgcctatacccatttttatctttcattgtcatttttgtttgacagagtatgatgagatagagtatttttatttggaaagtcctcagcaagacaaattagccaaaagcaataatggttcagattaaacagagtggaattgatctaatccccaggctcaactaaggaacagtcactatctgggtgtttgattttagactatagataagttgagatgttgtaatatttatggaggaattggctatgtcagttatgggatgaagactagtagtacaagtaccatcagtagtcattcttttttttttttaactttttactaaactaatacagttagatatttccactctatcatgattatattttttatgacagaaagaaaacagttccatgtttttataaatagtctctgcagagatttcagatgatgttattggtatcttggtttggcagtgtccgaaaaattgtgattgcctttaaagtgtttgtgctacttttagttaagtaaacccacactgtgtaagacccaggctggttccaagtaatatcaaggtttctatgcacataatagtttacaaagaacttaagtttaaagactatggattaaaaacaaacaacaacaacaacaaaagtgctttacagaaccaaacaaaccctctcttgatgggaatgtcaaaaaggacacatgagtcaactggaaactcttaaaggccaaagctgggacaatttgagcaatccaaaaaaatagtatgaattaatatccaaagtataaaataaatgtccttgagtccctactgatacaaataaataattgaataagtaaatgagggagaagggaaaatctcctatgcagaatttcaaataaattatgtagctgttcaacgcttaaagaaatacaacataactcttctgtgtgttgtacatagtgactttcttcccaagaatagagtgtggagaaggatggggttggggagagagaaaaagagggggagagagagagagagaaactttacagcctatgttcagtgatcaaggtcatcatcaacagtgataaatcatgctgatactatgtacgcctaatatgatgctttgagaatggcaccttaactcccaaaaacccaaaattcataaaattaattattaaaacatcagaaaatttcaagatactctacagaaaatgtgattagtgctccaagaagctttcaaaatcatcaaaaacaatgagtggctgagaaactgtcacagacaagaggatcctaaggagatgtgttgaataatgtaaaatgggatcttgaaaaaaaagtaacattagagaaaattagggaaatctgaataaagtatgaactttaatgaatattaatctatcaatatagattcactaagttttacaaatataccttaatataaggtatcgataatactagaaaccaagtgtggggtgtatgggaattgtatgtactatcttttaaatttttctgaaatctaaacctattgttaaaaagcttataaaacaaactaaacagccagtcatatgatttaaaagcaatcatggggaccctgattacaatttaacattctccttccttactagcttagtattcatattagtctcttcagctatgcaactaatttgtttttcctaaatagcaaaaaggaaaattgaacattaaccgtttcgacgactgttttactgaacgtttttcattatttgcacagtttagtttatatgttagtgtttttttttttaacttctgaaataagatttttttttactacgtatttcctatccccttaattcattgttgtagtagccaccaaaatctcggagttttccaaagtattttacattattcagtgtattttctgtttaacagaaatacattattcaagtattacattacattattcaatattatattattcaaatattttctgtttaacagaaaaataaagataagaatattacttgtaatttgattatttaaaatgtctagagaagagaagaaagctataaaggggaaatactcactaaaaaccgtattctaaaaatattcccagagatttaaaaccctggaatccctttgtaataaattatatttattttgagtccctaactgtgttttcatgaatattcacaatgttattagcttatttatctcctttttgggtcaaatgcatttactgactgtagttgcatgcttatggtgacagaggcaatactttaacactacctgcagagtcgcacattatatgttaacacttctaaaatatatttcctataccaactgttccaacttttgaacacattgtttcagtaattgcatggtagtattgcctgacaaaccaatactcccattttgttttaatttatacagaagtgtctttacaattaactaaatacttgttacattttcccacatcataaaattagggggaaaatagaaaaatgaaattactgattcttgtaatactataatcacaatcatgaaagtattctaaagagcaaagctgtgaatcttgatttctattaggtactgattaaataagtagtatagacagtgtgggaagcataaaaacacaaaaacataaaaaaaaaaaaaaacttgattctgaggagagtttccaaagagggagctactcttgtgagcataaaaattaaaacttttttttcctgaataaatgcaaagagaagttcatagggacataacatggttaataaaggtagatcatggtatatctttcatgaagagaaggaagataacgttcaattttcttctcaccaagatttgaaaatatgtagtaaagccatttcttgttcatgtcgtgatgattttcctgaacaatttcttacaaaagcaaatccttttagtatttcctaagcaatgacactttaaaattaactaagaaaattaaatttgaggtaaaattcaagatacaacatttgctacttatatttaatgtttaatttgtgtttctaatgcttttaaaattaacatctaaaaaactttttaaaaaatctaaaagtatatgtcctaatttgagtttttatcactctttaatatctacagtaaaataactttctttataacacacatatctcaaatttctcttcaaatattatgcattgaggtatcatgtaagacttccagattttattatggatgaaaatgggatctacttgtacttgaaaaagtaatgaataaacaatactctgattttttatctataaaactgaatcactacaaaggctagggataagccagtgatgtgcctagcgaagtattaagtgtatataaatcatctattgttaaaattactcactttctaagtgtttccactttaagttcaagaaaactaaccattgttagatcatgggatgcatttgaagagctttaaacacctcactaccacctttagtgtacactctaaccccataaagagctcattattgtcttccttttctcttattcctgtggcctttatttataaatctagctactttatttctgctaactttacataataggtccctattgctaagacctcacagcatttcacaattacttgattacacttaaaagttgtgcttcattccactgagagcactttgcaaaccctaacacagcagcctggcacatattgggtaaatgaatgaatatatgaatacatgaatacatgattattccatttaataccaatttgatattggcctccatggttccacaggtatcatcatgaaaatgtatagcaccactatatcttgccaaaaagaataaagttaatccaaaagagttgccaaatttacccagagaaaaacactttttaatttcttctctttaaaacgttataacatcataatgttctaatggagcaagttttctttgggactgaatgttaaatattatgttttgggaagcagaattagtaatctcttaaagtagagtactcggtcatttccatccatgattctatgatcacacaacttgatagtgaaaataactttgccaatcctgagtgtgaaatgctacgtttatgaaatataaaacgcatttagggcaattaaatatatcagcattttctttactgaaaactgatcaatgcagaatatttaggaaattacatttagacaaggcaaggctatgcagacatacattacatgattttgttcaatgtctccatttttatctcacctagctctaaaaggtggttaggcagatattagcaggttgactgaaaaatcaagtacttagtgaccttgtttaatttttgttcttatgcttcacatttcaaaaataataaaagccttaattttgtcatgaaatgcagcaatggtggccgagtaacggtaaaagaaatacaatgagaaagaagaaatgagcaggtgagatttattctgtattaaatggctactgtcctggtcctatctacacaaggaatagcaatttcatgctattgttcatacaatgcatggaagcagactttgtcaaaaggcagagagtgggggtgcatggaggataaggcttcaataagatttgctgtaattctcccctttgattacctcccccaaaatgagtatcaaaatgttctaccttccatcttggcagaaagggaagaagacatagggcaggtggtttttgtaactactagcagcaatgatgacaggaaaataaaagttttcattactgagaatgaagtgaaatatctatttaaggaccatcttattttcttaaaatatgtccattaatttatacattcatttattgtacaagcatttttaaacacaatacctatgtgctgattcactgaagggcatatggaaatcaaaagcaaagtcttgttcttcttcttcagtagatacaaatagaaatcagccaaacaacagataaagaatgcaaatgagcttcataaggaaatagggactagagtaaagtgtaaagtggaagagatggaacctgagaaatcatctcagaaagctgagtttggagaaaagtcctaggaaaaaagtagttatttttgaatactatgagtaagagattattgatataaccatctattttttcaataggtaatagaatacaagctggtcttgtagaatatgaagagaagagttcattagttttgggattctgacttattcccaaatatccagatgtttttcaaagtgatataaatattagatatatttaatggaacaaaataaaaataattttatgtatgaaagtgaagcattctgaatttgaattcagatgatcaaattgtatatgtgttatcctattctgtttaaaaaatgaagtcatagttcctatatatttttaaaatattatctccaatagaaataaatagaaaatgtttaattttcatttttattttgatctttcctataataaacctgtactgctttcaactaagaaaataattttttaaaactctacatttagaattgttctctgactatcacaaagtctgttagagtaactatgaagatgattcatagattctgctgcctttggctcttctttctctttgacttggcctttaacattgctttattcatattgagctattttactcctaatttcttcatacagttatgtctgattctactgtgaaaaagcattccaaattgcttaataccaattaatttgtgacattaacaagaggccaaggaacccagtcacagtccttatttatttactgcatttttgtgagtttttgttaatcagtgagtatatttaagttatatagttattaatagagataactctccttattagacaaaagctcacaaaaactaccttatcaagaagaagatattatgcaaatgcaggtggaataaatctaattttccatttttatgcacaagttatttgcagccccagtttattgtaaatgttgcagcacctacctaaccatatttttaaggtacatatttcatatgggtagcaaggggctaataataatgaaaaatttggacatatgaagtattcttttctgttactagccttgtcaccaaccgaacacacagccttgtttgtagctcactttcccattttcaacctattggcaataaaatatcaggtgttaaaaaatgaataaaatgttgtaaagtacttcagtggataatgtttcatatatttaataatggcaggcttattagtatcactagacataggattaaaatgtaattattatcataatcagttttgttataatatttagattctttttctaattgaaaactagatgcatactaactcattctcctgacattttgctgtcttcaacaataaatatttcaaaattggatcatattcactccagcagcatttaagcactacttatcaatatttttcaggatacttacatatatgaaagcccattcttgtgtctttatatccaagatgtttgatgttagcatttgagttaattcaggaatcctccagaagatccatctgtttcctattcagtgttgaaatattggtttgaaaagctgtttactaaggataaaagtaggaatcatctctccaggaaagaagaaatactctcatttatttttgtttgtgagatagcctctagaaaggatctaattaatgaagtatataaggatgaagtgtgttgaaactttctttcccttttaaaataaagatacttcgatacactgagggaatgtataaacgtcgcatgaagatgtataggatgttttaataggacacaggaagaatttttcttctatataataaatgaaaatgtcaacttcaagcactagctctataactcttactttaaaatcctttaaaaatgttaatgattgcgtatttataatctttgagttttgatttttaagttttaatttcctgagtgttttttataaaaccaaatacatatcaaaggtatttggggtttttttttttttttttgcttgttttatgacagtgtgcttgctttctaatcaagattaaaacaagccatactgatgcagattaaattatctagaggttgagttttgttaagtttctttcacttcttacatggactgaagtgatatatatcttcctgtcaaatgatctttatatcttgataatgttttcattgcataaatgtttctatgaatagtagtaatatataataaaaatacttgtcatttcttcagtgcttagtatctcctaagcactgaataaaattatttatatgtaatcttcacaatagtcttacgaggtaagtgttactgtttctgttttgaagatgaggaaatttgtaaatccgaaagtttaagaagtgcacctaaatttacactgctaccaagtggtcaaatcacaattaaaatttagttctgtttgattacaaaagccacagacatatctaatgacatgttctattagttcaatatgatgcttatattgataagatttcaacatatgaagttattggccattggttaatttgatcatttaacacagatatatagcatttgagtaactctactggatctcattcaactatcattagatccaaacaacgttgaaatttcgttgctagaaattatagtgcatgagctatataaaatgtatgatatataagaaatgattaatgcataggattgtaggtagagtaagaatgagaataaataatctgaaacaagttgtgatggatttataggacattgtagtgaactgcttaagcaccataataaatgaaggcaataaataattatatgtgtgtatatatatatatgtgtgtgtgtgtatgtgtgtgtgtgtatacatacacccatatgcatgtatattaataaactcatatggttttctggcccccagtgactgaccccattcataactctgagttctatactgttttgtgcaacatttccagaagagtcaatattccatcccagactgggaatccaccaggtattcacataggaacttactaagtgccaagttaaatcacacaggaacttattaaatgccacgttaaatgattacaaaattgatatgaattggaggtaaaaattaaaagccatgttgacttttaatttttttcttttaatttaaaaagtgagttttgtgaatagacttaagttgtgcactctacaactcagattagtgtggttcctagatgaaggttacaaaaaccaaacaaattgagctatgttttggtctgcaagataaaaatatatatgaaatactagaaatgttttgtccttttactatcaaatgttaataaagattctaaatgtgtgtaataagtttattataatacaaaaaagagaacccgattttatctcaaatacatattaatcatgaaatgtttactacgtacctactacatttaaaatattaaatactatcactatcttttatctatatatgcattctatatatccctgtaggtatacactactctctagaattcattatacttttgaagatgaaatacatctgttttcacagaggaaaaatgaggagtaaaaaaataaaaaatgcgaaagttatccccaagtgaagaatttcctctttgtcatcagtgactgagtctttcccagaagatagcatgtttattttctttaaaatgtttttatgttgcccgggaattcttcgttatagagcatctggcattccaataattatttccaaataacacagtcatttggactccgttagatttagcctgtgaatctgcttttggcattacctgtggtttattttggaaaaagctaataagtcaacaacaaaaaattagctgtatcttccaatatcttctggcttcattaactgcccactttacagctgtcacccagaagtgtatacgaatctctgttgaacacatacatattcttattctgtcctcttttctagaagattgtgctttattattgtattatttatataaaacagtactccctttataagtccttctgatttacagagatttcttcaaggcctagtgttcctagaatgtggtcactgaatccagatatgctctaagaagagttactgaaatttctcaaattttactcatagtgttacctttctccattaccagctgaagactcctgaatttttcattcccttttcctacagaaaagactccatgcctacatgcccctgataaattcactgatacaactacagaggtgattgtgtgtatactcaaattcttacagtattgaatatatttattctgtacttggttggttattagaatcctgattcacttaagcaagtattaggcctaatttttttacttttgtcaggtttgcttgttctagagcaactcatttttgttgataaacagcttaccaaaaagaaatgcagttgtttataaaaccatgagacagcatatttagaggttagaaaggggaaggactctttaggacctgggaagtgtactttagcaggaaaacagaatgcagaaagaggagcaggggcgatgggtttgaaaaacagtttttaattatttttgaacagagactgtggagctggtactgtgctagatgatgagattacatagtcctgatcctcaagtgtcaggatcctcacaatctaataaggaatacagaccagtgttatacactagaataacagaaaactacccaactagagcagagtgttgggatagctcagacaagctgaaccatcaccagggtggagagagacgccatcaaacttttccaaagagaagactcttaaaaatatatattaatcatttgttaaatatttaataactgagctctgttggcttatggggattaacataaagagtaatgataatagcaaagtttattttattactgtgtggctagtgctgctatcaataaaagagggactagatacagaagggggaacaaatctgatgagagcagttggttgggtttcacaagtgtgcataggtggaaatgcatcctacatattgggagatgttgataatgaggctgcctgtattatacagaactttataaaaggcacacttttagaacttaatctcacatgtaagcaattaattttattaaaatatgttccctactctattatatgtataacagtcttcataggtgggtttaagtcatttaaaatattatctaataagaattaaaaattcatagatggtagcttaatagctttcttattcttttacttggcagatatatcagcatttggaaacaccataggaaactgcccatttaagacattaactaagtcactctcactatctcttttacaaaataagaccaattccctctcattaattaaatctcttgatttaaaattcccattttctaaatttgtatgtggtgtcgtcagaaactatttttctctcttgggtagaagtcacttttaaacaatatacctactaatgatgtatcaacattcttacgagtgaattctatctatcttttaatttttttcttgcctgtggaagacttctacactctacttaactgacctttttaatgaccaaaagacagaggtgttcttcctatcataatcaaatgttgatttatttgtgtctggtcttttttttttttttaagctataaggatatggattaagtatgcagactctagtgtaatcagagtagtttgaagttcacaaagtgtaatcctgtgctatatatctcaattaatcttgcagactatggctaatcacattcccaccaggcaggatcacacaactcacagagccaggattattaaaatccatatttcacgttaatagccatgtgggtgagattagtttctaagtggtaatgcacctgccataaattcctcctctctgttatcttctgaaatactgctctgtcagaagatgaaaagtacatgatgtgcattcagaatcagtttatggtctttttttttctattggtcaagtaaaatatatcttcatccctcactgatttcaaatgcactggagaagataaacactatttaatattcctctgtgacatgtcataaaggccaaagtgttcaagtttcattacaaatcttagtaagtcttttcattttaacatattgtcctaaactaacctaaaaaaataataattaacaaatacaccttcaaagaactattccccatttgattatctaaattaattttccttccaacattattgcaaattaaaagctcctgaatagcctacacatttacttgtgcattaattcgtaaaaaaatgaattacactggagtgaagataataacaaactaaaaatcaaaatatctaggtcttagcccaggctctgttgttaattgaataatttagagatagccacatagtctcattgtttttcacaggacttgagtcaaatttacatttggctttgttgtcttcaatttgaaagctaattctctagaagaaaatgaagaatgaaacttaatctttattaacctgagtaagaaatatgcttatatgagagataccagaaaacatttattctccttgttaaaatgtttagccttcccatataatctctcagcaatcatacctgaaatatgctctattataatatctaatataaaataatatttttaaatgtccccctttttgtccaaaatgggaaacctattttatcattattaatagaataataacacacataaatactttaaaaggtataaagcacttccatgagtgcttttaagagaggttttgaaatgtgtcctggataggtctgcagatattattaatatacttacttgatcactaaattgctctgtatctttgttttaaaaagttgaaatatggacatgagcgaccttcagaggtcaaaccttaaaagccagagaacaacttgtgacctagaccactattcttgatgatgatcttcccctggcttggtataaaattcacatttttcctcctatgggaaatacagggaaaatattacagctatgaaaaataaatcctgctgcagaatttaaattttcagaccttttaagaaaatagatgttaatgctttctgttgagttgctatagtttcacattcatatattagagatgcattaaataagtttacctgtttaataatttaaatgctttaaatacatgcatttgacgtttgcatgacaaagacaaatacattcataccactttgtaatgtcacagtcaatcagtcaacatgaaactggaagattcaaagaccaaagtaaataaaaatataaaagtcgacagatgcattaactttcccttctgtacatattgtttataataagatactttcaaaactcaaattagatatatgaaaaaggcaccattctgatctactagtgcctaagcattgccaagcagtcaaatctaactaaacgttctatcctcctccatttttcttcgatgcctactgatgcctactttcttttctcactgtggggtgaatgcatctactacttgcagctaaaggacaaagagtcccagcctcccttctgccagagacaccaacattcttacactcaatggggctgaaaatcctagagtcatttttgatcatccttctcattttctttattcagagttacgaatcctgtccaacttggcttatatcctaagtttgtccatcctctctttcccttatactagtcctgtcccctctacacagtttagaatttactgtcagatttgataagaatctcctcactaatacctatgtatccattcacattcatcttccttgctaatccattggttttgttttccaaacgcaaagctgtttttgccatctcttcctcttcacatttttactgttgtctaaaattttctaaatgacatgcaaatttcttatgtagctaagctcattagcacatcatctttctggcacaagattactacaacattctgagctactttatttgtttaaaatgttccctgtgaattcctttcatgcaactatgatggcaactttgttcttaacaaaatgtctttgtttaaatgaacgtaagattcagatcacacacttttttttctaaaatattaatcaacatctactgtatgattgccactaagttaaaagaattgaacaatattactaaaattaggttaaataatgtcaagattttgcactgaattgttcagtggaactttacattgaaagtctcagtctgtttaagtcatgtgtctgaactctagagagtgaaattgtttaagaattacataaataccccatgtgtgcacatgcacgtaattacatttgtaaaaataaagacacatatgcatatatacatatgtgcataattgtatatataaacctcaccagaacaacagatatatttctggaaaatagtttataaatttcacatttctaaattgggtagtaattccatcaaactagaacaattgcaaattaacaggtttttaataagtaaataatgccatctagtttatgttttgggtaaattttaatagaagtttgaaaaggattcattaaggtatataataagttatttgagtttgcattcattggtgttttattaaggcaaagatattgaggtaattcaagccattgagggttttccctgagaaaaggaattagaggagagcccttaggtttagagttttaaattaaaaaaagatctaatgaaagttcattgctgaaaagttgatttttatttggtgtttgagtttatatcagtgattaaagtacatttgtgatttctgcataagctgtgtctttacacagttcattctgcctgccttcctcttccagaaatgtttcctgccatattctgcttttattgtgctattagtatttttttgttctaaaagcaaagaacgcacctgctaggcagagttgctaattttatccctgaactcactcatagatgccacaagcacttcccagtcgatacggttccatgtatcaggcaccttctatagtcccattctagggtcaccgctgttgttgtatttatcatcactgcccagcatctttaccctgcgtcaagaatcctatgcactgcacgttcctccatagaaccttgccccattcattcctcttgtcataacactccaggatataagtgaattcagactttctacaaacccttttgttctaaataatctcataaaactactacagccatactgttgtagcattaagtgagttaagggtgtgtgtctgttgttgttgtcgttcctgttgttgcatctgaatctgttggaaacaaagggaggatggtaagactgaatagttcatgcaaggggcatggcccctactgcagagttcctgctctagattgtgtgtgtgtgtgtgtgcatgtgtgtgtgtgtgtgtgtgtgtgtgtgtgtgtgtatgtatgtatgtatgtttgagtaataaaggtccacatcccaaatctgacatttttttttagatacgcaatctcacatgttggggagtaaaaaaatgactacacagttcaatattaaaggactattaatgcctccaaattggtgagatattctgcacatttgaaagggaatagggatgttcatcaaaggatgagagaaaaggcagagattaataattttgaatagttataaaatcctttagaagtaaattttatgtatcaacttagttactaaaacatatttagaacataactaaaagataagcaggaatttggagttgctacgcaaaatgcagaatgcccaattaaatttgattttcaaatatgcaaaggaaaattttttagtattaatgtgtcccacatattgcatactgcatacttattcaaaggagtactttattcatcagttctggagattctaattgtacataacctatataataacttctaaatttcccgacagaatcgtttcaaaacatttttgattgttccttcaccttacaaaaaaatccctgattttaaaaaagtcaccctttaataaacttttgtgtagaaaggtaatgttggtcaaagcaactctatagagatagatgatatttataaatttcctgtcttaccttttagaatttctgtagtatattcttttagagaaaagtaacacataactgttaagtggtgatgtttttggtgattgtattgttattcatggtttaatcacagctatattacctaacttacttttacttagaatttagcaaaagtataataaaataatattagttttataaagtatttttcttccagactgaatattttttactctcttatacatcgtttgaagacacagttttttttattatactttaagttctggggtacatatgcataatgtgcaggttcgttacataggtatacacgtgtcatggtggtttgctgcactcatcagcccatcattcacgttaggtatttctcctaatgctctccctcccctagccccccaccccttgacaggtgctggtgtgtgatgtccccttccctgtgtccatgtattctcactgttaaactcccacttatgagtgagaccatgcggtgtttggtttactgttcttgtgttagtttgctgagaatcatggtttccagctttttccatgtccctgcaaaggacatgaactcatccttttttaaggctgcgtagtatcccatgttgtgtctgtgccacattttctgtatccagtctatcattgatgggtatttgggctggttccaagtctttgctattgtgaatcgtgctgcagtaaacatatgtgtgcatgtgtctttatggtaaaatgatttataatcctttgggtatatacccagtaatataatggctaggtcaaatggtacttctagttccacattcttaaggaatcaccacactgtcttccacaatggttgaactaatttacactcccaccaacagtgtaaagcgttcgtatttctccacgtcctctccagcatctgttgtttcttgactttaatgatcgccattctaactggtgtaagatggtatctcattgtggttttcatttgcatttctctaatgaccagtgatgatgagcattctttcatatgtttttttggccacaaaatgtattctttagagaagtgtctgttcacatcctttgcccactttttgatggggttgtttttgttttcttgtaaatttgattaagttctttgtagattctggatattagccctttgtcagacggatagactgcaaaaattttctcccattctgtaggttgcctgttcactttgctgatagtttcttttgctgtgcagtagctctttagtttaattatatcccatttgtctattttggcttttgttgtcattgtttttggtgttttagtcatgaagtctttgcccatgcctacatcctgaatggtattgcctaggttttcttctagggtttttatggttttaggttttaggtttaagtctttaatccattttgagttaatttttgtataaggtgtaaggaagggatctagtttcagctttctgcatatggctagccagtttccccaatactatttattaaatagagaatcctttccctattgcttgtttttgtcacgttttttaaagatcagatggttcttgatgtgtggtattatttctgaggtctctgttctgctccatcggtctatatatctgttgtggtactagtaccgtgctgttttggttactgtagccttgtagtatagtttgaagtaaggtagagtgatgtctccagctttttctttttgcttaggattgtcttggctaggtgggctcttttttttgtttccaaatgaaattaaagtagttttgtttttgccaattctgtgaagaaagtcagccgtagtttgatggggatagcattgaatctataaattacttcgggcaatgttgccattttcacggtattacttttatcctatccatgagcatggaatggctttccatttgtttgtgtcctctttgatttccttgagcagtggtttgtagttctccttgaagaggtccttcacatcccttgtaagtcggattcctaggcattttattatctttgtagcaattgtgaatgggagttcattcatgatttggctctctgttttttgttgttgttgttgttattggtgtataggaaggcttgtgatttttgcacattgactttgtatcctgagactttgctgaagttgcttatcagcttaaggagattttgggttcagatgatggggttttctaaatacacaatcacgtcatctgcaaacagagagaatttgacttcctcttttcctaattgaataccctttatttctttgtcttatctgattgccctagccagaatttccttaagcccatcctctatgcaagatgctggggtaaattgcagaaaaaattgttggagtggaaattgctttcagtatcataaatatgtatgtatgtttacaaatagaaatatggaacccaatgtgctgttaactattaagacttcgtctcttttttaccaggcatatacattttcggaactaggaaaacaatagaaatacttgcacttttaagtttgaatgtggtcaaacctggggcattttattgtagaaagtaaattgattttttcccttcatttaaagaatgcattagtgaagaaagaatccttgctgtttgtgtatgttataaaggaacaaaagctggagaattaaattatctgcatagctgagcaaaaaatagtttttctgtgtttgataagagtcagatattcttaatagaattcttagatttcgtgagcagaatggggaccatgcatggcattgaaattttccgcagacacaaaataacttgtattacagctgaactatagctctttggggacttgtttctttttattcatagaggttaagaatggtgcattatattatccatttaaagatgctacttgcatttctgaacttcaaatacaatcatgattttaatattatcaagtaaatatattttaatatggctacacagaaatgatttcattaacatttatagaacccttggtatcagtagctctgtagtattttaccaagtggaagcgttatatttcattgtatatttcttgtgttcctctataaatcacctgtgcatatacatcccagaaaaaatgagtatagcaagctacatagcattgaattaagctttaattttcactggctgcttacagaagaaaataacttgtatagcatttagaattttgagtaggaccatcctcatcatctcatgctgtgtattacaaaaggagtctacctaatgaagcatagggtctggatggtttaacttattttttggataagagaaagaagaaagaaaataatacttagttgctgccttccaaggattctgtgccatgctggttttttaacatgcattatcttaagaatatttctcatttaaatatagattttattatacatttttaaagacaaagaaatgaaggttcacagttacagcgaatagcctaaggtcacaccaaggaataacgaggttcaagccaaaagccaagtaccttttaatttacaaatcccatgttcaccatattctgcctaattgaaaagggattatcatttgtttgatggaaatataattatacatactattaatatatcaaaccacttagcctgtttgaacttcagctcatgtggaaaaaaaaaaaaccttgaagctgtctaacttctagagactatttttggtaatgtaaagcactattgagagtgcttaaacgtaagggttgtggtgttggaaagctagcatttgaatatgcgctctagtattaattactctttttatgccttcgttttctcattggtaaactagagctaataatagtacctaacttaggagtgtgttaggaatgaacaagatgatgtaaaacactttttgtgacgtgtaataaatgttcaataaatatttgctagctgatttgtataggaaattttatttgtaatagcagaggaaaggaaagagcattagagaagaagctgaataaaagagagtgaaatagaataactcttggagtttcgcaattacatagtgaaagtctgtagtgggagaacttatttttttaagacattttacataaaatctgagtaacagcagcagaactcctctaaatctagctcacagaggcaatggtgaggccatccttcccacctcttcatggaatctagagccttccagtactctgaagataggcaacttgagaccaccaagagagcagaatagttgacatctttctttagtggtggcattgatgaggctccttcaacattcgagcaggccatgaatgtttgccaggggaatgagaggaagaacaggaaacagagtgaaccccaaagtctgttttatggcctgtatagtttcaagagcctcacatactccccaaaatgtctaggatgatgttgcaaggagtaataaacaaaaagaaagatcaggaattttttatttatcatttataacatggtatatcatcatctctttatcctgggaagatctaaaagcatttgatagattttaatatttatgttatgtttatacacaaatttacataaatagatatacttgactcatgatctctttattcttcatattcatgaattattcctttccctgccaaaaaaatgtctaatatattgggaaaggaaattgtattaagcaaaggtttatctaaatgacagaaccattgatttccatatattatttttatgttgttagaaataaagaggagagtatatccttagaacaagaatataaatttatttcccaaaataatcaaaaaattattacttttcagctttcgactttagtcatctaatttaaaaaaaagtttggaagattttcttagagaaatgttttcgagatgtgtttgctttcatacttggtatcttacaatttgatagtctattgtaatcactaatatgtctcatattttcttttgttctttctttagttgtgaactcttaggtcagcaataatatcgtgtatccctttgaaccccttaacaattcctgttggagtactgtgcccaaggaaacctctttaaatattaaaaattgataaagatactttccaatttttcttttctcttcttcctagacttcggcatgttaaatcgatgactacttctaacaattctctccttctttattgaagcaacctctcttggcttcaataatattctagcttcttctttgtctcctactcctctgctactcctcagtatcctgaatgagctcgtcttcctctctccacctctggtcagacccttgtctggatgttgacattaatcaccttcttttcatgctgctcccatgcagtcccataagacaactaaccttaacacatcctgcctagtctcatcagcttcaacctctgcctcatccttcatcagtgtattctctatctcaaactacatgcagctcttagaaattgtaataaatctcttaccctcagcatccacagaattaatattgcaaccagcttttgtatgggggtaaggatagagctctcaatatttttaagtaatttgttttaaatagtttaagttctctaactctaaggacataatatattccaagaatatgttagtagaatgcctaaaattgtgttttggatagtcattcattcaacagtgttttaaaacgaaagtattttatgttcaagcattatgctaagtgcagtgtgtgctggagaaaatagaaaatgtttaagatatagtttcatactcaaggagtataccaggggagcaactaagtgaatcaactatgctttcattttctttctttcttttttatttagtagcgttggtgaaattacaattgggcattcagtattccaattgtttttccttttgctttttactctatagaatcggaacccacaaattgtatattgtatatacagtatattttatttgctattttcagatgttttgccaattatttttctgtccttttgtaataatgcttgcaaacctgtagtatttgtagtttcattttttaaccttgctatatctgttgatttgaactttcaagagaatatgttaatccaagattgttactattcttttaaacaaattaaggaaagtcttatatacagtatagattaataatgatcacagacacattgtttctatttaaaatgtcataataaattttcaaaagagttgtacctgcttatagaaagaaaagcgtagggaagttattgctaggagttacgagtgtgcactaccaataaaattctatcagtaatataaaaaaagataaaaaataagagtatagtatttccattgtgtcttttggatggggaagagatgtgtttgcatgtgtgtgtgtttgttcagttttgattgtttaaattttttaattaaacaggtgttccgaatcaagcattttttaatcaacactttttaagccacatttgtgtaattaaatggaggtaaatcagaggtaacatatggatgtctccataatctgtttcaaaaaatgaattatagcaagatgatagaaaaatgtaataccaaaatccaggtcaggtgttcttcaaatgcatatagagggaaaaagtaccataacttacatggcacataaatactttaaatattattctgaacagaatgcttatcaaaaatattcagaatgatacacaattaaaaccttattattcaaagaagattatagttagagaaagtgatttaagttgcatagatccaactcagccatgacaatacttagcacccccctaaaaccttaccacttcgtcctgcaggcgtttcattgcgaatttcaactcaggtttacttcctacattttaattataaattgcctcattctgaaatgccaaactttgctgaagaatatcatataactctccttaatagaattctacttggtcatgccaatacgctctaattggaaccttacacatcttcaggaattatttatttctttttaataacctcactctttatgattgttattctaagccttttgcattgccttctattatgtgttcactaatacatttgttaaaccaaaaatatttgttaatcactcactgtgtcagacactgttctttgcacagtggcaagaaaagcattaaaaatgcactttttgactaacttgttcataatatatattgttatcctacaaatttgtcttagcagcagcataacagatcctgttttcagagattttaattcagtccatctggaagagggtctaggaaaagttcctgagtgattctgatatatggccaatttgggaaccaaatatagacaagtaaaacatgtttgaaacttgaaaaagacacttgggaaacatcagcttggagatgcttcttgtggctctgtgaaagggaaggaaaaactgaaagacagtttaaaggaaaaataaactatgttaggagcacacatctaaattggtcagaaacttgagaagaacagaatatgaggatggtaatctatagcatcaaatgctatagttagcaagatgagagaaaaaaattttagtctctatttactgacatcttactatgtaccaaacactttgctaagtgtcacaaacaccatatttaactctaaaataccacagctaaataggaaaataaagttcatagactttaagtaacttttagaacttaaaggtcctgtagtagtaaggccaggtttcaattctatctactgtactttcaatgtatttattatttgagcattattctcctcaaggattttcaccggtaatagaaagggcttttatattcaagataaagaaaaaatgatagagtgatgttccaagaaaaagtaaggaataatattaagaccataacagagagcgggtgtggtgtctcacgcctgtaattccagcactttgggaggccgaagcaggtggatcacttgaggccaggagttcgagaccacctggacaacattaatgaaaccccatctctagtaagaatacaaaaattagctgggtgtggtggcacacacttctagtcccagctactcaggaggctgatgcatgaaaatcatctgaaccccagagataaaaggttgcagtgagctgagatcacgccactgtactcctgcttgggcgagagaatgagactttgtcgggaaaaagaaaatggaacatagtaacataatagaggatcttatttaagaaggccactctttccttaggagcttatgtgaggatatatgtgtaaaaatgttttcataggagtaaaatgtatgcaaatttaatatatgctttctataaaataatacagtgaagaggaaacaaaggatgaagatgaagcaagattttgaggcaatgaattagaaattcaactaaggtaggattaaggggaaatttatagcactaaatgcttacatcaaaaagttacaaagatctcaaattaacaacctaacttcacaactgaaagaattagagatgcaagaacaaatcaacctcaaagctaccagaacacaagaaataacaaaaatccgagctgaactgaaggaaatcgagacacaaaacttcaagagatcaacaaattcgtgagttgttttttgaaaaaaataataggccactagctaaactaattgaaaagaaaagagagactatctaaataaacacatttagaaatgacaaaggaaatgttattactgaccctacagaaataaaagcacccatcagaaactactatgaacacctctacacacacaaactagaaaacctagaagatattgataaattactggacacatacactctcctaagactgagctaggtagaaatcaattccctgaatagacccaataacaagttgcaaaattagtaataaatagcctaccgacaacaacaaaaaaaaccctgggacctgatgagttcatagctgaattctaccagatgtacaaagaagatctggtactatagaaactatttcaaaaaattgaggaggagggactcctccactctatctatgaggccagcatcatcttgctaccaaaacctggcagagccatagcaacaacaacaaagaaagacttcaggccaatatccttggtaaacttcaatgcaaaaatcctcaacaaaatacttgcaaaccaaatctagcagcaccataatcaagtaggcttccccctaggatgcaaagttggctcaacatatttaaatcagtaaatatgattcattacataaacagaactaaagacaaaaaacacatgattatttcaatagatgtagaaaatgcttttgataaaattcatcatcacttcatgttaaaaactctcaataaactaggtattgaaagaacgtaactcaaaaagccttctatgacaaacccctggccaacattatactgaatgggcaaaagttggaagcattccccttgaaaatctgtacaagacaaggatgccctctcttaccactcctattcaacatagtattggacatcctagacagatcaatcaggcaagacaaataaaggaatcgaaatgggaagagaggaagccaaactatttcattttgcaggtgacatgattctatagcaggaaaacccagtagtcttggacaaaagctccttcagtggataaacttcagcaaagttgcaagataaaaaatgaatgtgctgaagttattaacattcctatataccaacaaaaccaaaaggcaaaccaaagggcatatcagagaagcaatcccattcacaattgccacaaaaagaatgaaatacttaggtatacatctaaccagggtgaaagatctctacaacgagaattaaaatagactcctcaaagaagacaaaaacaaatggaaaaacatcctattttcatggaaaggaataatcagtatcattaaaatggccgtactgcccaaagcaatttacagattcaatgctactcctgtcaaattaccatcagaattcttcacagaactagagaaaattattttaaaattcatatggaaccaaaaagagcccgagtagccaacgccttcctaagcaaaagggacaaagcttttggcatcatgctattctacttcaaaatagactacaaggctacagtaatcaaaacaacatggtagtggtggaaaaacaggcacatagagcaacagaataaatagaccagaaataaggccacacatatatgtccatctgatcttttacaaaactgacaaaaacaagcaatggggaaaagaccccctattgaataaatggtgcttggatgactggctagccatatgcagaagatggaagctggaccccttccttacaccatatacagaagtcaactctagttggattaaagacttaaatgtaaaaccccaagctataaaaaccctggaagacaacctaggcagtaccatcctgggcataggaaccaacaaagatttcatgatgaagacaccaaaagcaatcgtaacaaaagtaaaaattgacaagcgggatctacttaaacttaagagtttctgcaaaacaaaagaaactatcaacagagtaaatagacaacctacagaatgggaggaaatatttctaaactatgcctctgacaaaggtccaatatccagcattgataaggaacttgaacacatttacaaaagaaaaacatacaaccccatttaaaaagtgggcaaacaacatgaacaaacacttctcaaaggaagacatacatgtagccaacaaacatatggaaaaaagctcaatgtcactgatagttagataaatgcaaatcaaaaccacaatgagatagcatctcgcacctgtcagaatggctattcttaaaaagctaataacagatgctggtggggttgctgagaaaaggggacacttgtacactgttggtgggaatgtaaattagttcacccattgtgggaaagcagtatagcaattcctgaaagagctaaaagtggaactatcattcaatccagcaatcccattactgatatataccatgacaaatataaatcattaatccataaagatatatgcatgtgaatgttcactgcagtattattgaaagtagcaaagatgtggaatcaacctaaatttccatcagtgacagattacataaagaaaatgtggtacatatacactgtggaatgctatgcagccataacaaggaatgagatcatgtcttttgcaggaatgggaatggagctggaggcaattattcttagaaaatgaatgcaggacagaaaaccaaataccacttgttctcacttgtgagtgggagctaaatgatgagaacttatgaacacaaagacgaaaatagacactggggtctacttcttggggagggtgaaaggagggagaggagcagaaaacataactactgggtactgtgcttaatacctgggtaattaaataatatctacaacaaatccctgtgacacaagttttcctatataaccttcacatgtaccccccaaacctaaaataaaagttaaacaaaaataatttaaggaagttctagtcaaccctaatcttctaaaaaatacaaggtacagtcaaattgctaagatttgtcagagaattttgctagagtattctgggtgttcctggtaagaccctgtcttttactgagcccacaactctccccatatggggagatatagcccatatgggttatatattatgtatatggggcctccactcccaaccccatatacataatgtatacctcaactctccgggaatcccagtcgtgtcatcaatcatccttgcactctcatttcctcagacacttatttccattgtcacttcatagatgttgtcattaccaataagttaaaccagtttccaacaacactatttttttttcagctcatgcactctagtgtttcaacaccagctatatttagactccatggggatctacaatctactgttcctaacatgttttctctttacctattgttatttctatgctcatacttactcccttaattaggaattctatgacctggtatataattgattctgtgcatattcctcaactcccttcctcccttcctccctttattatcgattccactttgggaaaaaaaaatccacattagccaaacttgtatttcttccatggttcctctcggacaaatgtacatggctggagaaaaaaattagaccatgctgcctggtctcattaaatgtaagatccctactgcaagtggccctttagtgtttctaggcaagcacactatattcccctagtacttttcatctcccattctcctatatgatcatttaatgcctttgcatctctactccaacctccagatgactctgcttcctatttccctgataaaatagaaaccaacgtagacaattttaataaacttctaccaccacacctatcttgcatttatactctgttttatttttctccaaagcatttactgccatctaatatgttacatattttccttaagaatttggtttattgtgcattcttccccctcctctgccactgtaagtttgaaaataacaatgttattttctattttgttatttttgtctttgcagtacctgcagcaatgcctgataagtaaaggatgcagtaaattgtgtgtgtgtatgtgtgtgtgcatgcgtgtgcatgcgcacgcgtgtgtgttttgtttaaataatgttatgggatagatcttataatcttccttttacaaatgatgaaactgaggctcagataattttagtcacattctaagggccagttagcaatcaaatagtggagccagaattccagcccaagtcagtctaatctaaagcttaagcatgtaccaaattaagtttaaactattcattctactagtctgaattcttgggtttgtgtctcagaatatcttcccaggcttatcttgttctaccttattacacacacgtactcttcaatcaaactagaaacttcctgtctttcagcatgtccctagctggtcctgcacagtcattcatgtgaacaggctcctcttcagtgcctggagcatgttccgtcttatgcctattgaaatcctgcttgttcttcaggatctatatactctctctttgtttttttctaagacatttcaagtgggattttctgttctctgcttttaactcttaccaatgtcacacatctatcttagagcacttatttaaattacaaagtggagagagacgttgtatccatgtctcaagttcttccagactccctggcagatcatcagctcctttgagtatgtgttcatttttatatattccatatagcaacaccactacacgattttcacttgacaattataacagtcttggagtgctcaatgccaaacattgttctaagccattacatatgttaattaattcaatcctcaaaatcctgtgaggacaggtactattattatccccaaatttagaatgagaaagcgaagaacagaaaacttgtcaaagtcacacagttagtgattatttgaactgagacttgaatccagacagcctggttccagaggacttgactaagagatactaccttttagttatcggtaaatgcaccataaatattggttgaattcaggaagctgaataacagtatctgacaaaaaaaaattacaaaaacacagcaggaagactaaaggagtgaatgtccccttgtgttatctggctgtttgatgacaaaagtaggttactatactacaagctgttatatatgttgcctattaagaaaaaaatgtaaaggactcagtaaggctaattgtatgatatcaaaacagaatttacatttcacatcacaagataaaagattttttgcgccaatgctaagttttctaaactttgcttttgagattaagtagaagacttgattgtttagaaataaactgtaagtctattgtgaagtctcaaaatggcccagcaaaagggaaaatacatctgaattttctagttgtgtaattatctgtgtaattagatgtgaaacttctctttcacagtcttccctcatcatctgggatggcctcaggaaacagttatcatcctcccttcagacttacatgagatgcactgggatttttataagacactgtttaaacttcaagaataaaaagcaacaatgagataaagtgaaattatgcgtaggtatggattttttgtttttgaaaggagaaggtagatataatttgaaaactatgatagagagcgattttcaaagtatctctatgaagatactatttttaacttttcacaaagagaaattttcttccattaattatattaaatttttattttaataatttttatatatatgcattgtaggcaaagttttgatccaatacagaagtgttttataaaaatcatcatgagttaagtaaatattcagcattttaatctttgccttgcctttgtaacgttttcttctcttaattccttggaagaatgaagaaaggaatatgtgtgttaaaaactaaatatgtttagtaaatctaaattcattacttcaaaaaagatattatttttatatttcgtaaacatatgtattcttagaacagattcctgtagtgtatctgcatgtccttcaggctctgctgttgaacattttcctttcaggtcattagttgtgccctgctcttctgccattttgaatggtccagtggtaaatttgtaccagctttattaaacacaagcaatacactgcagattttgatgaccaggctttctgtaatgtggccttttaaatctgagggctcagaggcattctccaaatcctctccattagtctttttaaagatacaagctacttcagaatagccaaataagaatattattattagaatattgtcatgcaagtcttacttatttggctattctgaagtagccaactctaaggcacactccatgagcctcaaggaaatgagaagttctctttaagtataattccctcttggatatgatgtcagtggtatctcctctccctctatctctggggccacatccaccatcacttatgactacacttaggagaactgaagaggaaacctacatcctccccaaagagtcctaagacagtagcgagcagtggaaacagaacaggaagttacttgtctgggagatctgatgtgtagtctgtgctttttgtatgtgtgccagagtaaaaagcaattaatagcaaagtattttataaaagctttttctgtaatctatggctctgttatgtttaccccattgttgctttatctttttttgtttagagtgtacatttagtgtctgaagcaaggagagtttgatagctcaccgaaattactacatgttttctactagcaaaacgaaatagaacaatttgcttgagaattactgtggattatttactgtaagctaaactctatgtaataataatcgctgacacttatttcttacttcaggcaatattctaagtatttttatatattatctaatttaatctaacaacaaatcctaaaaaataggaaactatcgtctccattttacatatgacaattctacaatacagcagattaagttaatttttcaagatgatacgagcagcaagtagtgaagttaagatttggacacaggctattattttagacatttaggagaatgtcagattcttccggcaggtcatataaccactgcacaataccactctccgccccatctttaagtatagtgcttttccacctcatcaaaaaatttgtgatgatatcctgtaaattctatccttaaaagaaccataaaaatatgtattagacaccgacttgaaaaaaatttacataaaagataatagaaactatcttagtctagtttttgttctacaatcaacatttgtttttataaatctctataaaattccagggcatggccgggcgcggtggctcacgcctgtaatcccagcactttgggaggccgaggctggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaattccagggcattgtgctgctattgtgtgttattagaatattgttatgaaataaacaatgataagcccgatctgtctcctaaaatctcttttgtttctgatatgacaagatagagcatgtcacaaacccaaaccttatcactaaatataattttcatagttattatattatcccatccttaattgtttcatagttgtaagcatcaaattttcctggaactctatatttcccatttccaagtagaacttaaattactattgtcctttaatgaaaaaaatcaattaagggaaggaaattacacatttttcaaacctcccaccagaaaaacaaaaacagctgtggaaaaaaatgaagagatatatgggttcactgatattgactgaaaatactcacacttagtgccatccacatacataagttaatataaaatagaacaccataaagtcattttaaaactgtcatatttattgtgtttttgcccattttaaatattagctcgtgcttatctagtactaagggcttcatatttattaacttatttaatctgcacaattatccatcactgtctctattttacataaaaaaaattgagtcacagagagtttaaatcatttgtctgaggtttcgaatgcattcagattgattacttaaccactatggtaattcgtctctgacaatcaactaaatcaatcattttattcattcaagatcaatggaatcagaagtgaaaacatttaaggactcacctgtatattagaatcagtagggaaaagtgatggatttttaaaaagaaatatgttaagagtacgttgcaaaaaatgtagatttcaatatatgtttagaaaaatatagaggagtctgatcatacatgagagagagagagggaaagacagagaaggcatagatattgagcaggaagaaaaataatgtgtacaatatttgtgagtgacttgaggtattttaaaggataaatcttaaggccttgatattagaactcaaaccatgcaaatattgcaactctggtaaattccagcttaaattaaccaaatatactatattctgagagaatcattaaacggtaacaaagacaagagtagctctttgttgttgttgttttagcagttactgatgataatatttaaatatactcaatgtttctaaatttttcagggtctatctaactgaatgaaggtgctttttagaaataaatagataacgatctgctgtcaaaggtattgctttcctttattagcagcctcatagtgatgtagaacaaagttgtcgggatagaaacctgcttaggttgcttgttctcctcagatggtaaccccaggaagggtagatgagacagttcaccctaaaagacggtgagtagtgaccatgagtcaccaaaattggagttggccttggatgtcagctttgctgaaggggagcaaaaagtctgaggtctgaggagttaaaaaaaacagtcagcagtcactggtcacttccagcaggtgagaaaggaaagaagcattttgagcatacagtagagccagagctaacctcataacttaggaacacaggttaaggagcatccaggtatgttgtacacctcaaggtacaacataacttttcatcttaatgagcataggttcttgagccataccatctggatcttcagtagagtgatttcaacattaataggagcatgtcctctggggtgctaagtaagggaggttcaacggtgaacaagacctcttcctgctcctcaaagaatctctattgcagtagaaagataggcatctttatgtctttacataaaatgaagatgaaagagttataaataaggtataacattcacgtgggtatttagaaggatgagataaattccatttgggggaaaagtgggtgatgggggtgccttcagagaaggcatagatattgggcaggaaggaaaattcaatgctcactattaaactgacataacatttttttacctttaggtttgtgggcacatgttaaggtttgttatataggtaaactcatgtcacgggggttcgttgtacggattatttcatcacccatgcattaagcctagtacccaatagttatttttttctgctcctctcctcccatcctgcaccctcaagtaggccccagtgtctgttgttcccttctttgtaacacattattttgaattagtatagctatctgtatgcttcttcactcaagctattagaaactagagggctggttctagatctttaaggaatcatcacatggtcttccacaatggtagaagtaattcacagtggcggagacaaggaaccaacccaatgtctatcagtgatagactggataaagaaaatatggtacatacacaccatggaatactatgcagccataaaaaggagtgagatcatgtcctgtgcagggacatggatggagctggaagccattatcctcagcaaactaacacaggaacaaaaaacaaacactgcatgttctcacttataagtgggagctgaacaatgagaacacatggacacggggaggggaacaacacacattggggcctgtgggggtggtggtggtacagagagggagagcattaggaaaaataggtaattcatgctgggcttaatacctaggtgatgggttgagaggttaacgtgtgccatagtggtttgctgcacctgtgtaacaaagctgtacaccctgcacatgtatcccagaagtaaaagttgaatttaattaaatgagagggctaagatccctccttgttcccatgcactccccacacctagcacatacctgccatccagtacttacttatattgtgaataactattaattaaacagaattaaatatgacctagctgctgtgttctattccctagaaggaggcagaattctgctggaactggcttctgattctagcagagcagggctggattctctagaagaaagggtgtgataatgcagaagcatctaagtagtaacagtaaacctaaaatgcaaacatcacttttacctgattggttttactttacaaagagaagacggagagaatactatattaacttcgtaaataaagatctgttcaagactatattggatgaaaaccatcaaagataaacacctcaatattttatgccatcttagggctgccggttatctactattagacatttacaaaatcattcaatgagtattggtaatacttgtagaagcaagtttatggttatgtttggggcattgagatttttaatgttacttcttttgaattgataaatggttatattattgtttaattataatctgttcttcaataacaaatgagtattttaaaaaattattttactaatacataacatttctacatatttacggaaacgtgatgatgcatgcatacaatgtataatggtcaaatcagggtatttaggatatctatcacctcaaacatttataatttatttgtgttgggaacattttaagttttctattttgagatacacaatatattgtttttaactgtagtcactctgctgtgctagagaacactagatcctattccttctacctaagtgtatgcatgtacccattaaccaaccacacttcatcctccttttccccaccatttcccagcctctggtaactatagttgtactctctacctccatgagatagcttaggtagctcccatatatgagtagaaacacatcctcaaaacttagaaagattacaaaactagaaggggacaagcagctatataacctggaaatcagcattttttttttcttttttttttgagacggagtcttgctctgtcgcccaggctggagtgcagtggcgcgatctcggctcactgcaagctccgcttccgggttcacgccattctcctgcctcagcctcccgagtagctgggactacaggcgcccgccaccatgcctggctaattttttttttgtatttttagtagagacggggtttcactgtgttagccaggatggtcttgatctcctgacctcgtgatccacctaagagtttatcttttcttacaacttcttttatactgaaaagaagctctttagttaactctctttgtcatggagttagaagtcaagtgctattccttgttttaaagatgattgcagtcttggcatgttatcaaaatgcaaatactttacccttaaattaagcccttatttagagactcaaaattccctggagagaggaggatagcagtgctatatcagaaatatatttttttaacatacagagttgactgaagttgtttttattaaaaatgggcatttctaatcctgtccacaccaccatcctcagtatctcacctccaatttaatgacaatttcattctgaccttaggtgaagtccttctttctaagaaatatgttctgtaatcccccagactagagtagatgccttagaactttctatactcccttagttacttaaatatatcttaagggctagactgcaaattggcaccacatcacttctcccacattctgttgttaagtatagcacaaggctagcccagattcaaaggagaaaaactccttctcttgaggggaagggacatatgcatgctagaacaataggaggaattattggtgtccatatttagatataatgtatataaatgcccatttgagattagaatcataattttaatgtcagcatagtctttgtaattttcccactttttttatttactaggatgtagatacaaagaagacaaatagttgaattcatccagcatttgagtttcatcaggcaaggtaaacaagtcctgataggcaaaggatttaaaaggtttatgcaaagaagttgttagacgcagagccaaggaaagaaaggagatagtgaataatgaaaaactgcatttgaggttgttttaaagaattaatggaatggaagtaatagagttagtgagctggaatgatatcaggggtgatgagaggtcagattatagaactgtgtagttattactgataataagtttagaagggagaacatggaagcagaaatacattttaaaaacaaggctcagtataataactgagtacttgtataataactcagtataataactgagtactcagtataataactgagtacattgtacagttctaaaaataagccttaaatttagaacaaagacagtgatcatcgtaagctgaaatggaatggaaatattccatgagagaggtgagaattgagtggaatattggagacaggtaaagcatcagctaaagaaggatgctggagaaggcctggcggacttggcagcaccatttgcatagagtgcttcagcttagcgcttaagcccatgttgagcttccacactgtccaataaggagtttagggtttgatttatgtaaagtgggaatcactgaaaacattttagtaagaaagggatgttattaaaataatagaggaagattaactgacatgaggaatagtatgaaagattagtgggactgaaagcgaccagttaagatgctggtggaataacccattgtgatgaagcatttttaaaaacatgcatgtattagatgtatagaaataaaagatatgccttttattgacatctttgattggtgtgtcaggcataaaaaaagcagagggctcttaggaattttttcagcgtatgatgaaaagcatgtgatctgctggtgaccctggaacagtgaaagtccttggccgggcgcggtggctcacgcctgtcatccctgcattttgggaggccgaggtgcatggatcacaaggtcaggagttcgagacaagcccggtcaagatggtgaaacctcgtctctactaagaatacaaaaaaagccgagcatggtgaggggtgcctgtaatcccatctacttgggaggctgaggcagagaactgcttgaacctgggaggcggaggttgcagtgagccgagatcgtgccactgcactccagcctgagcgacagagagagattctgtctcaaaaaaaaaaaaaaaaagccttaatgtggccattttctggggcgcctcctgctggtttcactatgtctcattgctcatgatgttttctccacaaagttcttgaaggctgtttagaacatggtttggaagctagttgagcaaaaatgaaaagataactgggagggtctatggaaactgaataaaggtggtagctatggcagtaactttgccctcttcaaccaagtgttgtttgtctccacaattgcttttctaatatgggtattatccccaaaatacttaatggtgggcattgtctccaaaatacttgtttttaaagatgcaaggtgctgtagttgtattgaacctgtgagaatcaaatcagcctgctggtgctaactctgatggagggcggtgaggggacagaggtcataataacacagtcgccaattaagtgcttacaaattctggtttattatgaggctttcacacaccaacaatcatgcaaatatgtttaacacacaagcagtgataaaaaggagcgagtagctccagagaccagcctactgacttatgaactggcaggtccagttttcctaagagagccagttcacccaggagaagggcctcactgctttttttccccagcagagctctggcacctgcagctgaaggaaggaggccccagagttctcaccagcagaaatgctataggcttcttactgtggtcagcttctttgtggtgtttggagtcttccaaagaagtatacatggccactatcttcagctgccttttaggagagaattttatgagtacatagtagatgtatacatttatggggtacgtgagaaattttgatatgggcatacactgcgtaataatcatatcagagtcaatggagtatccatcaccttaaacatttatccttccattgtgttataaacaatccaattatattcttactgtaacatgtgcaataaattattgttgactgtagtcaccctgttgggctgtcaaatactagatcttattcattctatctaactgtattttgtaagcattagcaatcctatcacttcactttcttgtcaggcctcagaggtacctggccatgttaggtgtcatcgtatcatctcaggccaccataagtgtttttatcactcagaggggtcagcaatttcactgaagctgagtcatttgtcataagtgactccattttgagacattcaggattacaaaacattattatatatcatactgattttacaactcacattactagattcttaatttgcctcaaaaacagacttctaaaaggcattgattttgttttccatacgtagtcgtttttgatgatccccagccaaagagggtgtgtccctatttacattgttgattattacactgattttttttttttttgcctgcttcctactggaagggaataatccctaattcctacatccagttgctgggtccggggaaaagctacctatacaatagtctctttaaaagttgggtaaccccgtgaaaccccgtctctactaaaaatacaaaaaattagcccggtgcagtggcaggcgcctgtagtcccagctactagggaggctgaggcaagagaatggcgtgaagccgggaggcggagcttgcagtgagccgagatagcaccactgcagtccgccctgggggaaagagcgagactccgtctcaaaacaaaaacaaaaacaaaagttctgtaacccactgtgttataatagaaagtgaattaagaagtcaacatcttaggttcatttatttttttctacatgtattattcgtacctactatgtactaggcattgttgtaagatcctgtccttatggagcttaccttttagaagagattacgttctaaggtgtgttagttaaacaaattatctcctgaaaatcccaatgaaggatttttatcagaattcaccttcctgtaaaacataaagtaaattatgtcccagttcctccagttgtcttgagtttaactcctctactttgatattttcttacatattttctcaatagtaaaacttgaggtacaaaattttaaaaagtagaaggtatatgtttattttgtacagcaacacatagactatttcaccaattttggttaaaatttcctatgaatgctgtggaccataagaagattgaacaatgaagattgaatttattgactcactattttttgatcaggagatcaaaattgtttgatacctactatgtgttagaattgatactgaataaaaacaattaaatattattttagtagaataagccaaatttctggataaacgggaagcctactgaaatagcttcttccttcctctcatctttactgaggtataattgacaaacagacgttatatacgtttaagttgtacaacttgatgtattgatatataccttgtgtatcaccagaaactaacatattcatcacctcatacggttaccatcgtttgtgtgtgtagagaacataaaatccacctgctgagtggatttcaggtatacaatacggtattgttaactacagtcacgttgctgtactttagatttccagatcttgcaaaactgaaactttgtacaccttgaccaccgtctcctcattcatcctcccccagcccctgacaaccaccgttctgctctgcttctacgaactgaatagctcctcttgatttctttttctttctcttttttttctctctttctttttctttctctttctctgtccctctctctctttctttttcatatttaagtgctgaaattacgagattggtagatttaagatttcttttgagcgtgggacaaaacacagacacttgaatagatggaaagcagaactctattacttgcagctttcaacaaagttgcagggctagacagaggttgcacctatgaacagtgtaacagcaagcttatctgtggtaagcagggtggggttagctaggtttctcagacttactgtggattggctaatttgaataattttgacaggatctggagcctaggagctgttccttttagtgtggaacctaggcctggggcaatgagggctggtgtagaggagcccagaatgtaagggtctgatgaagaaggggttggagtgtgaacttcatcagctgcccaagaaggggaacagattggcctccagtcaaggcctcaaaatggggtcaaaacagcatttttaaacagctgtgttagacgattgtatctaatgtgtttaatctatctctgtaacatatagttttcttacatccaagatctagcaggggtaaatgtattacttgtttcaagctcaggaaacaataccagttaaccatgtatgtgagatcataattatcgaagtgtgaaattaatagtagaaggatacattgacggtgatatttataccaaaaattttaaatatactgcagtaggcctatctatatgtatctatatctataaaatagagacaatacctactcaaagtaattatgtattaaataagatacagtcttatttatatataaaatatagccttgtatacagttctttctatcacctttcacaataaacagatggatcagctgtggggaattacaaagtttgtgatcacttacaccaaaatacataagaaaatcataaaagcctgggaaattaaggaattaaacagcagtgttcccaagcacagtgaacttagcaagtctcatattttgactaataatgccttctgtcgtcaagtttcagaatagtctccacgttttgccctctttttttacttttgtcaaagggaaaaaactctttaaccaccctgtaacacacatgcacacacacacaaacacacacacacacacacgcacacgcacacacagtctttcaataaacctttcaaagtccaactcaagttgtgctcttaccatgaatttctttaccaccttctcaatcaacttactctaaataacttatcatattcttcgtatttattgttctcctgaagctcctgtaattatcttccagtttaaacgttcttatagtccaaggtggaatacaagtgttacattactgttgataaaaaatatataaccatgaagcaatacaacatcttctttctgaccagtgaattaagaagattagaactacattccaggtagtttgaaaaagtggatagatatctagactcagaatcagaatttatttcttggtgtctgctttttcaatttctttatttctggtctctgttttgcagtttattagttctgaaacatagggaaagcactgaaaaaataatccaagcatatgggttctaatctttggattctttccaaataactgtaatttgaatatatattttctatgaggcataatttattctatttaaaattggtgtaattccaaacttcccatttcacacaagagttatgaagataaattaatccttgaattcaaaaactatttcctgagtccctaatgtagatttgttactcgactaagccttcaggatagaacgagtacagtgttttaccaatcagaagatgcatctttttcactttttaacgtcactaaaataaaatatcataccatcggtgatgtccagtgattaccatgaactatattttcatagcataaaatctttgaaattgtgatgcatccttagtgaaatatatttatacttcttcaagtttagttgaggaaacaaagttcatagaactaaacagaaaacgtctatgcagtatcgttagagaaatactatgagatcacagaaaaggaggcacacaaattagtttagatggtcttaaggactgaattatgcctcccgacttcaaatcatatgttgacatcttaaccccaagtacctcagaatgtgactgagtttggagatagagcctttaaagtgatgattaagatgaggtcattaggatgggccctaatccagtctgactggtatcttataagagagggaagtttggatactcagacacagtgaggaggtggccacccacaagctaagcagagaggtttcagaagaaaccaaacctgtcaacatcttgatcttaaatttctagtctccagaacgatgagaaaataaacttttattgtttaagccacccagtctgtggtatttggctatagtagctctaggaaattgaaataggtggtccaagagagcttttagacaaattgatgtccagttcatttcaggataagttggaatttaccagctgaagaaataatagaaggaaagtgctgaaagcagaaaaaataacccagaaaaggcaggctataaaaatgatacattcataagacagtaacgtgtgtgtgtgtgtgtgtgtgtgtgtatgtgtgtgtagaacctggagtgtagaaagtgagcttactaaaggaagaaatgttgagtgagaaatgaagctgaagaggtattcaaatgccacaggacctggggcttgaaattcaggcaaaggaactcgtactctatcccataggcagtagagggggttttaggcatgtagaaggaatgtaaataataaggtggctttttaaaaaatgtatgtcaaaagtttttttctattgtcatgaagcaaaatattagaatcacctctagcttacgcttgttatacttatgagaataaattgtatgtgtatgtgtatgtatttgtggataagggaccagataccttacaaggcccagatgtaataaatatagacgatagattaagagttcaaacatctgagtcttctggggcctagtacccttctgtcttttattttgaccaccttgttctgtgttgctcactttgatttagactttgctgtctttatagctgttctccaaacattcctcttactgcacttaccacatagagcataattgttattcccttatgaactttaaaagtttatttataataatataaatttggaaactaaaataacctaaagctcaagttgcccgtcttaaaatatgggtagttcctttatcaagatggttcatatgaggaagtggtgaaaatgatagggttgacactcaattattaaatatataaaatctagcttttactttaaagaagtacatagtagggaaagtgtgaaatttaacttcaagacagattgtattttttcggaatcttttacacctccgatttgcctttacgttatctgaaacaaagatcaggcttaaaaaacataaatattaaaatattcatccattttgaaggaataagtaaataaaacacatctctctgaaaaattctgggattccatttgacctgaacatgtatcttattactagagaagatggaaaggtggaggggcttggagatgggagaaaaaactaaagtgctatgaatgattatacaacagtgccccctgatgggaagaatggggtctgaaattcagatgagatttcttaccaagtcaattacatgacttattcttcgtttttgcttccatttaaagagatttttgtagcgatgcatcagttttactatagaatctgacatacagtatgcactgaaaatatatgagtaaatcgaactgaagcattaagtctaggcaaggagcttttaaaaactttagctggcacaagggactaggtgtgttaaatatgaccataaccttgagttgtctgtagggtaaaatacattgatctttatatgttaagcttttggcaagtgctatttcccctactaatttacccacacttggtgataaatctatcttcgatctcaaaacattatcaaatactataatattatttcaaaattttaacagtataattagttcagatttaaataatcttgaggaagaatgatttcaattttaaagcaaaagtgtttttcaaataaccaaaagaaaatagttttgctttattttttgttattaactaggcatattaatgtggtcaataagaactgtagcttttccttctctaaaggggtgtaggaatggaaagcaatgagtactgaaaaggtaagaaaaatttgtacaatctagggtttgaattcaaaccccagagtagttgcatggaacaaatttactcatcttaataattgtcatgggtgcatggtaaataaaaggagaacttgtttgttaagaatgaggcattatcatagtattggtaatgcattctataaataagatttatgttttgagaaactcaagtaagaaagcaggaatggaattatccgtttttgaagtgaaagagaagaaatgtggagagactgtgtgtgttaggtctgcatctggctcctagggagatttgaatgaattagaaggaggcttcctttcctcttgatgtttgtagtcctgacttggtaagtagacacaggctggattgcaggccctagccacaccctcagcaggcatcaggtataattatcaacctgcaccatcagaggttgcagcaactcattcagtgatacatatttgctggatatgcatgaaacactctagtgaatttgaacatttttaactgaagaaatatggatatctagcattcattatagataatctcccttgacacccttctaaaaaattcatgaacccgtaggaagtagcatctcactgccttactgaacatggtaagtatgctgttaaatctaactatctgcttatgttttctgctcagcttaaatgctctttattttatattactactatttatttttgccaattcaaactttacctattttattgtttgcatcttgaatcccacattttctagaaacactttagctcagaatattatctttgtctttggaattctgatttcaaagtaatgtgttgtctggaacatttatgttttcttactatctaagtctgaatcagcaaggcaggtattcagtgagataaaagaataataatatcatataacattgtttaaattattgggattctaattagaacgactaacagtttgcaccaatcaaaacttacataaaccattaatttcaatattttggaatttaacattgaatggtaatgtttctttaagtagctacggaactatatttgtccaattcagttgcacctttttattctttttgtatttccaaattctgagattcagtatgttactaacacctcctgtctcataatctatttagtgtgccttaaggtaagataggctgcttaaggatgctttgaatttacaggaaagggatatctctgtggtaccagaatttatttgagaaaaaacaacttcaaatgtagttttcaaactgtgcagactgtcaccttactgacatcagtaagcaaatgttcttaaacttgtatcaagtatctgaatagtcacttacttaactgttcaatgaagttaaccactaggagacaagtttgccctaagcttaacccagacaggagatttcaccttctagagttaatttacagcttaagaacaagcccttcaaaatctttctactaattgttttactcaatttagaaagttcatttaaatgagaattcttttttatctaccttaaggcaggttaagtatttttttccattacatttacatatcatgtcttgccgctatgtttggtgttatacattattatatagacatgtgaacagttttgcataaatatgcccagtaaggttgtaagtactaatttccccctgatttcctccattaagggtgcaacattttactaacaagaagaaaagtatcttaatttcatgattcacaagtgaggaaaatcagatttttcaacactgaaaattagaatctataaaagagaaataggggaaatgtaactactaaatgttatgtgcaagcaacaacataaagattagtccatgtaattataacacaaccaatggaattcagcaagtactttactacttaaagtaggaggaagtgtaaagacggatggacagtccaagtcccagctcagtctcttgtgaatgtggataagtcagtttaaattctaagttcactgattctgtgttctctcctgcaaaaagtcagaatggcaatgcttatcatgtagaaagattggcatttaaacaattgttttgtaaattctagagtatattctaaatatgagttacatcagattgtacttaacacgtaagattttctaataagactggaatggaaagaaggaaaccttggttcagtaaccaatcatttgtgctcctttgtcaaatcatttaatatttttgaatgacagctttaagtgggattgtgtgagctttaaatagagttgtggtaagaaggaggaaaaaacaatctcttgggctttttctagctctaaaacactttaattctgtcatttatagctttgtttttaaaagcaagtcagatggtttaatatttatagattcatacactatattcaagaaagtattagagacttgtgcaagattccatgacaagtcagcagctgtgttgagataagaaatttacgctggatcctaaaatctgtcatcctgcctagcgttccttctactgaaactctctgccttgatagtaatacttctagttactataatctaattgaatctcttcatgtagatcattctagaaaatattgatatgttgggcatacttccagtcaatgttttagagcctgtgctaatgcatcagaataattagaaacacaaggcaaagcttctgccttcagaaagctcacagtctcacagaggactttacctactgacatgtttatcttagcttgtgtggctaaactcagcaacatgcaacatgctttgaatagttaaaattggacagctactctcaacattagccatgaagcacttcaaatgaagggataagaaaaattcattgctttgctcatttaacagtatgataaggaaggaggaggagagagatatatcatgttgaaagaacaatgaagaatctcaattatatcaggaatttgtacattagatgtgtcgttttaaaatcctatgcctgattatgcatacacaaataacaagtataaatcatcctcttcatacacattttttgtttaatctttaatacaaacccatgggaaagatttatcctactatcacaaatgatgaatctaatgttcagatattaggaagcataattttgctatttgtcttcctcattaaattgtgaattcctgggaggaagtgtgtaatagtagaaccaacttacttatgctgaattcactgtcccataaaaactgtgtgtcgcctgaacaagttattaaccctcctgaatctcagtttctttacctataaattgcaattacatgaagtacatataaagtcgttaagggcctgatatgtattagctaagtaatgagtgtttcttacaccatcatacatagcagagtccatgaatagactctctgtaactgtggaggagggatgtcatccagtcatactttacagggagacttctaatacaggtggcctcttagtacgtgtaaaaagtcaaacctatttagaagcccattgtaaaatcataaatgtaaataactccctaatgataaaggcaagtcatttcaatagctcagtgaaatcttaagagattcttgactaaatatagataagtattaaggtcgtccacttccacagattttctctaataatttaattcttctcatcttattacttaaacccatataacatagttattcagaagcagtaaatgttgaatagaacttaaactaaagcacaaaaatgagaaatgttttttaccctgacttttgtacccccatcaaaaccagtatgcaatgtgaaaaatttcaacccttaaaaagaaaaatttacatgttgccatattggaaatgggggagggggaagacatatacttccaaagaaggacctctgagttgattaaggccatatcaccagaatagtgcttccagaccagagcattcaggttcatttaatttctctttgtaaacaaagcaaccaattttcagttctattgcaaatatctaactgtcctctttttcacagaggagagacaagtattaactgctcttcaaaagaaagttactctgatttacagagattgtaaacctctggcccccacaaacaaacaaacaaacaaacagaaagaaaacacagagcaacaagtctcttaaggacgtaagacacctaggagatagtgttcccactaaacaatgttgggactgggccctgtggctcatgcctgtaatctcagcactttggagggtgaggcaactggatcacttgagcccaggagttagcgaccgattgggcaacatagcaaaaccccgtctctacaaaaagttaaaaaaaaaaaaaaaaaaaaaaaaaaaaaagctgggtgtagtggtagctgcctgcagttccagctactcaggggactgtgatgggaggattggttgagcccaggaggtctagactgcagtgagcagtgattgtgccactgcactacagcctgggcaacagggtaagaccctgtctcagaaaaaaaaaaaaaaaaaagttggaggtgcttataacagctataattgtgatgtggagatgctaaccctgtactcagaaagactgcgactctttaagcacagaagaagtaaagcacatactatgtagggaaagagaagaatagttggcttatctgccaatgccatagctgcatattaagacctaaattccaaaactgtaaggcaggcgttatttttagcgttctattccttcatttcccctactattcgatatcacaattacaaagatcagtccttccaagtagttgattgattgtcatcattgatcttgtacacagaaggtgggaaaaaagcacacgtaagtcttgcttggcatttcagcaaatttcctccattaagcgtttttattggcagacctaaaatatatgttcttggtttggaaacgattccctgatgggcatggattgctgcttttacctccctgctcacccttataaatttctgaattagaacaatggtaaaacagaattgaagaaaagaaggtacaactttttaaatgctggaagaaaaaaataaagcttcactaaggtcaatgtaaactgactctacacttctgtaaccctcccagaaatatcagtaaacatttttatcccaaatttattttgtcttcttttccaaaggctcggtgttcatttatctacagatactcttactagggtatattggttttataagttaaaactggggctaaggatggaaaatagtagtactaccatgctcagctaatgagttttttgctctgccagcttatatggcagccttgtaaatagctttcattttatgtaagcttcttttgatagcacctttctctgttaaaaggattttatttaggcttagatgcaaaaaatgatgattgatactttatttttactactgtggatcccaaaggggccagcaacataaatttcaaatatttgcttttcttattcctgccaaccttagttaagccttgtatatgacctgaagacatttttttttttcaattcaatagttaattcattgaaaatttttattgctttgttaggcacatgtgacacaaacatttaaaaagatgggcactgattctaaggcacttataaatagtaaggaagacagtcaaataaacaaatacaatatagtgtgatgattgaaagaatagggctatactcaggttgtagaactagccaagaagaccagtgatgaaattggacttccattggtggaggtgacaaatatgttcagggaagtattaccaaaaaagtaacactaaaaggattttgaaaggttaagaagtcttggctcttttaagatcagatgtgaccactaccacatcaaggttgcctgcaagtattttagtttctatttaaaagaacaactgtgcatttggggtcatactaaaaaaatccttgcccaaaccaatggcaagaatatttttttccctacattttcttctagtgcttttacaatttcaggacttccatttgtctttagcaaattttgatttgatttttgtatatagtgtgagacacagttctgatttcatttttctgcttgtggatatctagttttcccaacaaaaattgaagagactctgtttctcagtgtgtgttcttggcaatttatcaaatttcaactgacagtaaatgcttagatttatttccagactctctattgtgatccactagtctacatgaagggtcctccacccccagtcacagaccactactggtccatggactgttaggaactgggcagcacagcaggaggtgagcagcagacaagcaagcattactgcctgatctccacctcctgccagatgtgtggctgcatgcattagattctcacaggagcagagccctattgtgaactgagcatgtgagggatctaggttgtgcactccttatgagaatctaatgcctgatggtctagggtggaatagtttcatcctgaaaccatctccactgccctacgccctcttcttgctgtctgtggaaaaattgtcttcgacgaaaccagccctgtgtggctggggactgctggtctacatgactgtttctgtgtcggtaccatgatgttttgttaattatagtgtcatagtaatcttgaaatcaagtagtgtgatggcttagctttgttcttttacttaagattactttggctattcaggttcttttgtggttctatataaattttaagattatttttctatagctgtggaaaatagcattggaattttgatagggattgcattgaatctgtagatagttttggatagtacagacattgcaacaatattcattcttcaatccataaatatgagatatcctttcatttatttgtgcctttttcaatttctttcatcaatgtattgtagtttcagtgtacagatattttgcccccttagttaaatttattcctgtgattcttttgatgatgtgattataaaaaatattgccttctttatttcattttctataacttgttgttagtgtatagaagtactactgatttttgtatgttgattttgtatcctgcaactttactaatttttaatcagttataacagtttttggtggagtctttgcagttttctaaaaataagataaagtaatctgtaaacagatacaattttacttcttttccaattcgaatatatttatttcttttccttgcctagcctggctgagatttcccatactatattgaatagaagtcagcatcctttttttttttttttttttttttgagacagagtcttgctctgtagcccaggctggagtgcagtggcacgatccctgctcactgcaagctctgcctcccgggtttaccccattctcctgactcagcctccctctcgagtaggtgggactacaggcgcctgctaccatgcctggctaacttttttttgtattttttagtagagacgaggtttcactgtgttagccaggatggttcgatctcctgaccttgtgatccacccgcctcggcctcccaaagtgctgggattacaggcatgagccacggcacccggccggccagcattcttgtcttgttcctgatcatagatgaaaatagtttttcatcattgagtgtgatattagatttgggctggtcatatatggctttattatgttaaggtgcatttcttctctatatctaattgtttgagagttgttaatcataaaagaatgttgaattttgtcaaatgctttttatctattgatactatcacatgatttttattcttcattttattaatgtggtgtatcacatttattgatttgtgtttgttgagtcatccttgcatcccaggtctaaatcccatccaatcatagtgaattatccttttaatgtgctgctgaattgagtttgctagtttttttgttgaggatttttgcatctgaatttttcagggatatattgccctatgcttctcttgtattcttatctggctttggtatgagggtaatgttagtcttgtacaatgagtttgtaagcattccctcctctttaattttagggagagtttgagaaatattgggattaattattcattaattcaaatgttgggttgaattcaactcgaagccatcaaatcctgggcttatctttgttgggaagtttaagactactgattcaatctttgtattagtcagtctccagcagaacaatccatagagagagagagagtgagagagacagcgtgttaaaaaggggatttataataagaattaactcatggaattctggagtccagaaagttctacaatatgctctgtgcaagctggagaactagaaaagccaatgtataattaaatgagagtccaaaggcctgagaaccaggggacccaatactgtaccttttagcccagttcaaaaggcctgagaacttgagtggggtggagtgctcactttggagtcccagagtctgaaggtctgagaacctggaacaattatattcgaggacagaaaaagatgaatgtcctagctccagaagaaagactgagtttgccctttctctacttttttgttctatccaggtcctcaatggcctgcatgatgcccatttacactggtaaaggcaaatcttctttactcactctactgattcaaatggtaatctcttctggaaacttccttacagacatgcctagagataatattttaccagccatctgagtatctcttaggccagtcaagttgacacattaaatttaccatcacagtctccttactcattattggtttcttcagattttccatttcttcataattcagtctttccagaggtggaattcaccttgcttatcattagcatgtgtattcagtcaacattcaggcatgatggtgatgtcagaaaactacagattatccacatgggtggctgagatagtgatactttggcttactgatggttcagtgtatacaaactttgtttcaaactttgcattccaaaatctaaaataaaaaatactctggtcccaagcattttgggaacagggattctcaacctatattcagagagagggggattaaaaaaaagaaaaaagaatggggaaaaaagatgtaaaaaacacagtaagaaacatttcatctctctgattctcaatcttctaacctttaatatgatagtacctacttcaaaggatccttgtaaagattaagttagttactatatgaaaaacccttagaacaatgcttggcacattatatagtctcagtaaatattatctggcattgaaatattttaaaatcaaatattagatattctttttaaatactttaaattaaaaagagcacctgacacctcagtggcccagtcttaggatttcagataaatttcccctggaatactttcagtttgagtctagttgttttcaaaatccagtaaaagactttaatgaatgtaaaatgctatctgaatctggacattactgttttaattccaatagaattttctcatgtgggttaaaaggacaatcagcttatatttcctactatattttcatctagcacaactcttaaagcaagtctattttagttatatattattttatcatggttcctggaaggtaagattggtggccaccacattcagtctccttcacagctaagtgtagccacataactatgctttggccacggggatatgaatgctactactaattttttcccttgaaacaatgggatgttgactttcttgctcccttcctccttactgcttattgggagatggcagaaactgtcccatctaccattcatgtataagttaaaaccaaaagtgaactacagcatagccacttagcctaaaaatgttggctcgtctgtggattgatatatgagagaaaaataaactctgattcttgtgtctgttataatagctagcctgtatgtgaataaataccttctttttaaatttttgaggaattaaatctccatattatgtgtaaatctacattaaattaatataccttgagatgtttttctctctatatttcatgtcttttcatcacaaaagatttgaagcttttaacataagatttaatatctatcttacctctaaataagaaatgtttctttgacagtttggaaagagaatttcagtgattatagtcttatacctcaactactaattcattttacttgtagagcaccaaactataagcatccattatagcaatattgtaactacatcagattgatatatctctaacaagttttatgaattccaggaataatgtgtttaaagtttaagaaatttgaatatgttcctttctatctgagagctaagatagaagagtggtagctaaaaaaaaaagctaccactcttacctcctctgtaaggggaaaaaaaaaagataataaattttgttttcccaggaagacagagtaaatgttgccagaatctaactaaatatactgtggagctcttccttaagagacagaagaattagaaataccacatgcaataagtgaaattaagtttgagcatttatacttatcacacgaacaatatctttctaaacataatctttgagaatattccctcttaaagcatcagagataaggtgcaatttatattgatacttttccatctcattagaatcttttgtgagcaatctatagcctggagcatctgtttctgcttctagtggtgtggttagaaagcagatttaactattttggctttggagtttgctttaaagctaatataggcaaaagtcacgtggtctttcaattaattaaccaactgaagtgttaacctcatctccttcagtgtgaaggaagtgagatgttcatccctcacgattataacttaagggtgcagtggctcacgcctatgatcccagcactttgggaggctgaggcaggtcgattgtctaaggtcaggagttcgagaacagcctgaccaacatagtgaaatctcgtctctactaaaaattcaaaaacttcctgggtgtggcggtgggtgcctgcaatcctagctactcaggaggctaaggcaagagaattgcttgaacttgtgaggcgaaggttgcagtgagctaagactgtgccattgcactccagcctgggcaacaggagtgaaactccatctcaaaaaataaattaattaattcaaaaataaaaaataaggcttacatgggacaagattacagtttgactgaacaacttagttcccagtccccaaaagagagagaagtatttaaatgggaaatacagaaagtaccaaatttaaaattatattatttgacaatttattcaataatttatattttcacccaaaggagaatttacccacctctctctatataaattcaatgataaaacattccgtgcatagtacagtttaaagtcccagcactcctaatttttcacagtaatatgtcagattattatcatctggacatgttatttgctctgtaataatataggctgccttttaattactggtgtaaatatttttgaattttttctataagccaagttcagttgtcataggctatagtttgaatgttcacgttgccttcaaacttcatgttgaaacataatccccaaggaaacagcattcaaatgtggggtctttacaagctgattaggtcaggaagactcctcccttatgaatgggattataaaagaggcttcacatagcatttggctttttgccctgctgtccctgctgccatgtgaggacacaacattcatcctctccttaggatgtagtcttcaaagtgccatcttgtaagcagagagaactatccctcaccagacaccaaatccactggtaccttgattttggacttccagccttcagaactgtaagaaaaaaaaaaatctgatctttgtaaattactcagactaagttatttcattatagcagcacagaattagaaaccgtatgtaattgctccctctctgcctacaggaatacattaaaattttctgttttgtgtatttaaaggtgatccaatgacagcctttattgaggaagcgctttgtttttcagaaagttggaagaggcgaattcatttaaaatatcttacccatttctctatgatgtacctaggacattgctgaacttttctcttgctatcctctagaggagatttaaattgctagctaaaatgtcattagcaaactactctggtgattgggatgaataactgaataaatgaaaagataaattggtcagtagattaacagacaatccagtgtgacttaaaaaatgccatcaaacattcttggaatgttaggtaattatttaaagaggaaaataagtgataaaataagaaaccataaatgaagtaaatgttataatttgtgttttgtatataggttcttgacttactaactatattcactgttttccattcatgttattactaaaaacgatgttttaaggtttgagtttattatttatagttttctacataaataaagggcttcattaaaattctgatttcataattaacctctacaaacacaggccccatggtattataaaacaattgccactttagaatttttgaaaagcattatccggtagaaaaaagtaactgctttatttgagttaaattaaggctcttaaaatcaaatcttagctatgccgtagccacacagtttcagtaagagtgcagcatgaggtcacaggaagaatagaatatacaagtgattatccaagaaatgaagagagtctgtagttgtctgtcctggggaaagtcacctttacattcatttgctttttgactataacctataggaaggcacaaactataaaaaataagtcttgtttatcgtagggactcaacaatatgtaacaattgaagaatgtgtgggtctgagatcctttaaggatttataacattttaagccatatttgctttttttttttttttttttttgagatggagtctcgctttgtcgcccaggctggagtacggtggcgagatctcgactcactgcaagcgctgccttccgtgttcatgccattctcctgcctcagcctcccgagtagctgggactacaggtgcccgccaccatgcccggctaattttttgtatttttagtagagatggggtttcaccgtgttagccaggatggtctcgatctcctgacctcgtgattcacccgcctcagcctcccaaagtgctgggattacagacgtgagccaccgcgcccggcctgctttttgtcattatagttttcaccctaaacactgcgaaaggaagggctaaaatatcctgcatatgggcataaaataagatctaaatgtcccatatttctccctgtctcacattatcaggatctcctttggcttctgcttgcactagtttatcagcttgtggccccactaaactatctcagcagctcacagttttaagcagatgtgagtctctgtccaaatttttactgaaaaaaaaaaaaaaaaaacaggtaaaaagaaatcacttcctttttttttttttttgagacagagtctcagtccatcacccaggcttgggtgcagtgtcatgatctcggctcactgcaacctccacctctgggttcatgcaattctcatgcctcagcctcccaagtggctgggattacaggtgtgtgccaccacacccaactaatttttgtatttttagtagaaatggggttttgctatgttggctaggctggtcttgaactcctaagctcaagtgatctgcccgcctcagccccccaaagttctgggattacaggcctgagccacggcaccctgccaaaaaaaaaaaataaataacaacaacaaaaaaacaaaaaaacaccttctgatacaacacatttatgtgtgacagtctgagggtaaattcagggctatcgtttaggtcataggtagtggtgtaaggccaaactggctttatggctgttgtccatttgattgcttagcgtgtgtatcttcattgatgattgtccatgctatatgacttgttaaatgttttaaatattagtgctggttgtggtaagatgagagtaaagatggagatccttaacagttcatgaatacaaacaccttctaaaaggaatatacacatttctgtcttaaaagctccttagctactcctccaccatttagctcacatactgcagtcttttccctctcaaactattttttattcttctctccttcacccttacattctgaacatttataatgttgaaaagttttagccatctctcttatttgctgatttttctcaactcatgccttaagggttcaacttgtactcctaaaagtttacacatttattttcttaaacagagacaattacctcctaagagaagttgtggtataagttataaggatcatattttgtttattttttaatttaaatagactgtttcttaaagcagttctatgttcacagcaaaattaagtggaaggtagaagagtactcatttacttcctgccttctctgccacacagagcctccctatcattgacatccctgaaccagagtggtacacttgttacagtctgtgagccacatttgacacatacttattaccccagatcagtagtttacattagggttcactcttggtgatgcacattctatgggttttgacaaatgtaaaataacatctacccaccattatagtatcatgcagagtagttttaatgccttaaaaatattctatactggaactgttcattcccctctgcccccaagccctggcaatcattgatcatgttattatttccacagttttgccttttccagaatgtattatagttggaatcatacagtaggtagtattttctggttaacttctttgacttagtaatactcatttaaggcttgatagctcatttcttgttagcaatgaaaaatactccattatctggatatgcctcacttgcggaatgacatcttggtggtttccaaacggtgttaattatgaatgaaactgttataaacagctgtgtacagattttcgcatggataagtctttagctcatttaggtaaataccaaggagtgcaattgttgaattgtatggtaagagtatgttaactttgtaacaattgacagactgtcttccaaagtgactgtaccattttgcactcctgtcagcaacgaatgaaataattcctgttgcttcacattctcaacagcatttagtgttgtcagtgttctagattttgggcattgtaaaaggtatgtagttgcgtcccattgttgttttactttgtaattccctaatgaagtattattttgaacatttttatatgcttatttgccatctgtatatcttttttagtgaattcttttgagatttttttctgttttttaattgggattttttttattaacatttaaatgttctttgtacattttggatgacagttcctttgtaagatatgtttttgcaaatattttcttccagtctgtggtttatattctcactttcctgcaagtgtctttcatagctttttcattctgttatggttgtgttatagtatctgtaatgggaattagagaccctgaaagaagtttaatagattacttctaagctgccttcctactcttaactccttaagaagtatatttttatactgaagaagtatatttttcaagtgacattttaatattaaaacctatcacaaggtatgattatgaataaaagctggcaaactcatttagaaatattcaatagcttttgcttttaaaaagattttgttttaactaatgttaataaaatcaaaggaaatatccctcccccatatattaattattactatatccttgcatacatttaactggaaggtagaaaagttgactaacaagagtctgggctaaataaagcctatgatttgacagatcattattttttcaggttgtctattaaagtatgagaaacaagaatactatgaataaaatcagattctcctgtttagtttcttaaatgtttcctttatggtgaggaagtattgcctatgtctaagaacagcagaatagaccttgtaaagatagcctgggaaataaagattggaagaaaagttacgatcaattatgggtttctttagtaagatctctacctatgtttttttataggtcccttctaagtatatgattgcagtccagaggtatagtcacatcaattgtgtattatttgcatagattagcattgccttttcacagacaattttctgttattttcctgccaatataaataccaaagactattaaagtaagaagaagtttcaggaaaggtagattgcatcttgtcacaaatcgaagcacaatgagtaagctgatgtgacttttccctgctaagatcactagaaatcagagttgtctcattaaatacacactcaaagaatggaatgattgccagacttgctgtggtaagatctttgaacatttacaaagatgcttaggtaaattttagccttgtcacccattctcaagttatttaaactttacaattttgcagatcttatagatgtactttcactaactctttcttgcatattcttgttatataagaaagaaatgaggcttaaaataccaattataaaagaatgagttattttaaataagagatttggaattatttaagccatgtattatataaaaagaaataacttttaaaaaattctaaaacttaatatagccagaagtaatatagaaaacaatagagggttttttttttttttcctgagaaacatttgactaaaacaacatgtgctaatgccaaactttctggcaataacgtctttttatacatgtgtcatatatatcacaatatgtgtagtttccaaggattgtcataacaaattagcacaaaccagatgagttaaaaagtctcagatcaaggagtcagcagggtcgtgttgtctctgaaggcactagggcaaaatgtgatccattcgtttctcttagcttctggtattgtcaacaatccatggtgtgttttcacttgaagatgcatcactccaatatcttccttcattttcacatggggctctttctgtgtggctctgtttctatattttctctccttataaggacctatactataagtgccccaccctaattaattataagttcattttaacttgattctatttataaagacctcttccttcatcttcacatggagctctttctgtgtagctctgtttctatattttctgtccttataaggacccatactataagtgccccactctaattataacttcattttaacttgattatatctacaaatacctcttccttcatcttcacatggagctgtgtggctcagtctgtttctgttttctctccttataaggacccatactataagtgccccaccctaagtaagtatgatctcgttttaacttgattatatctacagagaccctatttccaaataaggtcgtactctaaggttccaggaagaacatgaattttggggagggtattactctcaacccaatacacaatatcttatgtaaactttggatacagaacaatctgagcttgaattccgactctgctacttagtagctatgtaagctaagacaagttagttaatctttctggttatatattagttcctttatatataaaagtatgataaatcccactttgttttaaagtttagaaatgatatttgtgaattaaccagaaagtatctgccgcacagaaggttctaaaaatagtaactgttattattttatgattattatacagaattacagcagcttctttcttttataaacattttgcttaattgtagaagcagtattttagaaacaaaatactaatctttaccaaacgtttggacaatttagtgaaagtgttgtcatactgttgctttgatgttaaggtataataactttgctttagctttgctagcagtatatttctccaagtccagccatctttctgagtattatgcagaaaaacactgtcctcaaggttgaccttaatgacaacattgtggttcataccacttcaaaccctccctttttttgctccttgtaagtttctttttttatttaattgttcaaccaatcaacagctatttataacctatatggaaagtattatattaggaattatgaaaaacagaagtattatatgatcctgcttacaaagaacttatactttatttgtcagaccagactaacgtataacatataaagcattattaggaaaatgaattgaaatttaataagaaatctgcctttttagcaaatattattccagtctttaaaatgggccaggcagtacacagaatatgcaaagatgattgaaatgatttgttcttcaagatggtctcagatgaatgagagatgaatgaaaagataattttcatagaatgtgataaatttaattataatcttatgagagtgttgtgtaacacagaaaagaatacttagattaaaagagaagggcttcagggcttctaggagaaggtgacatgaattgattactaaatgactagcagtagaaagtatattggggaaagaacagaagacaggataaggaattttgaggaagaggaaatagtatttgtgagaaaatgcacaggagcaaaaattatgcaagcattttgaggttattcataattcatagtataagattaaaaggcagtattgagaaaaacatgtaataaatctggagtaaaaagcagaagcagatcttaaaatggtttcaatatatggtattttgttccgtattacctgtgtggacaaagagaattgcaatagtattccaaaagaatatgatgaaggctggagaactgaggaaattaacacttatactagctttctattttaagtcggtacaagttgcttttatatgcattgtcccatgcaatccacatagcaactctataaggtgggtgttctccccattatgcagaagaaagaagtagatcaaaggtgttaagaaatttgccctaggttacacaacagataaatggccatgtctgtatttgttcaaaatgatgacatcatgaggggaaggtgtgtgttatggccgagcataagtcctgtgaggaaacacttagaaatttttacaatgaaattcaggtgatagatttacagattagccttttctcacagtacttattttcagccatgacacctaccttcccctcatgagttcatcatttaaaacaaattcagacattgccatttatctgctgaaacaaatctatattatatagggggcaatgaaattatgaaggcacgtaaactgaagcctacagcacagtttcaaagagggtgaaaattgttaggaagctagtgaaattaacatcaattttaggtttgtttcagctacttgagatatgaccccaagaatttaccaaggaaatggttatattaattcaggtgtgaagtcataaccccagatctagggtcagatgacgaatgctagggagggtgtttgccggtagtcagactaagaaagatagcataagaaaaagggagggagggagggaaagagagaaggagagggaaagagagaaggagagggagggaggcagagagagagcaagagaaagcatttaaaagaaagaaagcatttaaaagaaagaaaacttaatgtaaaaaagtatttaagttcaaaattggttggctattggaacatgaagaacacgtgaaatatttagggtaagcaaggcaatagtcatgtaactgacagagaaactgtgctggaggagtctaatttagtgaggcctatgggggtggagtgaaatgatacttcagtttcagacacacagagtttgagatgacagtgaaatatccaaacagcacatccattaatctctagatattgcacacgaaccagaatatgtagtagtgagatgaaacatgcatgtgagattgtgtctccttttttctccaatccttttttgatagttggaaatcctaacagacagaatctgtgctaaataagcaggtggtgtgaagtgtcagaggagtctgatttatttttcttaacagttagttaaaaatagaaagtgtatttgaaaaacatagatttttgttcagtgacctgtgtcacagaactgtcacaattacgctaattctgtagtcctttttggaggagcgtctgagaggatctgggggccatgggctacaagctaggttactttacctctctatatggtgacttcagagaatgatttcaaaataggatatatgttctaaaactggactgtgctgattgcacaactctgtacatttactaaaaataatggaatcatacactttgggtgaattttttgttacgttatacattcatgaagctgttaaagaataaaataaaataatgctatgtttttatttcttgctaaaaatggttatggattagttctgagtgaataccattgtaaatgacttgatttttaaaactgctgcctaataaaattccaatttatatgcaaaatatagtattaaatacacatgaatactgactctcttaaagtaatataattaataacagctttgtttactttatgttatactgtttttcttgtcatattcctaactatgtctggttcatataaaaatccaaattataagttaagaataaatagtgaaatattactatttattacacacacacacagaggtttgttttgtatcatgttgactacaacttggcaacagacacctgagaacatcactgtatataattttttctgtgttgcaaattttcaaaagaaaaaaacgttttctaatgatgtgggttatttgttttattgtaaattgtttaatcattgtctcatagttcttgaattcattaatagggaactgtactgggggctgtgatgaaagataagttaaaaatggttcatattctcagtgaacgttcctgtatgacaaggatgatatatgtgtagaaggtaattataatttgggtaaaacgtgataagaacagtagtaattattattttaaggctgttcagagttgaaggaggttgcctttaggtatatggatcaaagtaaatcttcaggtaaagtttctgtattagtttttttttaagtgtttttttcttttattattatactttaagttttagggtacgtgtgcacattgtgcaggtttgttacgtatgtatacatgtgccatgctggtgcgctgcacccactaacttgtcatctagcattaggtatatctcccaatgctatccatccccctcccaccaccccacaacagtccccagagtgtgatgttccccttcgtgtgtccatgtggtctcattgttcaattcccacctatgagtgagaatatgcggtgtttggttttttgttcttgcgatagtttactgagaatgatgatttccaatttcatccatgtccctacaaaggacatgaactcatccttttttatggctgcatagtattccatggtgtatatgtgccacattttcttaatcagtctatcattgttggacatttggcttgtttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgacttcttaatgattgccattctaactggtgtgagatggtatctcattgtggttttgatttgcatttctctgatggccagtgatgatgggcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctgtgtcctgaatggtaatgcctagattttcttttagggtttttatggttttaggtctaacgtttaagtctttaatccatcttgaattgatttttgtataaggtgtaaggaagggatccagtttcagctttctccatatggctagccaattttcccagcaccatttattaaatagggaatcctttccccattgcttgtttttctcaggtttgtcaaagatcagatagttgtagatatgcggcgttatttctgagggctctgttctgttccattgatcaatatctctgttttggtaccagtaccatgctgttttggttactgtagccttgtagtacagtttgaaggattctgtataagttaaatggaaataacaacaaatgtgttctcatttgtttattcaatgagacaggaaggaaaccattctaggaatatgttcttcaaatttaatgtctgtatccctatagtacacaaatactttcaaagtggtaggcagacagaaagttttaaagattaattttccacatccttaagattcttatgaattcttttcttgtgaattcatgggaacacttctgatgtaaaagcttcatgcattccccattgagtctccctatcacagtctcccaataaacacatgtgactttgacatccttatttgatagcccaaatctatgccagtgtttcctaaattttattgatccatgtatcactgctacgattttccatctctctgtatcaaaacataacacattttctgatttctgtcatattcatatactttactgtatcaacaatgttttctctgaatttttcatatttacttaaatgtatttgtaattatttgaaatgtgtatcagtttttcacttgtcagatatagaatataatgatacacataaatacatttccctttatcaaagaaaacacactgtagtccatcctttaccatacagagatgcaacacccaagaggggaaaacagtcaaaacaccaaacaaaaggataatcataaatattaatgtggatggtggaaagtaaaaattctaactcatgtaagctgtaactgacttgattttagcaatttatctttttaatattaaaagagaatcttttttgctgataaattaataattttattgtggataatgtagttttggaatataactcagaagaagtttaaagtattaagtaacattgttacaacaaagccttttctattcccatctactcagtatctgaacatgtttttaaatgcgtgtagtcaaaaactagaaaataggtacacccacctcattaagagacagagttctaatacaattttacattcgatttaagcatattgtatattaatttaagcagctgcttacaaaaaagattatattgataacttaatcctaaagaaaaagaagatttttagtcttgtgatctgcattttaaaaattggtttatatgaattgtgtgtgtagagaaatagaacaaccgtaaaaaatctcaagcataaccatatattaaattgaaaaaaattctatgggcaaaatagaatgagaatgttagttcagtaagataaagggacaatatgaaatttctgactcctaaaaagagcttgttcacatatttttaaaatgaattattgtggatttcaaataaccatgatatttatattattttttttccaaaagaatgatacagtagtatactggaaatgatatcattagcaattatttacatttctgttgtaaaaatttagatatcaatctacaaatatgtgatagtatatatgattttaaaaattatagactatatgagcagaaaattttgaagaccactgttgtagaataaaggcctagatgtacaaaaccttaaaaactttgatatatctagtagttcaattatttgatgagtaggacaaggcttggaacacaaatttgaaaagactgaggtgctcctggaaggctaatgctaccaaataggaaaacaagttgggtgactcatggaatttcacattttctcctagtcagccacattaaaaaaaaataaagaagaaacactggaaatcaattttttgttggtttgtttttgttttttgtttttgagatggagtttcactcctgttgtccaggctggagtacaatggcgtgatcttggctcactgcaacctccacctcccagattcaagggattctcctgcctccgccttcccaagtagctgggattataggcatgcaccaccatacctggctaattttgcatttttagtagagttggggtttcttcatgttggtcaggctagtcttgaactcccgatctcaggtgatccgcctgcctcagcctcccaaagtgatgaaatcaatttttaaaaaccatttatttaatgcaatacattcaacatctcatttaacgtataatcaatataaaaaatagaatttggaatctggtgtgtattttacacctatagatcatctcaacttggactatccagatttcacgtgcctagtaaacgcatatggctgtagcatccttatttgatagctcaagtctgggccagtgtttcctaaattttattcattaatgtactgctcctataattttccgtatctctgtatcacatcataaataaattttctttctgtcatagtcacatatatctactgtatcaacaattttctctgaatttttcatcctttttacttaagtttacctatattaatttggaaagtgtagcagttttttacttgttagatatggaagataatggtgtgaataaatagaatataaaatattattacatgtcaaatactttttgacccaagaaactgagcctgagtccagtttctctattagaaagactaagaaacagttgtttaagtgggatataaagtatattcaattttttctaaaaataattgggattaaagaaaaatagtaaatatcactatgttacttactctaaagtccacctgaaaccatatatatatatacatatatacaccatcagcatcatgtgtttcactcactggggactaaatctcagtatgaaacacatactgagtatgagatttagtcactggggaacatttgcaggtctttagtagggatcataagacacaactatatttcataagttaatcaggctaatctatagtactagaatttgatttgatatagaagattaaaaactcagaacattattttaatttctgtacccttcttacattttatatatttctttgtagtaaggaacttcatcatattttattggggtcattgagacatatctaactttttagcctttcagatgatctagaatgctgttacaaaaaaagaagctaaggaatgctggaatttttaatgtcaaagacaactatagaagagtctacaccttttttgttgtttctgttgttaatggtgagatatgagtcctagagaagccctctagaagggtacacaaaaggaagttatgaaaatgactgatctctacttgtttatagtcaattagatatgaagaacatggatctgtattctggtgacattaaataagagtagcctagagtcaaataatacaatcacataatataaagataaaattgttaaagcacatttatatctgtcaaagagcaacctctaggcttctaagtttttattactctaaataattttactagcatcttgaatatcatctgtgattagagaacatgaatattttctctggtaatcaaatgttattgcaaataatatcgtacttcctactgacacaatattattttattatgatttagctattagataaacatgtttttggaaattttaacttcatagctatacatcgtatgataaacgtttatttaaactagaagcaatttcaaaaggtatttctggaagttgccttgattggaatgcaaacatatttatctgtagaataaaacaggccttcactgtcccaagcacagagaagacattcagaaatatattttgaatgaatgaacaattccatttccattagtagccctttctactaatggagcaagatagaaagttttatgtgctgtgtgatttcctaagtaaaataaatggaggaatgaattccactagatggtaacaacagtgctataggcttgggaagattatggataactctattttatgttcctctttcttagaatgaaatactattattttatactgaaaactaatataaagttctaaaagactaccccttatcaaaagagaatataggttgagttacttcaagagtttgagaccacactgtttgccaaacgtcattccatattttcttaacacttttattaatacccccatcgctgctgttaacttattttttcatcatttccctgtcaaatttatctgtggaactggatttaatatgctttaaagcagattttttatgctcaagttatgcctattttaacaagcattttaaaaacttgcatttgttaattattttcaaatataaatgacatagtcaagagcatttcacttgactgggaaaaaaaagaactgactatgagctcttctagattatctcagattacaacgatatcagctttaaaaaagacaggttgtgttttggcatccttcttaatcttcagatatttgcttatcactccatgtcatatggcctgacatcctttctgtggcttgctatcctctgaatcattcctcgccttctcttgactattctgccaaatgcagctgttttctaagagatttcacaaaggttttatctgtgccgtgggacaaaatatgtctgcatctctctctctctttctctacttctatctctatatctatcatgtatctgtttatttatttattctgcatgtataacatatatgcaccactataacatacattcactttacaaaattgtgttaaaaaatattgataaaaaagaaatcacttgtaaaactaatgccaagtggtaattattaaatcagagagagagagagagacagactatgtagaactgtgatagaggaagcattttctttatgtttgagtcttatctgttaaggtaacttaatttcaaacaactactcaaaaagaaagctggtgtcaacacagcatatattttaatgtgttaaatatcacaagattagtgaattcataaacagtctaagtaatggtattcaatttcctatagcatatgtgttttgtaagagatagtggataaaatagtacatgcccacatttgatatgcaaataagatttttttggaaaagcttcttattttcccattgattactattaattttaagtttttaaaccaaaaaaaaaaaaacccatcagatcaaggaatgtgaagtttaatattctctggctgatcatgctttttgtttgcttctaaagacctggacctaagtactctctaaccttctctttatcttgctgagaaaggcagtgacgttacagcaaataaagactacatgaattcttattaaatactgttatttccacttctataataaaatgaataatttctgtttcagtacagaattgtcatttctcctatgttttttattttaaatattttcaaaacaaaaaagtaaaatgaacacccatataaatactcacgtagctcagggatcttcaaactagagtttcatggacaatttcagcttgtcatctgcttctatcagtagttttattggaacaaatctatgcccatttatttatgtattgtctatggctgcttttgcactgcaagactgagttgagtagttgtgacagagaccatatggaccaaaacctaaaatatctaccatctgtccttgtagaaaaagtttgtcaaaccttgatttagattcaccagttattaaaattttgctacatctgttttttctatctttgtaattatagataggtagattatattaatagttatatacatccacagattttatggatgtatatgtacacaaatatgcttttttctgaactatttaaaaataagtgtctgatattataatacttcagcatgtatctcctaagaagaacatcgtcctatatctcctacatgatcacaacattataatacgcgaagtatttaacaatggtacagtaatattgtctcatagacagtccatattcagatgtcttcagttgcctgactcagcatccagtcaaggagtatgcattgccattgatactttatctcttgacccttctttagtctataattctcctttgatttaactttcatgacatttccattttcacaaaatccaagacaatggtcttgagtcatacaatttggatttacgtgatgatttcctcttgaatttattaactattttgataaaaaatgttatgcagacaatgatacacacttcccattttatcatacagaaggactcacaatgccagtttgtcctataattggtgacactaagtttgagtcacttggataagataggatctgccagacttatttattctagtgatatatttaaattccatgttattgataagtagtaatgtccagtgatatcttgaaactatgtaaatattatgctactccacagttttatataatggatttaacatctattgatgatccttgcctgagtcaattattatactatagaacacaaaataaaaactttctaattacatcattccttctatgtttatgacctggcattcctctgtttaaaagttcttttctcttttctatcttttcatttcttaaaaaattattttaatattatggactcatggatttttatgtattcaatgtgaaattatacattacttgcaatattctttttgatacttaaattatataaactggctgttgaaaaccacttcaaactggcaactttgacctgttgtcttctttattccttcatgactgccttaaattctgaagcaacaaaatactcagggcccactttctgattcctctgccctaaaccttgtatgtactattctttaaggattcctagtttagtaagaaagataccaagatctgagtatgagatatgctcattgctagtggtgatttaacacaaaaactagggaatacataatcttagttacttttttcttattcataaattcttacctctaattcaaattcagtgatatatggtttttcctcacctctctcactctataacttgatctcccatttcctgtaatgagaatcatgactccccaaaattcagtatatgtacttatttgatttgccttacatatagatgaagtaaattaagaatcatgatactcactttgggaggctgaagagggcgaatagcttgagctgaagagttggagagcagcctgggaaacatagcgaaacccccagccaggtgtggtggtgcttgcctgtaatcccagctacttcggaggctgaggtgggagaattgctttaacccaggaggcagaagttgcgctgagcttcaacatctcgccactgcactccagactgggcaatagagtgagaccccgtctcaaaaaaaaaaaaaacaatctgatttaagattgttgactgtaatcagctcaagtctaatatggtatagacaaacagccttatcaactcttgtcaactattgcaatgcagtgtgatacaggttaagtctggaatgtatgtaagttggtgttatttgttttacatttttttgttttattttctaaaggaaatcacaatatcagtatcactacctaaaatctatttagaaaagttcaaggattttttgttttctctttctgttcctggaacaggagtgtttgctgtcagctaaatctttttaaaatttacttgaatttgttctttattttctgtgtgataatgctaaaaaagtcacattgagttagtttaatttgcttatattagcatataatattaaggtttgctttatcttttctcttaaatttagtttttaaaaaatataaaaacatttacatggttcacaagtcaaaactatacaaaggtacattcaaagaagtctcattcttatatctgttcctttcaacttgttaacacatcctcataagagatcattttcattagcatataatttatgattctgtgatcctttaaaaaaagaaaagcgtatacatgtgtgcatttaataaagttagtatgttattaatatacttcattttgctttaacatgttctggaataacttagtgtctgtatatagtgaacaggtttttctgtttttctcaattgcttaacactcaattatgtcaatatctcatagttttttcaagtttcctatgtattatgtctttatttgtgtctttttgaatttctttcatcaatgtcttagtttgtaatgcacagatctttcataaccttagtcaaatttttctctaaatattttattttttgatgctattgtaaatgggatttgttttcttactatccaaagtgatctacaagtttaatgcaaaccctataaaaatttcaatggattttttacagttattagaaaaaatcataaaatttgtatggaaacataaaatattctaaatagccaaagcaattttgagaaaaaagagcaaagctggaggcatcacagctttatgatttgaaggtgtatcacaaagctataataatcaaaagagtatggtactggcataaaaactgaacacacaacagagatcccagaggtaaactcatacatttatggtcaaactaatctttgagaagggcatgaagaatatagaatggagaaaggataaactctttagtaaatggtgtagaggaacctggactttcacatacagaatatcatatcatttcatacctgaattaatataaccattttcttgttaaattcttggggtcacatctcaagtagctgaaacaaactggactttcacatacagaagaatccagcaatcttctgtgtatatacccaaaagagaaaaagtcagtatgctgaagacatagctatactactgtgttcattgcagcatcattcaccatagcaaagacaccgaaataacctaaatgcccatcaactgatgaatgaataaagtaaacgtgaaataaatacatatatgtacatacatacatatacacacatatatgtatataccagacacatttacatatatgtatatgtatttacacacaatgaaatattatttggccataacaagcaagaaattctggcatttgtgatgagattaatgaaactggaggatattatgttaggcaaaattagcaagacaaggaaagacaaatgctgcataatctcactatatgtagaatctaaaaaagtgaacttggaaaagcagagaatagaatggtggttaccattagctggcggtgggggaaatgaggagacgttggtcagaagttacatataatcaattagaagatgaccacattctggggatttaatatacagcatgtcaagtaaggttaataatgccgtattgtaaacttgaaatttgctaagatggtagatcttaagtgttgtcaccataaaatgatggcaactgcgtgaggtgatagatatacattgagtagcttcctttatgtgttgggaaaattcctaaagaaagggaaatggtgtgaactttactgtatattatatacacaaattttatacaagtatgctttacccatgagtgtctgggagaaaaaaaaacctgaaaaaaatgtctctaataaaaaatatgggcactgagggagtctataaaagaaagtacaaatgctttgtgacaactgaaccttagaaacttctgaggtatttttttttttttatcaacaatggagtgctctttctgaagaatcacattggacattgtgagaaaaatttttctactacatcaattacttcatttttttttttgccatgtgctaagacactgttttagtcattgagggtacaaagataggtgatttaagattgttgactgtaatcagctcaagattaatatagtgtagtcaaacatccacaccagctattgcaatgtagtgtgatacaggttaagtccggaatgtatgtaaggtggcgttatttgttttacatttttcttgttttattttctagaggaaatgacacttaactgccatgaattacttctgtgaacatttgttactcatgttacaacaaggtgtcttggatttgctcctgacatattcctgtaaaaatccccattgatttttagggttgattcacttgatgtggctgttatgtaatgtgtacccttcctgtttcactgatactgcagctcacttggtcaaagaaaacagccttgtctaataaaggacaactttgattctaaccaaatctcaagatacttttgaaggtgaacttgttttgctaaataaatatttttctttttcatttcaacatgtcataatacattttaaataatagattacctctgaagttgaacagggagttgtattccctgatatgcaacctataaaagtttaataatggttttataagagagaatggggaagaaaagggcagtacttccagtctttatctgtggcacacatacacacacccacagaggcagaaagctggatgggattgtagatcatgtagtttgaaaataattcagtctttgtcctattggttttgtattgtctaagtcagaattttagattttttttcagtatttgtaaataagcagccacatagaggtataatatacacataatgtataacttacttattatgcacaggtggtaaattgccataagtgaacataactgtggaaccaacaaccagattaggaaatggaacattatcagtattcaaaaagaccctcttgtgcttctgcaagccactgcccccaactccctcagggaaaccactacataagtcaacctgaattttaatttgcgttcaagtagagcatagattgcaatatttatcaaagataacaaggttaaaagatgttggcctgaggaaaattctaggtatccatgtctaaacaccagtgcaaatccccaaagaaattatctgtttttatatagttctaaaaattattggtgataacattttcaattagagtttagttgcattacttaaatgtataagcttaaagatcttgttcatatttttgtggttttttctgctttataaaaactattagaaatcccttcttggacattatcacagtctttggtttttaaggtcatttgtactgtgtatgtatttaaatactaacctagggtatgttagactgcaaattaatttttgaagaatttttattgaaataatacccatgaccacttagccttacacataggaaaaaaaatggtcattttaatgtataattttattgtcttcatacaatgtaaaaattagcaataattttttaaagtgataatagtaatattatatttctcatcaatattaatgccaattaaatgcgaacgtttaaagttgctatctgagtatgattttccttgtaaaactccttaactgatgaccctgagtcgaccattggctggaattcaagttcatgagcgtgacacacaaggcccttcgtgagatgatccctgtcttcctttggaccttacaccactgctcttgtttatattacaaaaaataacaaactactagtggtttcctagcaactattgcagcttttcatgcctatgtaagtgcttatcctgctgaatacaattttcaccttttgtatgatataaagttccattcatctctcaaaaccccactctgattcttccttctcttagtctttatggactgtgatcaccaattttaatctcctttttaagtttgttgcttcttccttgacattttttccaagttctagaatggtttaagttttcgaaccacccctataacattatgagtttctaaggaaggagcaggaactatttcttaattaactctgtctagtacattgcagatgctcatcaaatacttgtttgtgggtaaatcttcccaacacttatcagagtgataaaaaaaaaaaaccaagtaatttagtgattgttaaatgattagctttagaaaacttcaggttttttttttgggggggtgggtgttaaatttattttgccctgtaaaaggagttaatctgattcctccccttttgtttataaagtttgtgtgtctcatgagatcttaaagatagaaacaactttaatcgagcccaatttttttaagaaattcataggagaagtaaaaaaaaaaaaatgctctgttacagaaacaagttaaaaacagactaccttgtatcccttaatgagagctaggaggcctacattgtctctccaactgtcttccaagggcctgaggtccttcatggggtctacagacttgaaggcagttctcgggctcatcgtttttatcccgttgttgcctccagttacttatttgctttattctgtcctgttacttcaaatgttttgaaacagcttcttctcttagaatgtatgaatgagcaatgtttcagttccgttagaaacatgactcttttctggctacccataataaatccgctctccagttttgttcttttctactacattaaagccattataacaaaatattaaaaaaaaattttctttcaaaaaaccagtaacccaagtatctatttcttagtgatttggctgcatttataggatattttatttggatctattttataatcacttgaaagcgtcactttggtttggttcaggtctgtggacctgaataaattgaccatgctttggcagagccatcagaagagtattgtggccaatcctttaaatctctgcagatgctctatagctaagtcaatccaaactgatcatcattgtggccatactgagtggtttttactctgccatgggcgtgatgcttagccataaaaagatttacctttgagtgataatatttttgtattttctgctagcgtagtttcccatttccaatgacattgggaagtaaaatatcttgcttttttaatacggtcattttcatttatgcttttttattgttccttaacaatgaaaaataatgtaaaatgatataaaacctctgagatgcagatttcctggggataaatggttggactgattaaatatctgttcatgacactgttcagaatgagtcttcatgtcattttggaaatgaaggttaatatctaatccagttaaatataaaaatatattgtgattaatgtctcatctactgaagagctttggtcaaacaaaaacctcataactttaaaaaacaaatgagagaaagaaagaaacaggtagataattactggaaaaataatctaaaactattcttaaaattatttaaggcactcatattttaagttttcttcgggcatatgcaaaactattggatgtattagataatctctgtatcacatgctctctctctatgtatatttacctctgtgtgctataagtagaattttgtactcacgttatgataataatgctaagcattaatatattttaagtgaagtttccactttatatacgatcttgattgattatcaagtatttttacgttagcgttcccatttaaaaaaattatcaagaaagaaggaaaagaaaaactccttaataacgttaaatataggttaataaataaagacattagaatatgtgttggttgtaaataatttacatcctctatgcttagagtaatttggagaaaattcaatagttctttatagtcatatcttttcatagaatttatatttgtattgctaatttggtattctaggtaaaatttatttctgcccttgaaatgattttcattttcattagtcacttggtcatttattgaatacatgtttattgagtaaacactctgtgctaggcattgctagcataatgaatgagaagaggaccgtgactttatggggttaaattcagtagagccctagagcatgtgactaactatattatgctgcagaagccacacacacagcatcctgtaggagtacagagaaggcagaaactaactcttaaggagaggtagaaatgtcaggagagcttttcagtaggtggggatgtttaatttacattttaaagaaatcgatttcaaaattaatacccaatttcaacacaccatttatagaaaaaatttctctaaaagcattgctttcctatcattatcaatttttttttaattttcctaggccatttttgggaaaagaaagtggctattaatgacttacataactcatactgagcttaaaatatatatattgaaatcttcatttaaaagtagaatgttattctcagtgttctttccataactttctccgtctctgtggccccatctttgttttgatgagactcaaaaacattgatcctgttaacttttattttcaactttcaatggcctagtggtgcttgcataaatatacagcagtgctctctacgggacagaagctaatcaactcatgtggaacacgctttattactgggtatgaaggatggatatcttataggaaactcaatgacaattaaaaaaaaaactattcaaaagcgactgcaaagaataataccacattttaacttgaaatatttacaagactacttaaacctctttctagcaactggtaaagttcaggaccagccccagctccaatgtgaacatgagatgcaagcaaactttctgctttctctaagaaattatgttattttaaaaatgtcattttttcatttctaaccaaaatgttatattgagttttttcatttgatttacttttacaatgttcttcttcagtggaacagcaaatattctacttcccaagtagccatatttgattattattataactttaaagaaattaagttgaacagatgtttattatggtgaatattacattcactgaaatatattcatgattttgacaatttactattcaaaaaaagtagtgtttacagtaagacaaaaataccttttgaagttcacatgtatcttttaaaatagcgcaatgacatgctgcccatggatattgaaatttttgaccatgattacaaatgttgtgcatctcatcaaagaaataaaagcactgttcttctgttcaggttgttttttgcatttagttataaaagttaattctaggcaaattggtctggcaaaataaatcacgaatgtataaatgcaaaattaagagagtaaacgatgctaacacaatgtctcaatttcaaaaataacatgtttggaatttagtcttccactgaacttttccactataaaaactaatttttaattacttgaaagcaattttatataaggtcaatcaaaaagtgttaattctcaagataaaaaaaattgttcttgacagtttttttctgttagactagtaaatgtgtggttgccaagggtatatttctaaattgaaagcttcaaattcctattttttgagtgctccgcaaacctcaggtgtaacagagttgatttttaatgccaaaacatttcaaattgagtaacaataatagtgctaattatacaattccacttttacatgatattttatagtttatggattactttcacatacatatgtacgattttacctaatcactccatccacagttgttatacagattatatataatactacatgtgaaagcagtttaactgacaaccccattaaacacaggaagaagaaatggtaattgggtattctgtgatattgtttaacagccataataggcgtacccttacactagctttatctctgaatattttaggttatataaccatatatgactccattttttaattcagattgagttgaattttttttcaacttatcttaccagatgcactgttcacatcctctgtagtgtttaagccttgttctctattaaaacaatctctttcataaaactactgaagtcaaaggcaaaaactttgtgatggattcccaaaaacattctttaggtatgtcctgcttggatacacaactcaggttttcagacttgttcagctgactctattaaagactgagaagtgttgtcatcttgatcaatattgagcaatgattaggtgtaggtctatgacatcaccttactctaaaaccacagttaaactgttttgtgtttagactgtatgctttaaaaatccttatttctgagtatctaacaggattttcttaactattatatgctttttaaaaattaatgtatattagaatagatggataaaagctcttattcctctattctgtggggaattggttcttattccccatcaaattgtggaaacaagtacgtgccctgttgaatcctgtctaaataaattaatctcatagtcattgtgattatgtgtcaggaagagatggccaaatgaaagttcatcataggttaaagccctaattgagaaagcaaccagatactttattatgcatcctaagatcttctccaaggacaagtaataaactaaaaaaaaatcaatgtattaatattatcatcactatgattattttggtaagaaataaaaagtgagttcaaaaactatatcaataaaatattcaccatttctgaatttaattgaaattaatatcaacaatttttctctatttgtgttaaatttataaaagaatatggtaaattaatttcatagcattttattacatcattctcaaataattctatataagtaggtgtgttgtttttctcaatgtccaggtgaactggagagattatatagtgttttattttaaacacaacaatactaccattttatacctcatcagaaaatttttaaaaagacacccattattttctaattaatacaatttcttgaaacatttccttaatctatagacattttaatatcatattatgaatactttataaacatttgcatatttaggaggaaaaacagttttcataaatgatttctgtatttctaaatttgtagaaatttttctctacaagtttgtagaattttaggcaagaaaaaattcagaagaaataaaataattaaatgtataactctcatcaaggcatttattcattttctgtaatcaggctgaattcagatatggaaatagaatttttaatgtatttcaagcaaagtagttataaaatttgactctcttgtgaatacaacactaagactttcaaagtcttctacttgtagagccaaatagactgacaatcattctttgattacatttacttagaatatgtgatacaaaatcttgttaactttccagaagactggtaaatttccagcttcccttagaataattgtaatgatagctgaggtttcttacttgttttctgtgtgccaagtattagtccttgtacaagggctttacatgaagaatttcttcaaattctaacagtaacactatgaggaatagggttatgattcttactatattgacaaggaaattgaggcattgaaagaataagtaacttaaaaaagtatcttgtagcaatgtttaaactctgtttactgctcaaaggaagttcttattacatcagtttgtggccaacaacaaatcccttgcatataactaagaaatcataatatgcagaactataagttctcagtggctgtgcaatccacctagaccccatgatctgctcccttcaattgcaccaggcaattcagatgccacccttgtagtcaggactcctactacatcttagagtggaatgttccatggcgcaatgatcctttccacactcaaattgtccatagtttcttgatacgtatacgtgaagagggagcatgttgttgttcagcatagaaggagtctggacatggatattatatagagactgtcatgatccttaaaaatgttttggcaacgttgcctcttctcttgcctagcagataaactactggtagtttctgttactgttatcaagtcctccttcttagtttttttcccccccttcagattaattaagccttttgcatgcagtcctctgcagaaataagtattactatttcatacgttagtatatttacaagcaagtgtgtgaataatatagattatcaatgctgaagaagatcagggtaagaggagaatatggctaatacaagattattactacttaattatcagtatagaagattagaaatttgcttagaaaataattttgaatttagctgggaggaaagaaaagacattataacgacactttaaatgagaaatgaatgaataaaggtcgggttgagaataaataagtgaattggattttaagagtgagattctcaacttagcaaagcactcaaaagggcaagtaagcttgaaccaacacaacagatgggagatcagagtgtagtccaagagagtttattacaaggattagctctaaaatctaatggacaatattaaaattttaagaacagtttgcatttccatttcacagtatgtttacttttgttataaaaatacttcaaagtgtttaatccttaccttcaaatctagagtaaaattacgctttataaaattgtgtggttttttgtttgtttgatgttatgacatagaggaacacactgtgccacactgtcaataaatgagttttaaaagtgcaacttcaaggaaaatgtgttaagatcacagtgggagaaaatgagagagaatccttggtaaatcaggtgggcttaatttatagataactttgtagatcaggaagggaaagggaagctgctggaaacacacgtggcatcttaggaaatttgaacacacaatgtttcatgttcccataaaaatattggtagatgctaattgatcatgttgtctttgtatttactcctgcaaattccaaatttagtcttagttctggcagaattgtgtctgcttgataggatattttagtttataccacatttaagaatcaaatagcacacacacattcagaaaatgtgaaatattcaagagtaaaataaattgttaactgcctgaaacatgagctgtgtcctttcattgttgcagtccccacacaaggttttagatatatgtattgctcaactcaacaggtattgctcaactcaacagtggagtaacagatggcacttatattttgtgaaatgacttattttcatgtttcttggcatatgtgactcaatgcattatttaaggtggaattgtaatatttgtaccttaataataacttcttaagaatgagaagtggccaagctcctctcatactaagtgatatattgaagttagcatcttcatgaatgtcttcttaaccccttatcttgtagctactataccatttatttttgcattgccttgtattttagtgaatatatgcacatgcttaccctctcctgaccctatttgcaagttcttgtaatcttactgagttggaacgctgaccatagctcctacacccagcaggtactcaatgaacaattatgggtttcaattcgatcaacatactttaagcattcaagaacgttccatgtctgtaagcaagtgtttgaaaaatctcaatagatgcagaaaaggcctttgacaaaattcaacaacccttcatgctaaaaactctcaataaattagggattgatgggacgtatctcaaaataataagagctatctatgacaaacgcacagccaatatcatactgaatgggcaaaaactggaagcattctctttgaaaactggcagaagacagggatgccctctctcaccactcctattcaacatagtgttggaagttctggccagggcaattaggcaggagaaggaaataaaaggtattcaattaggaaaagaggaagtcaaattgtccctgtttgcagacgacatgattgtatatctagaaaaccccatcgtctcagcccaaaatctccttaagctgataagcaacttcagcaaagtctcaggatagaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaagtaaaagaggatacaaacaaatggaagaacattccatgctcatgggtaggaagaatcaatatcgtgaaaatggccatactgcccaaggtaatttacagattcaatgccatccccatcaagctaccaatgcctttcttcacagaattggaaaaaactactttcaagttcatatggaaccaaaaaagagcccgcattgccaagtcaatcctaagccaaaagaacaaagctggaggcatcacactacctgacttcaaactatactgcaaggctacagtaaccaaaacagcatggtactggtaccaaaacagagatatagatcaatggaacagaacagagccctcagaaataacgccgcatatccacaactatctgatctttgacaaacctgagaaaaacaagcaatggggaaaggattccctatttaataaatggacatgggaaaactggctagccatatgtagaaagctgaaactggatcccttccttacaccttatacaaaaatcaattcaagatggattaaagacttaaacgttagacctaaaaccacaaaaaccctagaagaaaacctaggcattaccattcaggacataggcatgggcaaggactccatgtctaaaacaccaaaagcaatggcaacaaaagacaaaattgacaaatgggatctaattaaagagcttctgcacagcaaaagaaactaccatcagagtgaacaggcaacctacaaaatgggagaaaattttcgcaacctactcatctgacaaagggctaatatctagaatctacaatgaactcaaacaaatttacaagaaaaaaacaaccccatcaaaaagtgggcgaaggacatgaacagacacttctcaaaagaagacatttatgcagccaaaaaacacatgaaaaaatgcccatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactaccgcaagaacaaaaacccaaacaccgcatattctcactcataggtgggaattgaacagtgagatcacatggacacaggaaggggaatatcacactctggggactgttgtggggtgggtggagtggggagggattgcattgggagatatacctaatgctagatgacgagttagtgggtgcagtgcaccagcatggcacatgtatacatatgtaactaacctgcacaatgtgcacatgtaccctaaaatgtaaagtataataaaaaaaaaagtatgaaatacctagctgtttttgtgtggtcctgactactttaaaagctgtgtgccttgatactctagtcactactcaaatgtatgtacacatagtattttgcagatgatttcagaagatgaacaaaatccctgaaagtcatcagtcaacccaggttcagaactttttactattattattatactttaagttctgggatacatgtgcagaatgcgcaggtttgttacttaggtatacatgtgccatggtggtttgctccacccatcaacccgtcatctacattacattaggtatttctcctaatgctatccctcccttagccccccacccccacataggcccaggtgtgtgatgttcccctccctgtgtccatgtgttctcatttttcacctcccatttatgagtgagaacatgcggtgtttggtgtatgttcctgtgttaatttgctgagaatgatggtttccatcttcatccatgtccctgcaaaggacatgaacccatccttgggttggttccaagtctttcctattgtgaatagtgctgcaataaacatatgtgtgcatgtgtctttatagtaaaataatttttaatcctttgggtatatacccagtcataggattgctgggtcaaatggtatttctggttctagatccctgaagaattgccacactgtcttccgcaacggttgaactgatttacactcccaccaacagtgtaaaagcattccaatttctccacatcctctccagcatctgttgtttcctgactttttaatgattgccattctaactggtgtgagatggtatctcattgtgttttttttttttttttttttttgagatggggtcttgctttgttgcccaggttggagtacagtgacgcgatctcgactcactgcaacctccgcctcccaggttcacgccattcttctgcctcagcctcccaaataggtgagactacaggtgcctaccatcacacctggctaattttttgtatttttagtagagacagggtttcaccatgttagccaggatgatctctatctcctgacctcgtgatccgcctgcctccgcctgcctccacctgcctatgcctcccaaagtgctgggattacaggcgtgagccaccgcaccctgcccttattgtggttttgatttgcatttctctaatgactggtgatgattagctttgtttcatatgtttattggccacataaatgtcttcttttgagaaatgtctgtttgtatccttcgcccacattttgatgggattttttttcttgtaaatttgtttatgttctttgtagattatggatattagccctttgtcagatggatagatagcaaaaattttctcccattctgtaggttgtctgttcactctgatgatagtttcttttgctgtgcagaagctctttagtttaattagatcccatttgacaatttttccttttgttaccattgcttttggtgttttaggtatgaagtctttgcccatgcgtatgtcctgaatgatattgcctaggttttcatccttataccaaaacctagcagagacccaacaaagaaaatttcaggccgatattcctgatgaacatcgacgcaaatatcctcaataaaatcactagcaaactgaatctagcagcacattgaaaagcttatccaccaccaccttatcaagtcgacttcacccctgggttacaagactggttcaacatatacaaatcaataaacataatctatcataaacataaacagaaccaatgacagaaaccgcctgattttctcaatagatgtagaaaaagcctttgataaaattcagcaccccttcatgctaaaaactctaaataaagtaggtattgatgggacatatctcaaaataataagagctatttatgacaaactcacagccaatattatactgaatgggcaaaagctggaggcattccctttgaaagccggcacaagacaaggatgctgtctctcaccactcctattcagcactgtattggaagttttggcaagggcaatcaggcaagagaaagaaataaagggcattgaaataggaagagaggaagtcaaattgtgtctgtttgcagatcacatgattgtatctttagaaaaccccgtcgtctcagccccaaatctccttaagctgataagcaacttcagcaaagtctcacgatacaaaatcaatgtgcaaaaatcaaaagaattcctatacaccaataatagacaaacagggagcctaatcattagtgaactcccattcacaactgctacaaagagaataaaatacctaggaatccaacttacaagggatgtgaaggacctcttcaaggagaactacaaaccgctgctcaaggaaattggaggacacaaacaaatggaaaaacattccatgcccatggataggaagaatcaatatcgcaaaaatggccacaccccccaaagtaatttatagattcaatgctattcccatcaagctaccatgtactttcttcacagaattagaaaaaaactactttaaatttcatatggaaccaagaaagagcccatatagccaagacaatcctaagcaaaaagaacaaagctggaggcattaagctacctgacttcaaactatactacaaagctgcattaatggaaacagcatggtactggtaccaaaacagacatatagaccaatggaacagaacagagacctcagaaataacactacacatctacaaccatctgatctttgacaaacctgaccaaaaccagaaatggagaaaggattccctatttagtaaatgatgttgggaaagtggctagccatatgcagaaaactgaaactggaccccttccttacacgttatacaaaaattaactgaagatggattagagatttaaacgtaagaactttcattcagtttacctcagaatgccaaaaaagttaagagaatcgatacgctatttgctagacaaattcttatttagataacttcttagaaacatttagatgtaaccaaatgagttttctgattcggtgattattggcaagtatgttcggatatgaattttaaatgtatggaatgatagtttttcatttgcttctgaaactacatgttttttttttgttttttatttatttatttattattattattatactttaagttttagggtacatgtgcacctgcacgttttggctttaagaggatgatcttcttaaccagggaagaaatacagaagaaaaatgagtagagtgaagaatgtatgtaaatgcactttagaaagaggagagaatgtgttatatttaaccaaaaacagtatttttaaattatcatttaagagacagtgatcatgaaattaggacctgttcaactcttaacataaatgttatatattttccatattaaaaatctttatttaaaatattttttaaaacattacttataaggtataatattaaacttatatttttagcagtgagaatgtatttgaggttttgtcttcaagctttagttgcaaagagaaaagtagtttttacccagaaaaaaaaaaatggccaaggaatgattcaacatcctatagtggcacgaagccaactcttctaatcaataagttgtcattgccagtaagctgaagaagaaaagaacagaaatggtttacaattggatatttccaattatttcaaagaagaaaaatatgttaccagatatgagtcaagatgacataaagtacatgatttgtctctattaactttgaccagaaccagaaaaaaatatatcagacatgtgctatacatataattaagccattaatacacaacttaaaatctctcgtgacctcattctataaggcttaaattcctgaaaaatttctccttataccattgccaaaacatgtagctaaccagaccatatacggatctgattccaatcactgtttatctcattttaatgtggtttctttaattataatgccattataatttcaggtcaattaagaatggtgtgtaaatcatacagcatttactaaaatcctaacatgacttgattaaactttctttgtgttcttggcacccctcacattcatgatcaaaagaatacaaaatctcccatggctttgcttcgttctattttcaggtgatctcttccagtttgtacactttttctgtatcttcctcatatagaaagtttttacgattttccgtgatgttacctatttttagtttcttaacttcaacatcttcctctctgaattcctccattaatgaatactgtctattcctcaagtttaattgcctcttattatcatgaataagtttccttgttaataacatataggctgtggagggcatttcaaaaaattgaagttaaaaactgtcttgggcaataaaagccagtagctcttagaggtgaacacgctcaaagacaggacttatttcggtatataaatttttgtatacctatagaaacatctcattaatttattgtgtagctcataaacacattatttttatgtcattcccttttgtaatgagaaatgatgaaaaatagattttagatttctgttttgttcagcaatacttgttcagtactgaccccatacaagtcacagtgataggccttctagaagttgatgcaactttttacattattgcagcagataacaactttattatatatgcagagtgtgctaaagatgcctgtaaggaaacacatatgataaccatcactaggaaatgtacctattaaaatttttactccatcacctcttggccagattaaatttctcctcactagagatagtaaaaaacttagttgtatcgtgtgtatattttcattgttcaattctgaaaaaatctattttatatacggggaatgctttttattaagggggctcaatttcagatttcatcagcacagctctttcaacagtctgtgttagctgactttctgaaaaaacgtttccaataagagcctctcaaaatctagtagcttaatattttatttctaaaccttttattaaaattatattgtaaaaatctaacatctccccaaaaccgtgctcattaactctgggaatctctactgttctaagaaacaaacaaaaaaaaattataagaaatagtcctatgttactttgaagaatcagtagttgcatatcaaactgattttattttaaagctgttgtagcaatattagatataaaaacaatacaaattatgattatgaaacaatttgtagacttcccattttgtaccagacaatgtactcaaaaattcatacatattttctcaatattcagaacagccacagtgaagtagttactattatcctgattttacagattagagagattaagtaacttctctaatgtaagacagataatgaacaacagaactggggtttaaacttgaggaaaataagttttaagaaatcagaaattaagtctttggagataatttttcatgttataatggaaattataaatggaataaactgcaataaactatcatggaataaactgacaaaatattgcataccttactgtagatgtaatgggcaattgaataattatcacttagcttcctttgcttccatcagctgtataggattccttccaggtttgatataattcttaaaacattgcttcctgttattgtattttagaatatgttctttcactgtttgaaatactacatcattttaagtttttctctcttaaatcttgtcttccacccatgaagttatctccttaaccaaaatagaacatgattccttgattgagatgagaaaattttttatttcatttttgtttagattcatgggatatatgcgcaggtttgttacatggttatattgcgtgatgctgaggtttatggtacaattgatcccatcatccaggtagtgggcatactacccaatagctagtttttcaactctttctctatctccctgcttctctcctttagtaatctgaagtgtcttttgttgccatctttatgtccttgagtacccagtgtttagctcccacttataagtaagaaaatgcagtttttggttttctgttgctgtgttaattcacttaagataatggcctccagctggatctgtgtttctgcaaaactgaataatttgaaagacatgatttcattattttctatggctgcatagtattctatggtgtacatgtgccacattttcttttttaaaatttttattttaggttcaggggtacatgtgcaggtttgttgtagaagtaaattgtgtttcataggagtttggtttacagattattcctccacccaggtaataagcatagtaataggtaatttttgatcctcacccttctctctccttccacctcaagtagaccttagtgtcttttgctcccttctttgtgtccagatgtactcaatgtttagctcctacttgtaagaccatgctgtatttggttttctgttccagcattagttggcttaggataatggcctccagctccatccacattgctacaaaagacatagtaacatacttttttattgcagcttagtgttctatagcgtgtgtgtatcacattttctttacccagtctaccattcatgggaatttaggttgactccgtgtctttaatattgtgaatattgctatgatgaatatacacatgcatgtgtttttatggtagaatgatttagattccctggagtatatacccaataatgggatttctaggtcacatggtaattctgctttgagttctctgagaaattgtcaaacaagttttcacaatgctgaactaagttacattcccactagcaacatataagccatccctttttctgcaacctcgccagcatgttatttttttgacattttattaattgccattttgactgttgtcttattctgcttttgatttgcatttctctaatgactagtaatattgaacagtttaatatcctttttggccacatatatgtcttcttttgaaaagtgtctgtttatgacctttgcccaccttttaatggggttgttactgcttattactttttcagtttcttatagattattagaccttagtcagatgcatagtttgcaaatattttctcccattctctgtgttgtttactttgttgatagtttttttttttcctgtgtagaagcttaagtttaagtagatctcatttataaatttttgcttttgttgcaattgattttgggggtcttagtcatgaactctttctccattcttatgttcagcatggtatttcctaggttatcttccagggttttaataattttaggttttgcatttaaatctttgacccatcttgagttgcttcttgtatattttataagaaaggggtccagttttgaccttctgcatatggctagcaggttattccaacatcatttattgaatagggagactttccccgtcacttatttttgtctactgtgtcaaagagcagatggttgcaggtgcatggcattatttttggtctctctattttcttctattcatctatgtgtgtgtatttataacagtagcatgctgttttgaagttgggtcacgtgatgcctccaggtttgtcctctttacttaggattgccttggctattcaagctctttttaggttttataagaatttttaaatagtgtttttgaattctgagaagaatgtaattgaaagtttgatacagacagcagtgaatctgtagattgctttgggcagtttggcatttttaacaatcttgattattcctataagagtggaatatttttctatttgtcttttctgatttcttagagcagtgttttgtagttgcattttagagatctttcacctccctggttagctgtattcctaggtattttattccttttgtggtcatagtaaatggatttttgctcttgttttggctctcagattggatcttgttgatgtataggaatgttactgatttttgaacatttaatttgtatcctgaaactttgctaacattgtttgtcaaaggcttttggtggggtctttagggctttataggtatagaatcattttatcagtgaagatagctagttttgacaacttttcctgtcaggatgcgttttttatttttttctcttgcctgtttgctttggccaggatctccaatactatgtttaataggaatggtgaaaatggtcactctttcctcgttccagttctcaaggggcatgctttcaatgtttgcctattcagtatgatgttgactgtgggtttgtcagagatgacttattattttgaagtatgtttcttcaatgcctaatttcttgagagtttttaataggaagggatgttgaaatttatcaaaagccttttctgtatctattgagatcaaatggtttttgtttttagttccttttttgagatgaataatttattgatttgcatatgttgaacccaccttacttgactgtggtgggctaggtttttgatgtgctgctggatatggatatggtttgctagtattttgttgagaatttttgaatctatgattattgaggatattggcctgaagaggggtgtgtgtgtgtgtgtgtgtgtgtgtgtgtgtgtgtgtctgtctgtctgtctgtctgtctgcaaggttttggtattaagatgatgctggcctcatggaatgaggtaggagggagtccctacaactcaaccttttggagtagtttcattggaatggtagcagctcagcagctcctctttatacatctggcagaattaagctgtgaatctgcctggtcctgggcattctctggttggtaggcttttcttactgtttcaaatgcagaactctttattgttctgttcagggattcactgtcttcctgattcagtcttgggtggttgtatgtttccaggaacttatctgtttcttttaggttttgtagcttgtgtgcatgcaggtgttcatagtagtctctgagagttttttgtatttctgtgaagtcagtggtaacatcccctttgggatatctgatagtgtttatttggatcttccctcttttatttttttgcctgtattagtctactagcagtctatctatcttattaatttttttttttttcgacacagtctcactctgtcgcccaggctggagtgcagtggcgcaatctcggctcactgcaacctcttcctcccaggttcacgccattctcctgcctcagcctcccgagtagctggggctacaggcacctgccaccacgcccaactaatgttttgtatttttagtagagacggggtttcaccgtgttagccaggatggtctccatctcctgacctcgtgatccacctgcctcggcctcccaaagtgctgggattacaggcgtgagccactgtgcccggctctatcttcttaattttttaaaataatcagcttctgggtttattaatcttctgtatggtttttcacatctcagtgtccttcatttcagctctgattttatttcttgtcttccgctagatttgggggtgatttgctgttgtacttctagttcctctagttgataatttgagatcttgctaaatttttcagggatgtgtttcatttttataagcttccctcttaacactgctttgtatgtgtcccagagattattgtatgctatattttgtttttcattactttcaaaaaattccttgatttctgtcttaatttcatcatttgcccagaagtcgctcaggagcagctgcttaattttcatgtaatttgattgtttgcatgattctcttagtattgatttctatttttatttagctgtggtataagagtgtggttgatttcaatttataaaaaaataatttaggattgtttatgaattatttttggtccattttggagtgtgtggcatgtgcacatgagaagaatacataatctattgtttttgtatggagagttctgtagatgcctattagttccattaactcaagtgttgagttcagctcctgaatatctttgttagttttctgcctcgatgatctgtctaatacagtcagtggtgtgttgtagtcttccattattattatgtggttatctgcatctctccataggtctctaagagcttgcttttgaatctgggtgctcctgtgctgggtacatagatatttaggatagataggtctttttgttgaattgaaccatttactgtaaggtaatgtccttctttgtctttttttttttttttaatcttcgtaggcttacagccttttttgtctgaaattagaatagcaatcattgcttttttttctgttttccattttcttggtagattttcctccatccctttactgtgaaagtatgggtgtcactgcatgtgagatgggtcttttgagacagcatactatttggttttccttgtttatccaactttccattctgtgccttttattggggcattttgcctgtttacattcatgattagtattgatatgtgtggatttaatcctgtcatcgtgtttgttagctgggttattttgcaaacttgtttatgtggttgctttatagtgtcactggtctgtatacttaagtgtgcttttgttgtggctgtaatggtctttcctttccatatttagcactccttcaggatgttttgtaaggcagatcttttggtaacaaatttccttagcatttacttatctgtaaagaatcttatttttcctttgtttatgatgcttagtttggctggatatgaacttcttggttggaaattattttctttaaccatgctgaatataggctccctatgttttctggcttgtatggtttctgtggaaaggcccactgttagcctggtgggactccctttgtagatgacctatcctttcttgctagctccacttacctttttttctttcattgaactttggagaatctgatgactatgtgtctttgagatggctgtcctgtataatatcttgcaggggttctctgcatttcctgaatttgaatgttagcctctattgcaaggttaaggaaattttaatggaggatatcctcaaatatgtttttcaagttacttgctttctctgtctctttttaagggatgccagtgaatcatagatttgctttctatacataatcccatatttcatggaggtattgttcattcttcttcattcttttttctttatttttgtctgactacattctgttagagttggtttttgagctgagagattctgccctcagtttgatcagttctgctgttaacacttgtgattgtattatgatatatttgaagtgagtttttcagctctagcagatcagtttgattcttaaaatggcatttttgtcttttgtcttctgtatcattttattgtattccttagagtttttggattgggttttgactttctcctgaatctcagtgatctttattcctatccatattctgaattgtttttctgtcatttcagccatttcagcctgattaagaatcattttctggggaactagcatgatcatttggatataaggagaactctgccttagtgagttgccagatatgttgtgctggttgtttcttatctatgtgagctaatgttctttcaatcgctgaagctgttatcctttagatctttttttttttttgtatttatcttccttgtgttctttaaatcatagacattgttaccctttggatctttttttaaaaaaattatcttctttggtgtctttggggctttgagtgtggtattagatggattcactcaactgtcttcatttctggtagattttatggggtctcagactcggctcaggactcctgggctgcatgttgtaaccctgagagcagttatgaggtcactgacttagttatctgatccattgaggttaggaacttgcagttctaaggtatttttggaccaccgatcacaacactctgttgaatgtgccagccaaagtgcttcatcaggcagtttcagtgggatctgtcctcattcccacatgccagcagcaatgctagagggtggagtgcatgtgcattagctggggtggggcactggcaggtgtggggtgttggcttctatacagatgtttgtagcagtgatggtggcaatgcaatgtgggtggggggcagggccactggcatctgtgcactcaatcacactgctagcagtgttggcatggggacatggtacttgcaggtacagagctggcagtatttgtgtgcacgttcacttcagtagcaatggcagtgcagggttggggacaggtctgctggaatctctgggcacatttgcaccagcaatggtggcacagtcagggagtggcagggtgtgctccagccggcactcatagcgtggtggagtgcatacacacatgtacatccattggggaggggaggtgatgtccacctgtatgcatgtgtgctggcaaagtgataggggggtagccataggcaagtgtatgctggcaaagttgcacagggaaggatatggtggggggtaagtgcgagtgacctggtgcacttcacaaatggctgctctgctggagctgtccgatggtcaggtgcagtctgccagcatatgagctatgatacgggcccccagaaggcactctggctgggcatctgaggctgcactgtaagcaggcacagccagactgaaactccaggtgaggccagcagacagggggctgctctggtagaactggtcctatctcggggcaggatcaatctgctcttttcaggtccactagctctcctagggctcaagtctcctagggaaacccagcaaggcttggaggatggacatccctggctgagcttcactgcagacactcctgtgccaaatcctctgggtgctacactggctgggtttttttcccctactacatctctaagcagctctccctgacaactcaagtgtctctggaggtcgtgtggtcttctgctgccaggattccaggggtcagttgtgagggcaggctgctcctcacctgctcaattcactccatccctaggagtctttgggtgccaggaatgagtcccagggcaccctagcttcatgcaggattccccatgtcctccctcttctgcctgacatctgtgtcctgggcccttggtggcagatatccctcctggctacatctagtcagccatcttgacactgtatcacatttcttaatgcaatccaccatcgatgtgcagttaagttgattccacgcctttgctattctgtgtactactgtgatgaacataggagtgcaggcgtaatttttgtaaaatgatctattttcctttggatatgtatccagtaatgggactgataggtggaatggtagttctggtttaagttatttgagaaatctccaaactgtttttcacgttggctgagcaaatttacatacctgccaatagtgtataagtgttccctttacactgcagccttgccagcaaactttaagaagccaaaaaacgttaagaaatcacttttttgaatctgtaataactgccattctgacttgtgtgagatggtgtttcactgtggttttgattagcatttctatgatgatgaatgatgtgaagcattttttcaggcttcttggccacttgtatgtcttcttttgagaagtgtctgttcatgtcctttgcccactttgtaatgggcttatttgttttttgcttgttaatctgttttaagtacttaaaaattttagatattagatcttcatcaggtgcatttttttgtgagtattttctcccgttctgcaggttgtttactctgctggtttattttgctgtgaagaatcgctttagtttaattaggtcccacttgtcaatttttgtgtgtgttggaataggattttttaaagttaaaacgaatgacttttattataatttattattttgtcattaatttgtgaaattataaattgtaccacaataaaataaaatcatttaaaaatatagcctctgcctgtttatctttttttaaaaaatatttactgaatttttattttacgttcaaggatacctgtgcatgtttgttacataggaaaacttgtgtcatggaggtttgttgtacaaatgattttgtcactcatgtattaagcttagtacacattagttatttttcctgatcctttccctcctcctaccctaccccgtctgataggccctagtatatgtttttccctcaatgtgtccatgtgttctcatcatttggatcccacttacaagttagaagatgcggcatttggttttctgttcttgcattggtttgcttaggataagcaatccatgttcctgcccaatccatgttcctgcaaaagaaatgatctcattcttttctatggtagaattgcatttaaggacatagtgataaattgttcctcaagtctactgtccagaacagtgttttcttctaggattcttgtaatttggtgttttgcattaaaatttttatctatcttgaattaatttttataaatggtgaaagatcaagggtccaggtcattcttctgcgtacagttagacagctatcccagcatcattttttgaacaggaggtcctttttctactgcttgtttttgttgactttgttgaagattagatggctatgggtatttggtgttatttctgggctctctattctgttccattgatttgtgtgtctgtttttacatcagtaccatggagctgttttgagtactgtacctttatagtttgaagtcaggtattgtggtgcctccagttttgttctttttgcttgtgattgctttggctatttgagctcttctttggttctatatgaattttaaaataatttgttctagctctgtgaagaatgatgtttgtacgttcgtaggaatagcattgaatttgcagcttgctctgggcagtatggccattttaatgatactgatttttccgattaatgagcatggaatgtttttccatttgtttgtgtcatctatgatttctcttagcagcatttggtagttctctttgtagagatcttttatctccttggttagagatattcctaggtattttatttttcatgtagctactgtagatgagattatgttcttgttatggtcttagcttgactgttattagtatatagaaatgttactgatttttgtacattaattttgtacctgaatcttcactaaggtcatttatcagttcctgaagccttggggtttctatgtatagaatcatattattggcaaagagaggtaatgtcacttcacctttttctatttcagtgccttttatttcttccttctgcttgattactctggctagcacttccagtattatgttaaataggagtggtgagaatggcgcatccttattttatctcagttctcaaggggaatgcttctagtttttggctgttcagtatggtgttagctgtaggtttgtcataaatggcttttattatcttgatgtatgttcattcaatgccttgtttctgagagtttttatcatgaagcaaggccggattttatcaaatgctcttccttgtcttttgagatcatcatgtcgtttttgtttttaattctgttcatgtggtgaacatttactgatttgtgtaagctgaacccaccttgcatcctaggaatgaagtctacttgatcatgaagaattaactttttgataagctgtaggatttggtttgctagtgttttgttgaggatttttgcatatatgtttatcagggatattggcatgtaattttctttttttgttgtgtttttgtcaggctttggtaacttgggttgatgctgcctttgtagaatgagttagggagaagcccctcctcttgaattttttggaaaaaattgggtagaattggtaccagctcttctttgtatatcttgtggaatttggctgtgaatccatctgctctgggcttattttggttggtgggtttgctattactaattccatgtcagaaattgatattagtctgttgagggtttccatttctctctgattcaattttgagatattatgtgttttccaggaatttatgcattccctctaggttttctagttcttgttattctagttcctctatctggtatgttacattgtttctgtttttttctaactttttatgatagatatttagtgtaataaactttgtttttaacgctgctgtttttgcatcccagagattttggtatgttgtgtcagtgttttcatttatttcatagaagttttatatttctgctttaatttcattgtttacttaaaagtcattcaggagaaaattgtctaatacttggttttgagaggacttcttggtattgatttctatttttattctgttctctgagaatatggttgctataatttcatttagttaacttactgagacttgcattatgacccagcatgtagttgatgttgaagtatgtttcatgtgtagatgtgaagaatttatactctgcgattcatatgtggaatattctgtagatgtcaattaggtccatttgttcaactgttaggtctgggatttctttgttagttttgggccttgatgatctgtctgatgctgtcagtagagtgttaaattcctccactattatcatgtagctgcctaagtctatcagaggtctaaaagtacttcttttatgactaaaagtgctctaatgtttgatgaatagttgagtcttcttgttaaattgaactttttatcattatgtaatgcatttctttgtccctttttttactgctgttggtttaaagtatgtttttatgtaaaaataatgtttcttttttattttctaattgtttaaccgatcttccttaagtcttttacactgaacctgtgggtgttgtttcatgtgggatggttcttttgaagacagctggcagatgggttgtctttttttattttattcaaattgccactctgttccttttaagtacagcatttagaccttctgtcttcaagattaatattgatatgtgaagttttgatactgtcatgaagttgttaactgatagttttgaaggttttattgtgtggttgctttatagtttctgtgggttatgtacttaagtgtgcttctgcagtagcaagtatgttttgttttgtttttctcatttccgtgttattactaccgtaagagcctcttacaaggctggcctagtgctaatgaattcccttagggcttgctcgtctgcaaaagattttattatgtttcatgtatgaagttcagtttggtgagatatgaaattcttagttacaatttttattctttaagaatgctgaaaataggcctccagtctctcctggcttgtaatgtttctgctgagaagtctgcagttaatctgatgaggtcctctttgtatgtaatctaacatgtttctctagctgcctttaatttttttccttagcattgactttggacagtgtgattactatatagcttggagatgttcattttctgtagtatcttgcagttgttctctggatttcttgtatgtggatgtctacctttccaagactattagcaacattttcttgaattactctcttaaatatgttttccagataatttacattttctccttttctttcaggaatgcaaataattcataagtttggttgctttatgtgattccatatttcttgacaactttttttaactcttttttaaatttatgtttttgtctcactggcttatttgaaaagatcggtttaagctgtgaaattctttcttgtgcttggtgcagtctattgataaatatttcaattctattttgaaattccttaagtaagtttcaattcaagaagctctgatatttttttaaagatgtttatctcttccttctattcctgtattgctttagtagtttctctgtgttgattttcaaccttctctttggatatctttggactttcttgcaatccatgctttgaaattcttacctgtccttggcatgtgaatgcccccaaagcattcatattttttatggtgccagaattctggagctgattccttctcatctggagatactgggatttctaatatttgtaatttgtgcattagggttttctcttcgttttcccacaatattattgttttgtttttaattttccttttcttgttctccacccagggtgtatgactgtagagaatattgagtagaattttttgtctgttcttctatagacctatatttttctgtcaacacgttttaaattgggctgttcagtttgacctacaggcctgtagtttgtgctatgggtaagagacagttacagctaacatactgggtagctacttgatcctggtttattaggagattgtctctgctgcctcagggaatgagctgatttgtggagtacacagttttctgaactgcctgattaactctggagggtagggggaaagatgtgcttgtccaaaccaggaaggctcacctacatgtcccctaatggcaggcaagggactgccattaatagtgccgtttgcaagggagaaaccactgggtggccaccaagtgcccagaggtgtgcctcagcatggagctgtgaaaccttctcagttccatgttctatgtacaaggttggagtcgggggttggaaggaaacctaaactcctaatctaggaaagtgactgttcaagaggcctggaggtctgcctgtgcattgactgtagaggccttgctgtgccacagtctgcacagggatgacagggtgactcagcctgcttatccaggcagataggttctgtgaatgcctggagacctacctggacatgccatgcagaggggtcccctgcaccgggatctcttcacaaaagagatggggtgactcaggaagctgttccaggtgagtaggtactccaaatgcttggaaatatgcctgaatgtggagtggagagggctctaatgcaacaccatctatgcacaggaaaggtggcatggctcaggctgccaatcctggtgagccggtgttttgaacacctggagacctgcctaggcatggagtggagagggtcctgctgcaccacagtctgtgttcaggaagggtgtggaggctcaagctggtgatccaggtgaatggatattccaaatgtctgaagatctgcctgggcatagagcaaatagtgcccccctgcaccatgatctgtgtccagaaaggacggggtggttcaggctgttgacccaggtgagcagctgctgaaaatgcatggagatcttcctgagcatggagtagagagggccctgctgcaccacgatctcaagggagtcagttggaacacccagcaatgatacccagatgagttccagttcaccgagctggccctggctgcaggtcttgttaccctggagaaaccacagctgtagtagctcttctcccaccctaggcctgtgatgagggacagcataattccagtgccttttcataattctgactggaggtccttaccctactttagagcaggtgacccaagctctggcccaggactaaaatgcctgtgcagccacactgctgggtcactaaagaattactgactttgtatgtgcccagattaaaaatggcatcctgctcttggtcctgagtttgggaaaatgcccacagtttttgctggtgtcttttcctgacagtgtctactgttttggacaagggagaacactatgttgctcctagatcctctccgtaaattagctctctaagttagccccagggcataggagaaacaaagtgccctcccttttcctgggtttcttggattccattggaaaggtgaatcacagagggtggctgtatgtttctctcatgtgctggggtttcacttacttttatgagctacgtcccgttacagtgctctcttccctgagatctgagttgtccttcacttttctggtggatttctgttttccttcttgaattaaagctcacagaattgatctttacgaactcttgctctttccaagtggctgagacatcttaaaattctctaatctaccatcttgggtttttaaaaatgagatgaaaaactatgagtaaactcttagtggggtctttaaagtcttttttgtttgtttgttttataaaaatgtaatgacagcacatgtcagaaaatactcaagtacaaaatgcccaaatcttctactttttataccaaaaggctggtggttttcagtcaatatagttacagtatactgaataaaaataatttataaaattaaatatgaataataatgtgttttacaatatggtagatacatttatttggaaaaagttacttgataagttgattaaaggaaagtcatttaccaaatgtgtaccctagcttgcaaaatgtgtttcctagattactacttacagagaaaaccttaatgtcaactcagtcagttaacaaaaacataatgtgatatttaggaatagtgcaagttgtcttttaaaaaattagatttttaaaccattttactcttcaaaattactttctgaactctaactttatactgaacatgtcaatcccctcaattctattagttcacctaaagccatgagtctacaatacggtataatttttgagatagaaaaaaaaaaactcagtaaagtatgatattacatttaattttatttttataatcttataaataccttcaaatataattcttacatctttgcaaagtaaaattctttacataagccccttaatcgttagctaatatggcagaaactcttaatatggaaggaatagaatattttaaagatataataaaaataaatgtatatactaaatgtgtttgagtctatgtttatagatagaagtacatcttacagaatatggtaaaatgatttatgaattttactttttaaataactattttatatgtatatacatataaaatatatacacatatatattatacatatatatgagaaaaaccaccaacattacatttttataaaatattcagtgcttcatgatggaacatataacaggattagaaaaatagcaagttcaaaggctgaaaacaaaacatggcctcatctatttgagaaaccataggtaactgtttattgaggaattaaagtctgagagaaaacaggaaatggaatatataaatttcgacaaagagagtctttctcagaagaaaattgtgctttggtttaaaggtttgaaagaataagtgcagtattttggtcaggcctgtaacatgatcagaaacattactttcatggaattgtggagtatagactggaaggatctgggcaaaaattaggaaaacatagttaactagagcagtgctaatgggtatagagaagatagaacttggaacttctggaggttgggttaaatttaccaatgtctgtggaacatccgggtgtttcacctaggcaattacataaaaaagcccgaaggtcagaggagagatctgagctatttttacagaaaaccgaaacaatcaacctatgtctataaacctttgtttatatagagaaaaaaattagaaatattgtttgtcatcatgaaggcaaactaacttgttaattgaactattttcagctagttgttttggcagctgtagacacagccttgcaatcactactcattagggtattggaactatagctccccaccctccaggggaagtagtgtgctttcataaaccatggtgaccaaggaatgaacactttcaatatgatataattaaacattacgggaaagaatgaattagggttctttgtgacatttggctaaacatgctagcaagcaaaaatacacaaatgaaggtcacatttgcaattattatacaagtgtctacattttaattaggtagctgataaatgtcattgagccttagccactgaccaactgtcattttctaaaaggagaggaaaaatgtcacctaaaaagccagaattttttgcattgtcatgaaattaaaaattgtaaccacagtacagtgtgttcagcactaagctgttaaatgggcttagggacaatctcaaaatgtagtaaagaaatatttggacagcatgtgaggtgtcactagtaatacacattttcaagcattgtttctttaaagcattgtgtctttattgtaaaaccacatagagccacattagccttgaacgtctcttctcagagagtacaagtgaacttttttttctttgcctgcagatttgacttaaattcattccttattaatttggactaaatattcactgactttctccctccaatgacaaactaatcttcttaagctcacacagtattgtacctgacctaagaataaaataaattggtatctcatctcttagatattctttattttttggaattttacatagtatttacttgaaaattatttgtccttatcccctaaaaaaataaatgaagtgtgtcagctaatatgaatcccccactaaatttacttataaaagtgccatggaagaaagtaaatatataaatactatgtatgtgagtgagtgtgtgtgtgtattgtctttagagttattctgactgatatttctgaatccattttttttaacttttaataagaaaattcaaaagacaaaataggtcgtgtgcagtggctcatggctgtaatcctagcaccctgggaggctgaggtgggcagatcatgaggtcaggagttcaagaccagcttggccaacatggtgaaaccctgtctctgctaaaaatacgaaaattagtcaggtgtggtggcgcgcacctctaatcccagctacttgggaggctgaggcaggagaatcccttgaacctgggaggcagaggtggcagtgagccaagattgtgctactgcattccagcctgggcgacagagcaagactcttcccccaccccctgcaaaaaaaaaaaaaaatagatacattagatacataaatacataaataaatcaatcataaaatgatcaattagttcttgcaagataacaatgtaaaccttttcttcagagtatgctattatcaaattggaagcaaaacactacggtaaatgaaatccttaatcatcagtgtataaagtgcttttaagaatcaaggaaaacaaatcagaactcaataggataaaagaaaatatttgatatataatttaatgatgaaatatgtatacatggaaaaatatgtgtctaataaagtgcaaatctaatgaaatatgatttccactataatatttgtagaaagtaaaaaaaagataatagatcttagccatcatctaataaaatggtatgcaaaataacataaagaaaatattgctcttttatgatgctaacaggagtctaaatattaagtcaaaaattctagaaaacagttttagcagtagctattttcacttcagaaattctgcttctctgatattcctaggaaattacagtaatagtcacaaagatttatgtacaggggtattcctgtttggttatatatgacagataaattcatctatagggatagggttgaagaagttttaacaaaacacataattgaaatatataattaattaaatgcttctgaaggacatttgtaacagagttacataattataatttatatatatgtgtgtgtgttttaagatggagcctcactctgttgcccaggcaggagtgcagtgacctgatcttggttcactgcaaccaccacctcccagttgaagtaattctcctgtctcagcctcctaaatagctggtattacaggcatgcactaccatgcccagccacaatataatattaaataaaaattagaaaattacgtgtacaaactgattccagttttcttcaaacaaaacaaaaagtctgcctgtgtctctgttggcatatctctccataaatcaaatgaagataaatccaagtttgtttttgcagagtattctgtttctggatatcaagatcagagatgattttgttctgtagtgcgcatatatttgtttataatgagaatatttaaaactagaattcagaggactcttcaggtaccaccgttttggatctgaaccctgtaacttattccctaagggaaagaattaggcgtagggaccttctgtgaccctgaaggcaacaccaagagaaatacatgttagctgattctcataccgatttggaagggtactatactgctttgaattgaattcatttgtaaaacttttgacttgagaagtagtagaatttgtgatgcatacataacttagccaagaaacagcagttccacagctggaagttgctttctgacattaaggttttgttgaatattgtgcaaatactatggatgaggcaaatgtgtggacactgatgatgagagtgacatattaaatcaggctgcaatattttagcccacttgatgtctttgtttcaatttaagtaactggacttaaatgtgctgtcagttgaggctacaaaaatcacaaccacagcagatgagtgaatttaaatggacttttacaggtatttaatctgttaaatgaaaactcacctaacttagctaaaaatgtcattgggaaattttcttttgatatcttttctttgaagaaattgctgttagttgcacagtttcccatttactcctgcatgtgcctcagtaacctgtaattcctagggtcaaagctgtaggtctgcttttgaagaaaaattgccatagaaaaaaatcactcggggacttcaataactaactcaccttgcagggattcctaggcaactttttcacgtgctgggtagcaaaataaaaaccataaacatatttccaatatccatattcccatttgtgagaaatcgccaaagctcgattcaaatttcacctctactgccaagcactttttcttggtatcagctgcttcttactagatgctccaacatgagttagcttgaacagtaatcctattatgcacctattcctctctcccttttaagattgtgccttgtgacttgagcatcacagtgagcctgtgatcactggaaagacagtaacggacagctaaagattataagcatagggttttctttaatggtaaaatataaagaagtttatttgctcagagcagctacacaagcaggagccagtgtacccacacaagtaggaagacacaacttcctttgtccctaccatcttgtttacagacacacatctgcccaagatagtacccatgtggagtgaggactcccccaggcccgggaaaaatttttgtttactctatgggggagaatgatgtcagaccctcttaatgctatatgcttctattaagtgtaaaaataaattcacttatagccccaatttgaaaacaactaagccttttcgctaaaacaaattgtgagtatagttttatctgagtggctctgttgctaagttttgttgaaattccatgattataaagtgatctccttgaggtttattttttttctcttagtttataagaactccttgaaggcaaagattgtatgttttattatactttttaaaaatttccatagttaccttttaatgtgggatatataataatcatttcacgttaaataaattttaaatcctatattgcattatttgtgtctatgtccaaaaatgtcataattatttttggccatctaggattccattatataattagccatcttgaattccattcctaaatccagaattgaatgagtacacccaccttttacagattctatgttctacacggcaccataggaaacactgaacttgatactgaacataatgaaacacatgtttatttttaatataactgcatatgtaaaagcacaacttgcccacagaattgtttctaaaattgggaggaaatacattttgtgtaattattttctaattgctaagcaatgctagctttttttgatttgttataaaatactgtctgatctatcttaaacacacagagaataggaaagtaaaagctaatataatcattacagttaaaactttactgaaatctttaattatccaaaacaagagggaattctttaatcactaaattaatttggttatatttctcaactagctcctgcctttgctaatttcctcagtgattcatattcatattgtgagggaaatattaatttaatgcaaccatatattatgctcttggtgatttaaaaagatagcatcataacactataggtttttaaaaacttaacagccatgaaaaaatacaaaacaagaaaactgttagaatctcctttttggcaataaaagtctataatacccagtttaatttgtaacaatgttcatgctctatctgtgaatacaactaagaatttactatttagaaaagacaaagttatccaaatcttacataattatgactacaaatatttacagcatacctgagtatcagttgtagaaataatttcaaatcacgcttcttttcccttgtaaatatgtctattttttcagtcttatgcaaggaataccaggaatgcagtgccgttaactttttttcttgtatcttggaactatcaaagtttaaatgcctgactccagtgctttaaaaatcgtgtatttcatcctctgcatatgctttttgctcttgaagctacaacactgtaaactttacacataatacatttcttggagaaagtgctgagttgagacatagagtacatctgatttgggctatttcaaactctcatatgccatagatgcagacaaccaaattgaaatgatgcacattatttgtaaattattaaccatttctaaatattctccacacgactggctttgctgaggtgtttcatccatccttgcaagcttcataaaacagtagcaggccaaaattgcagagttaacattaattctcatcaaagagaggacagccttagcaattactttgaaaaaggtcaggtatcagatttctttatgctgactttgatgccaaatggagtcacactgcaggcttggatattgtatgtcttctgtttttttctgtatactctgtcatgaatacatagtgccactctttgctgtctgacatataagttgatgatggaatattctcaagaatattatgctctcaagagcatcacacatcatttggtactataatttatttatatttttacacaagagcctaaacagacatttaaaatcaaacttcaaaagtagggaatacatgatttatatgaatatctgtcatttcatgacttgtgggtgttgctcactcttctgtaccagtaaaacttaacagcattgtgtcgggagtcgatagaaaagattcagatacagagtccaatagtgataatacagttttatcaatcaatattttaggagcggtaaattttcttgtaaacatacctctcatatttagggacggaaatagaattctgaagttttattggtgtcagaaaattcaggaatattttgatgatagcaagtgattaaatactttaaaatatatttttatcatattgacattttattttatcttcttcataaatattgccataaagaattttagttctgcatattctaatccattattttgttaatattttatttataatatttatattttaatattataactattatatttataatattaatattttgttaatattatttacattggatggcaatgttatgatctctaaaatgaccttttatttaatggaaaagaatgctattagttccaaggactgaaagtggtggcaatgtcattctgacttaatggagtacagttttattaaataatgcaagttcagttgtcccagggtcattatattaggaaatatttaatgaaggtattaatatttactcctacccaacctccagctggaatttcatggtgtgagagcaccaggttaattgagttttatcacaaaatctctgggccactttagaaataactttaacacatgctccctaaggtctaacctacaaaaagtgagaaaatagaaaaagaaatgattaacatgtaactagatttagctgacatcttcagcatagttatttattaaaagactgagcaactgatgaaaatttttctctgaaaagaaaaaggtatgggtttgaggagagtgggtaagatgctaattatccgtcctgtatgatgggagaataaatggaccaggaaagtgaagtagtatttcttggaaactcaaaaggcctactggaagtcagttatcacacactgagttcttcctttcaaaccctgaacaggaatatggagaaaagatgggtacatgttgctctagccaatagaatcacaagaatatatacttgtggagttttctgtagatatatagagtctattcatatccaaaacttttcttttagaatttgtttttgggaatacacctgttaggaaaataaaaaatgtaatcatttcctttctgctcttcactttttcagttcctcagggtaaaatgaatatgacaattcggtattcatattctcattttgtgacccagtcaaagctggaaagggtaaactcagtattcagttatacccacaagagtggtacaggataataactaaactctagataataataacaaaaaataatatagaaaatgtattgagttcttactatcaggcaagcatagtttcaactgttttctgtatattactttatttgatctttacaacaatctatgagggaattcctgttgttatcctcaatctaaagtcaaggaagctaaatcacagagctattcctctcttgctcaaaggcacagagatattacgatgtggaatctagatttgaattcatgccatctgactttggaacctctattgcaaacagatttactgacagagctaatctcacccaaaaatttcattcagtaaaatgcgtggccaagatggaggaggaggatatatgcatcgtagccaagcgtggagcttttattcccaggaactgagcgatgatggcggtactgtaagaatacaagatgttggcaagttttcattcaaaggcactctgctttttttttctcctttatgtttattacatgtattatagttcttggttttataaatttttagaataattttgtttgtttaatgttcctctactaatattttaccaactggtaaaatcttaccaatttaccaattggtaaaatcctccaccaatactcccagattgtaaattccacaagtcaggtatcatttgtggtttattcatggccatatcacctgttcctaacccatcgtaggcattcattaaaaagttattgaaaaaatatcagtgaaggttgaatgagaaaacttggaaaaaagaatgttagaggttgctgaaagaatgcgagggattatgtgtacaaggagtctggtccagaccccatcagagcatcactcaatatttctatttcactgagcctctgaattctgagcctaaaatttagatcaaacctactctgctatttctttaagtgacagctcttggggtgatgaataaaaacagtttctgaatcctgagtatgatttaccaaatggtctatcttagaagacacctttccatgacagaagtgtggaaattgttaggatctgaagcaaaaccacaaaaagagagtagagaggtttttgttttgttttgttttgttttactaaaagtaggagtttaaaagagcataggaaaatattggaatatcaaagacagaagtgagttcaagtaactgagactaaagatgaaattcctctgggagggagttgatcatttaaagggtactttagatagagaaaaatgtttcctagggtgtgccaacattgaggagacaaagaactagaaaaggagataaaaagtttccagtgaaatagggataaagacataaggttgtggtatcttggaattacataaagacaatattcaaaggaaaaagaaataactgtgtcatacactcctaataggtttaatgtagcaaaaaatggtccttaaacttagcaatatcttggtaatttttatctttaaagagagacattgtggaatgatataagcaagagatcttataaaagttcaagggaagaaggggggataataattgaatacttttaccatatacagcacttctaaggagtcttgttgtaataaaaattaggtgagagaaatgataaggtcatgataattttatttaaaagagaactttttatatagttatgagaacattctaacaagcatacaaaaaattgatgctgaaagagagacagaaggaatcatctggagagatgtccttgaacagtgaagatggaatggaattcaacatacacaaatacagggattggcctttaagagatgtacagacatcattcatgtgactcagctcatattaatgaaacaaggctgagtgtatgcgtgtacaggcagatggtgggagcatgtgagggactgtctcttctgattgcctctattttcttaataaaatagaaagcagcaccatcaagaaggtcagaaaggtatgggtttgaggagagaggctaagatgttaattatccatcctgtattatgggagagtaaatggaccaggaaaatgaagtagtgtttcttggaatctcacaaagcccactggaagtcagttatcacacattgagttctttcagcatgatactgtattctttggctacagagtgtgtcgacagttggacttaaattagcaggggagagagttagcctgggaaaaaaacagtccagggtgaagagcagtgtgcctgaaggtgcattgaaggaattgagtaaggttacgaattatgaactttaacctggaaatggagggagttgaggaaatgagagcagggtgaaagagagtgaaagagtgttaggatcagtagattgtaggtcttgaagtagttgagatgccaaacagaaagagatgaaattatgtattagtctgtctccaccctgctatagagaacgtctccaaactgagtgattataagggagagatttaattgactcacagctccatgtggctagcgtggcctcaggaaacttacaatcatgatggaaggcaaaggggaggcaggcaccttcttcacaaggtggcagtagagagaattgactgaaggtggatcttgacaaacacttataaaaccatcagctctcatgagaactcactatcacaagaacagcacgggggaaactgcccccctgactcatttacctccgtttggtttctgccttcacacctggggattatgaggattacggagattataattcaagatgggatttgggtggggacacaaagtctaaccatattaaataatataagatgtacagaaaaacacacttaaatgtagcaaggggatgcagctatattccaccctcaacagatttctgcatttgttaatttaatttagtctcacaaagttgagcgttagataaagtcctatcaatgaaacaacatttcccacttatttatgctaatatattttcagagatgagaatcctcagaactaagactgaggagtggggaaactctgaggatatgtcatagaaaagggctgggcagctaagagggcaccaagttggagagttaaaaatatccctgagagaggaggagaccccacaatactgtaaatcagttgcactaagaccatacgactgatgaaagccactttctaaggactgggcttatttgtcaaatagaatggaaatggtaatgcagggggttccagaccatgtccagatcttgaaaaggcctcttcatcccttatgtctgaactcacttttactgaaatctgtgtgcagtgccctgtgtggagcaggcaggaagctatgatactgctgtgtgcacaccctctgcaggaccatcttctccacacctaatccacttgaattgatttaacaaaagtgggtctctgttgaggatgaaacataactgaatccactttctctgttgaaattcaagtattggcatttctgtctatttcatcttattattccatctctttttgtctaggatcccaactccttcaatacttaaaatagactgattttaacaccctttcagtttctgcaccttgcatctatttcttcaattccctccctcaccgggttagagtccgtggtccataacattattcacttccttcagtgagccttcaactacactgcccttcaccatcaattattttaacagactaacctctctaacccccaatttaaattcaactattaatagactatagctagagaacactgatcttcaaaactattgaatgcttccttgtctgtattgaaagactttcgcttcctttcactttgtgacattccactttcctacttttttccttccctttccagattcgagtagctctgcttttcttcaaaaaaaatgctaatgttggtcaaaattccattttcaacaccctatttcttatttcacatacttccttggcaagcttgtctattctcagtttcaataaccatctatttggttaccatttcataatctctctgacgaacctgcgtcttccttacgtctgcagaatcttaacatcaacatgaatgtcctggaggcaccataggctctccatgtgtctaaaactgaattcatgagcctttacctcaagctcttgccttttccttcattcttacctatcttctagtggaggcaaccttgcctgatttttcacttttctttagtgcctccaatcaaataaaccaataatcttatttactattcccatacgtattatctccccatttctgaccaatctttgcctatattacagctttagacccttgagtcatctttatttggtcttgttcaaatatggcactacagccagagtgatctagaacttacgttgctctcctttcaaagctgtaccagtttaacatgacatgctagacgtttcatcatcggcaccttgtttacttattcagccttacatgtcctcccacctctctccctcataataccctgcgctcctattttaatccaccaagcaggccatggtgcctttactttcaaggtttttatatattttcttccctgtctagagtatctttctttccctactgaagacttgactgagctaatcactaatgaactttcaggactcagtttagatagaatatccactggaaagcattttctgatgacttaaagctgaatgagagttttctctacccatgcggggagcccataggtccttgaatttacttttatatcacatgatactaacattgtatgaatactgccttttttccccactagatcgtagctccttgagggctagggcaggattattcacttttgtttccctagcatttggcacctactaagttgttatcacatgtttgttgaatgaatgcttgaatgaatgaatgaatcaattgccacatttctagtaacagctttgcgttcacattaattgatgaaaagggaatctttactgcaacagataaaactgattacataacaaaggaagacctggcgtagtgcgcttagccaaattagcatttggctcatctctgtatggagtggcacaagcccatttgtgtaccacttagtatttggttaaaatatgtataagatttatagccacaatgatgttcctggcctttttaaaccttactatggcctttctacttttcaagtttttcattgattattcttatctggctttaagaactataaaccacattatcatacttcactgtaattgttaatactagtctgggatagttttttttttttttttttttttttcctttataaatgagcagggcagagagttaaaacacaaagcaatagattgcactgagaaatgaatacgttcagaaactacaactacaaactaccttaaaggaaaactcattcacttttcattaccttacacctctaggtgccaaaacttgcatttaattccatgttttaaaggagactttatgtctacccataatctgttcacatatagtttgcccaagggaggttaactcttttcagttaaaattgatccaccttcatcagacttgtggttgaccagcaaagagtcaaggacatgaatctcttaacacctcctgatggtcttgggctacacatatcatgctcattttaagtgtggaaaacatctaaaaatatactttttagagtttcagagaaatcatatttacagcttcacagaacagaaaatattaaacttaatttgatgcttaacacctaaagtgttattttcaaatcatagaaaaatgctttttgcattctaaaatatctctgtaagacagcataattattctaaataattttaattaattatgagaaagcttacttacagtgatactttttttaatcaaaaatttagttagcaatgattattaagtttaaaggccagatactctgaacaaaactaccttttttttttttgagacagggtcttgccctgttgccagtctggagtacagtggcatgatcgcagctcactacagcctaaacctcccaggctcaagcaatcctcccagctcagcttccccagtaactggagctacaggcatgtgccaccacatgtggctaactttttgtactttttgtgtagatggggtctcactttattgcttttgctggttttaaacacctagctgaagtcattctcccacctcggcttccctgagtgctgggattaaaggcatgagccgacgtgcctggccacaaactgccagagtcttagaagtatttccaagatcagcaaattgtccagcttaattgatactgtacatataaaaaatttccaattccttatttctctttagagttcatcataattagtttgtatttttaaaaatttgatccatatactaaacttattgtttcttatggacataaaggaaagttagttcaatccattttaggcaggatgctcaacctttctaaccaaacaccttaggaattaaaatatgaaatttatcaataatcaataaaaatgaaaatttcatcattgtttccccacttaatagtattaatctgtacacattagataataaaacctagaaaataaatttcattcatttttttatgtaccagagtgaatttgactacttttcaagaacatgaggtattacttagagcctagttaaaacacatgtgctacattgaacacacctcatactacataataaattttagtaaatgaagttcctatctatgtttgtagaatataagtgaaatgttggtttcctcactgcattttaataataaggaaagaactgatctatgtgaatgggtattgtaatattaaggtaaacttttaaaagttaatttacaaattttcctgacaaagtataaagcttgggcttttgactgtcttcccttctttcctacttacctctctctctctacttgctttcttccttcccttctgccatcatttttccttttccctctcctctcctccccttccctcccctctcctcccctcccctcccctcccctcctttccttaatattatagctagtagaattttcagaaaatattaaaaaatataaaagtaacattttttcacactctcactgtaatctgaatttgcttgcagctccaaagaaggtttttagtaatgtcttcaaagaaacaatcttcataagaaaaaaataaactagtttcctcaaaattcagattttattatattttttctcttacagagtattcaaaatctcttcctggtctctccacttcatatgctgctttgttaagaattaagaagagttcatcttcatctctctttggttccaaaaccagaccacgatacagcagcccttcattaggaacactgagtgcttcttcacccagctggctaggggcagctcagaattattattcccccatcaatctttatcattcctcagatgccttcaaacaagatggtaagtgtcaaaggaaaatggctccagatagaataaaggaggcaaagaagacttatttaatactgttgcaacagagatcaagactattccagtaggagagagtgattgaactcaactctgctaaaaatgaaagcaggagagtttttaaagctggggtgagctagtagaaaactggaggatgttaggggagatactggtaaatgtgactaggccatctgtgtttattgattggtgcttgttgaagttaggctactaccttttcatagagactgggagatagagaacctgtttcttgatggtttcatttcaaatggagagctcccaggccttgagacagacactactgggttataaaaatgacaagagcctgtgttggttgtaagttagtcttcttttctaaacatctttaaaggatttgtatgcattattatgtaattgcactctataccaattataatttaggattaagactaaatactctcgtagaatgaaagtaaaaatagacatttttggaaggccaatttgacagtgaatatcggaaacataaaacagacctatccttcaatccagtggttttatttctggaagtgtattctgtgtaagaaaataataaagagagcacgcaaagataagtatatacttagcattacttatgaatggaaaataagaaaaaatctatatatccaacactaagatatcagttaaattaaagactgctctacagctattggctttatagtttgaataacattttctagatgttgtctacctttgtcatttttggatccatcgacaaaataatgcctggttcattaacagcaggatgaacggcacctgttattactagtctctatccagtctattttatatagatatgccattcagttttctcaacacatatgtgaagtagatattgttactgccttctatagaaatgaaaactctgggacagataagtatttttcacaaggtcacactgctaataggtatcatagctaattttcattcacatcaacaatgattttaagactagtacacttaggctgcatttcatttatgactgatgaaagaataaacattcaaagatacatctcgaaggaactaagatattggaaagattctgggaatgtcaattattaggttgtggtgccaggtgcaggcaaacttatcctttgtgattataccaattgttgccatgtgcagcattgtctcgtagtgttggcatctaagttgtatgtaagcatgatgttagaactccagaaatgttttattttccaaagtacttacatttaatataagtttttaactttctattaccttaagcctaatatgaaacatattttctttaggcattattatcttgtggagtggcattaaggtagaaaatcaagtgatcagaactgtgatctacttgtatagtcggtataattttcagccaactagtgttctgcctctttgttctcttgtatcaaatggaagttaaggtagtcacaatggtcaatataagtatgaattcaaatccatgaaaatgatgagaacaataaatattgggacataagatggagccagctgtgacaacaattcaaggtgtctactattaatgcttgtacacctactgtgagctgatcctattttgggtaattagcagacagaaaagaaagaaaatctggtcagttacatatttcacagtatttcaaatattaaaatagaattgttattcagtaaaagcacaactctctgacactttgattagacaattttttttttctggaagatcatcattaggagtttattattcgatataatggcaagtgacctgaacattacttttactgtacccataataatgagtttcatctgtttcaataaaggcagatgaaacccaaacagaaacaacaaaatgagaagtagtaattctctaaaactgtgctcctcaatctttacagataaaaccctcattaaaataagaccccccttcaaagattgaggtagggcaagagaataccacttacaaaaagctcccaggtgatggtgatggtgctgatctgtggatgatacttactgagtggcaaggctctaggctggtaaccaatttaatatcatttggtcctctgctaatctagtttaatccatattttagagtataaggaagaatggataatctgagtattttccaagtaatcttccataactactgttttctcttctgagcattttataaatcttagctagatgtgactttgagttctttttctctgacaagagtctgacgtatggcttttgtcaggtaattccctttagccttaatagagagtaaagctgaggttgacatgctcttacgaaaaatgagaaaagtaacagagcctgaatagaaagtcatcccactcctgttcagagttaagccaagaagtaccccagacagagcaaagatttttatgaaaaatataaagactcagcttacagagcaatttggggaagcaattctacttccggatatacaacttggagaaaccttcccatacaagtacgaggaaataaaacgcatcttcaccacaatatgtttaagagtaaaggttggaaacagatgtccatcagaaggggaatggatacgttgtattatttttatttaatggagaactaaaactgttaaagtgaatagaaagaaaatggatagacctcaaaatagagagtgaacatggtaagttatggagtattatatataatatgatatcacttatgtaaaacaatggaaaaatatatcctatttatggatacacataagtggtataattttaaaacatgaacttgagatagcaggttgactgcagtgcttaccactgcggacaaagggagaatgagagcaggaaataagtaccaggagagggtatatacattatctcaacttactgatactttatttcttgaaagaaaaaatctgaaataaatataactcctgtagtgactagacactaaaatgtctcacagtaattctcacttggcatttacaatgtaatctctcactttatctgttggctatggctattaacttgcctctggagaatagattataaataaagtaatgggatatgactcccaacaatgggttacaaaagccactggcttccatcttgtttgtcttttttgctttctggcttgctcatattaatggaagtcagctcgtgctgagagctgtcctattgacaggcccactgggagtggcctctggccaacagcccaagagtaagtgaaggactcagttcaacacccctaaggaatttgaatcctatgagtagtcacgtgagtgagtttacacgtgtatccgtacctattcgaacattgggatgagacagcctcccaccttttgaaagacacagagcaagggttgagccacacctgcttccctgacccacgaaggctgtgaggtaataaacacataatctttgttcattttctgggtttcctttctactattttaactgtaattctatatttctgcagaaaatcattctcatagtttcatagctttaaagtttcctttatatgtttcatctattttaagttgctgtgtcatcttgtgattatctcaacaggttggtattcttttctaggaagccagttcctacattcagcccagatttgtttattcaggtcttgattatgcattcttctttgttctcctttatattttctacaaggcctactttttagtcctgtttgttatataaacagatgctacagagaaaatctgaaaaaaaaaggcaaatgctgcaattagaagagatataattccaattgtcctactattttaagtgctcatagtttatattaaatgtattattctttattcattacattagaaattgtcaaatattgaaaacataaaggaaataataatttcatgaaagtgtcttgtgactatatattaagtttattaaactttaatatttttccaaatttgtttcagtattttttgacataaaattaaatttgagagttcttgagtattttgcttggattgtgtctcacactttctccactcttagaggaattactatacttattttgtcatttacatgcatatatttatatttctatatgtgtgaagcctataaagtacatgtactgttctttaaaatttttgtgtcaatgatactgtgtatatcagtcatgatccaccttttctggatcaacattatatcctagagattcatgtatcttggtatcttcagttctaagttcatttcatttcctgtaaagcataccacactaggactcaattacagtttctttattcattccctttttgtaaatatttaggttgttttaattttacattgttacatgtcaaatggattttttcatgcctcattggtaattgtattataagtattttaggagtgcaatttttatataaaagcattgtaacatttccagatactgtcaaattgctttccaaagtgattgacacttctaccaacattattgtataggtgttcgtatttctccacattgtcaccaacataaaatttttttggcaatctcttgagtatagtataccattttattgtggtttagtttgcattttcttgactagtgaggttgaaatttcatgtaaatattggacattctggttttttctaatgcatatttcttattcatatatgttgactgttatttctgttagaatattttacttacatttaactgtaggaaatttacaaatcagttggtcactggttaaatgcattgcggatatattttctcagaatgtaacttaactttttactttgtcagtagtaccttttgttaaacagaattttttgattttgtgtaatgagatatagcaatattttcctttgtagtctgtgcttttcatgtcctaaaaaaaaccctttttaccttaaatttttatttccttccaaatttaaattttgattttcatatttaggtgtttaaaccacatgaaattatttttgtatgtaatatgaagtaattacctgattttatttgttttccatttttggagtggtatgtattaaccaatgtcagtgatctccactgatttgtgaaaccactcacttatatatgttaaaaatatactttaaatccttcagtaacatggtttaattttttggaaaacatttttcacatctttaagcttattcctagatctcatacagtttttgtctcctcgaaaataataatatagtaagaatagcatagtgtttgttaagttggtatatagagccctatcaatctgttactgttgtctgttatttctgttagttcttgctcatatggcgttgtctaatagtatgtgttagatactatatttggaaaaattgcttgtaaaaatagtttgtaaaaattgcttgtgtgcttaggaggaaaacagaaaaggtttggttaaaagtagccagtatctgccagactctttaatttctttaggatgttttcgcttttcccttgctttacattagatagactgttttctatatgtaattcctctctcttgtattttttttgcatcatatgcctatttcttttgtgattaccattaacttagtctatagtgattatcactaatgaaattaagaaatttctcaagtataacattatttgataattttgttgtttcaaacatatgcgtcctttagtgttttctcttttactaattttaccttattcacaaaaatatgtttaaaaatcaatacttaattatattttctgtaacatcactatctatagtcataatttcttataatttttctctgtgttcactttttggatgaagcatattttgtggtaaaaaggatatcactgtgacaaactatcttagtctttatctgtctgaaaatatattttgccattactcttgagtgatagatggttttggaaagtgtaaaatttctaggttgatagttatgttccctttgtactttaagtatctgctggcctcttttgtagcgggcaagtttatcaatctagttgttatttcctttgttaatagacttccctgtggaagttatttttttctaatgcttgccattttgtacctttactatgtactttctaaaagtaaatttatttttgcttattcacccagcacttaagagacaattcaaaagaaaatataatatagaaatgttataatttcagagaaaatacaacatctttcttttcaaatgtgcaaaatccagctctttttctgattcgtctgttcttcatttctacacttttttgtgttatatatgcttacttagtttaaggaagtccattcctgaatttgtactttggagtatcgtaagcatatttattttaaagtcctgatagatataagtgtattttatctgggataagttcttattcctattattgactttggcttttttttgcaatatagaattttttatctatgttgtaatttttggttttctttgcaagtacatgtggaaaggaagtatttttattatgtcttataatgtctttaaaatgtcttataatgacattttgaggcattacagttctgttggggctattgagattcagtcactttccctgggaatagcttaactaagttcacagtcaagaagctatatctgccttctttcatctttgcaagtccacacctttcaatgtactgtagcctcacatgctcacagaaacagacacacatacgtacacacaaaaggcatccaacctgttgttataggtatcatgacagaggtacagtattatttggtaacatagaatagaggcatcaaatttaacctgtgttgtatgatcgggtgaagcaaaattgaggaagtgatactggatctaaaatatattgcatgtgtagaagtacattatagataaaagaaatcatgtgttcaatggcaaaggggtaagagagaacactcctatgtttaaggaaactgcacgttatatattatagttgtagcaaagtatgaatggctgcaatgaaattataaataggcttcttattaaggagtctaaaaattttatctgtgttaacagcaagcctccattaatcagtggaatctttttagcagcagttgcctgtgagacctctgagcatgcagatttaaaataataataaagtctctctcatgggaggaaggaagtaagggggggatcagaaagatgctttcacatttataaaggaaaaaactgataattatttcaaggaaagcagtagtagcagagataaagagaaaataatagttcatcaccctgtattctactagagtctctccacatagatatatttggtcagagcagctgtgttcattggttttttgctttttgttttgttttgtttttgtttgttttaatgcgagacagggcttcactctgtggcccaggctggagtgcaatggcctgatcttggctcactgcaatctctgcctccagggttcaagcgattctctaacgtcagcctctctggtagctggaactacaggcacacactaccacactcagctaatttttgtgttttttggtagagatagggtttcaccatgttgtccaggctggtctcgagctcctgagctcaggcgatccacgcaccttgacctcccaaagtgctgggattacaagcatgagccactgtgcccagcccattcattggttctttttaagttttattatgtctaattgtcttctgtgtgtcctgaaatgttttcagcattataacagcaatagcctgaatccattatagaattccaaccatgtgggactaaattaaaaggtaaaatttaaaacaagactagactaaattgttagagtaaattccagaagaaacatgagcagcatatagtgataacacatatttttgttaggtctgttttggcccagaaacattttcatagagacaaagtgtatatctgtaataacttacacatagctttgtttccaatattttaacaaatatttttagaggcttattaacagattggctctaaaaagtagcttgaatggctcctttatacaattactttacctctctatagtataatgttaacagtaatcagaatgctttctgaatgtttgtgacgcaaatttttacgcagctctctcgactatttttctttgatcggtcaataacatatgtagaataggattactactgtgaacataaaacactatctgtacaagtttattaaacagagatgtactttttacattttttctgtaggagatattggccatctactgtgtgcaagctgtacattaactcatcacaagagagttattgttttaatctctaaagttttgaaagtatttgataagtatgattgtatagcacattcatatgtattatactttctatttgaaatagaataaaataataatagttatatagatcttcagagatatgtacaatgattttggtcaagtactaaatcagtaatgtgaatagctcattataagagtaatttgtgaaaaaaaactttatgagcctttatataatggctactgcttctttgtaaactaatgatagcattctgtcttagtccattttgtgattctgttacagtatgccacaggctgggtaatttaaaatgaacagaaatgtgttggctcacaattctggaggcagagaagtctgatacaaagtgctagaatctggtggggacattcgtgctgtgtcatcatatggtgaagatggaagggcagagacagtgagagcaagaatggataatgcaattgcaacaataatggcctaaccacctcttaaagtcccacctcttaatgctgttacaatatcaattaacttttaatataaattttaaagggaagcaccttgaaatcatagccgataccctatgctattttattaaatagaaagttaattatcaatgaatatgaaatagtttttgtttacacatgcataatcatggaagcttttatccaaatttaagtaagatacatggaaaactgaaagaacctttcatatattattttactacactcaagagaatttacattattaaaatcatgtatctttatcttcagtggtcatgttgatgatgtattttagtcacagatattaaatttgattatagtagttgtcttaaacaatgacaaatcccatctaaatgtgagcttttgtataaaatattcccatattcatggaatgtatctgtacttgctatattctatttccagcgagaattagaaaacatcatgtctgatttcactttattatttatcatagtagttagatcattttagcaacaaaagctattccatttagagcaaatttagtgattatgttgtgatgtttaaaaagtgtgatttacaaaaaaaataaggaagcttttggttatattttaattagctctgttcttttgaagatattccctggtgatatacttaaagaagcatcaaaatttttagtgatctgaaatgatgaaaatacatattctaatctacttaaaaatatttggatagaggttaatctcataatttgctatacatatgtccacatttaggaagtacagaaaaaggctgcattcagaattactgtgttgcatgacgatgaaaacatggttgtgaatattgtggactggtccatactaggcagagaattcacatcacatgttatactttggtcatccccaggctttatgtttgaaaataatcaagaaaggcacagtagtcagtcactgatacttgattgaggtgaagagatacacatagtcaatgaataaaaacttctgagctagtctcataaaataaagaagagaaatggagcagtacctggaaaggtgagtgctgctcattggcgttgagcaaccagaaaagtcctcagtatctactctgttttcaacccgatactgttattttggataatagctttgatctcttgaaattgtgtcaatgcaaatgtttcatagacctaagaggtataatgtggtttaaaaaggaacaactgagttgttaataattactctaaagtagttatttgagtacaaagagtgacatttaagtgatttaaaaaattgaccaaggtttaaagtaaaaatatgcaaggtaacataggttaattgaaagctcttatgagttaacacctcagacacatgcaggatatatgctttcgggggacataggcaaggattattaaccagagctgacactatacctgttcctccctctataaatataaactgatccttgatttcatctgtttttattgttgttatgattttagtaggagtaaacttaattaagtgtagggtgcatttcattcttctatttgtgatgagatggttaggttaagatattttatttttgcagagaggcagtctggattaggagtgattcaaattagataggtcaaacttttttcgggggcggggagcatgttcttctgtttgtcctgattcagagactacagtgctgtttttgatggcggaaatggtggtccttagaggaagcaaattatttttctactaaggctaagcacataattttgctctctttaattccctcaatggtaaacacaatctgcactttataaaccctctgtgtctacgcaagcttttaaaatttttagcactgtcttctgacaattggatgattcctgcatttacaaatttgtggccttatgtcttcagtacttttggctaaattttatcatgaacatgatttattaacagatttgacttggcacatgggcaatggcatcctgactcaaagcaacccctttggtgacaattttctgttgtttcctcaaaatactctttgctgataaattgtttgagagacacaagcacaaaatgtgatcttttatgaaaataagaattctctcttggagggggaaattgtattttatttggatgacacacttctaaataaaatacatcatgtcagtttccccaatttaaaaattgagaccatattctaataataactttacagtcttatgaccattcatcaaaactttatgactttattctgctattgtagtcttaattttaaagccatttattattttatacttaaatgcttttttaccaatttaagtatatgtggtgtgagcaaataccatttcatagtctcctctttattctctttcagcacttacagcagtgcaaggttactgggagcttaacaaatattaaataagcaggaacctatttgaggactgcttcatttttcttgaaatctataggctgaatttctataccatgatagtatatttactaaatatttttgaacacaatagtggattttggattataaatggaaaggagaaagaataatgtccaccttcaacaagatgacctattggtttggcatcctgtgaatcttaggttggtgtaaatggaattgaggtttcggaccatgaattttaaatcatgataactaggttccaatacatctttattaatcaaaataggaacccacacatttttgctaatgaaaaataaatttgtttattcctctaacataataatccatgcttcaggattcagcaaactcttggaaagcattttctgcatcctcctggttgtggaagtgtttttcctgcaaaaagttgttgagatgcttaacgaagtggtagttggttggcaaaaggtcagatgaatatagagaatgaggcaaaatttcatagctcaattcgttcaactttcgaagtattgcttgtgtgacatgcagtcaggcattgtggtggagaagaatttggccctttctgttgaccagtgccggctgttggcgttgcagtttttggtgcagctcatccatttgctgagcatacttttcagatgtaatggtatcaccaagattcagaaagctatagcggatccaactggcagcagactgccagtgaccataacttttttttttggtgcaaatttggcttaaggaagtgctttgcagcttctctgttcaaccactaagctggtcatcatcagttgtcttataaaatccacttctcattgcatgtcacaatgtgatcgagaagtggttgattgttgttgcatagaataagagaatatgatacttcaaaatgttattttttttaattttgagtcagctcatgaggcacctacctactaaggtttttcacctttccaatttgcttcaaatgctaaatgactagaatggtggacattgagttcttcagcaacttctcgtgtagtcagaagaggatcagctttcatgattgctctcatttggttgttgtcaacttccaatggccaaccactgagttccttatcttcaagttccttgtctcctttgcaaaacttcttgaaccaccactgtgctgtacattcattagcagttactgcacaaaatgtgttgctgatgttatgagttgtctccgctgctttatgacccattttggactcgagtaagaaaactgcttgaatttgctttttgtctaacatcatttccatagtctaaaaaaaaatcaagtaataagtcattagcaaaaaagcaagaaatgcccattaaaatgatatataacataaccacatttaacaatgcattccaatatccaatggcaaatcccaacgaggcaaaaactgtaattacattggcatcaacctaacacatggagttggtgcactttgattgttatcataagtgataatattactgcatcctctgacctctcttttatatctgtacgaaagtgacaaaaaacctattagactttaacttatgttgtgtgtacaacgaaatgctacactacccatgaaacattcatcaatatgcttgttaataaatcgttctcttcaattcttagaaatccttgaaggttttatagtttatacttgtttaagtttcataaacttcatttcaatgttgaaaggcaacttaaagttaaaagaagatttggacaatttttttaagaattcatctaagatacttggtgcaaaaatttttctcaccttgtaactatgtcatcataaaatataatttctagttaacacttcaaaatttcttgaaattgtcacataaagtatactaatgatcattaaaatggcatttcttaaaattttattgggcatgataggctgctatttcctttatattatattactgagacacttagtttacattacatgaataagctagtcacagacataaattacagctaaccagcaggcagaacagttgcagcctggcattagatgtaatccctgagaaaaataagcacagaagttgatgtagatgtaatccctgagaaaaataagcacagaagttgatgttaaaaagaggatttaagcctgaaaggcagatttagaattgagggagacatgataatgttgggtcatgatccaataaaacaatcgaaacagtgatccaaaaccaaaaagcaatcctttctgagaacctggctgcaggagtctcagatggatgatacttaaaatgtcttgatatgaaggaagttataaagttagtatctgggtagcctatcagtaagtggcagaagtttcagaaggagctagagaggaccggacactaacttgatcctaggacaggactctataaaggaaactattgtctccataacaagataatatacagacaatccctaatttaaggtagtttgatttagaattttttaactttatgatggtgtgaaagtgatatgcattcagtagaaaccatactctgagaacccatacaaccaatctgtttcttactttcagtagagtgttcagtaaattacatgagatgataaaactatattataaaataatctttgtgttagatgactttgcttaactggagactaatgtgagtgttctgaacaactttaaagtaggctaggataaactctgatgttcagtatattagttgaattaaatgcatttttgaattataatattttaaatttaggaatacgtttgttgaggtgcaatcttattgtaaactgaagagcatctgtactactgctcctagaaactccacttggagataggtagatggggcttccagagtcataatttataatagaacttgatcatcctgttcaagaccctcttgtagaagactcttgccaacaccaggctaactttaggcagccattgtctcctgtttcttgctctagctcagtgattcccagttgctgtgtcgcttccttcttcgtgtttcagacatttgtgggggtagtctcagttattcaaggatgtaactttcatttaggtagtagagaccaggaattccaaatgtcctataattgcaaagcacaggactcttaagtgtcctgacaggcatttttgtgagtgaaaattctcttcatagttatctggtaaaataatctgactggatatttcattacctatgtggtatttttaaatatagtggatattttaatgcaaacactgtatgaattgcaagattacacttagttttgttcagaacttaaccagaggttgttgtccatttagaatacctactacctaacactggtgcctctcatgacacttgggtcaccaattgtagacacctggattagtttgcgtttgtagatgctgcattcacggggatttttatgaacaaaaactcttgattgcttctttatgttgtctattataattctgaaaacttacatattgaaaatttattgaattaaatattgttttaggctgggcacagtggcttatgcctgtaattgcagcactttgggaggctaaggtagaaagattggtttagcccaggaggttgcggctgcagtgagccatgattgtgccagcctggatgacggagcaagaccttgtttcaagaaaagaaaagaccaaaccacaattttacagcaaacgattgcacttttatttgtccttttaaaatcatttttaaaagaattacccgtaggtagttagaatattcattaatttcatttgacaatcacaaaggaagagcataaaatagttatgatttaaaaactttgagaactgctagatggatgtaaggtactttttctccattccatattgtttttctcaacttgctgagactaagatagatggggttactactaaggctcagggataacaaaagagtaagggaaaaacaggaatacatatatatgattttataatttacaagtttagtttaaacatctctgatttatgctactctagatgactgcctccacagtcaagaccatcttgccctagccatttatttgataccttgttttcctaatgtaaagctgagagaaagctatccagagtaattcaggagtttcccttcttatatgtctaccttccatgtttcagttaactgtttgaagacctattgcttccatgatgcaaactcctttcaaaaagtttatgttcccctccaaggagactctgtcctttacccagattattgagtcctactttgctgtacgtggttgccctgtggcgggtaagatcagtaccatcactacctaaaattggttcagatgcagaaactgatgatgacgcatatgttcaaaaagggtatgaagagatttattcttcgtaacatgaggctttctgagaagacacattggtatgaaaacagcctgagtgaaaaaaggaatgaatgacttggatttttaactgtggttgtgaggtagggttgggatgagggttcctatgtgggccagggtttgtgtggtgtaaacttctccactggagtcagggcaggaggtgcccaacttctgaccttgcccagaggtgaggcaatagggaaaaggcaaataatgtggcttgaaagctgtcagcagtcaaagagctgacataatgtcagactcttaattacatgagtctatagtgaatgtcagtcactttaaaatccaaaacaagaaccacagcagcacccatacaacataaatgtgtacgtaatagcactgggccttctagaagggttaacataggatttaggaatggaaacatatggatgaaaacccattttcagaatatggccatgtgaagaaggcttggagctcaagaattaagtagaaagctaatttaaaaaactggagcactataactggtcaagctaaatacatggttgactggttaaatacctcctgtcataggccctaggcctggaaatacatgctagctaagtagtaagcaatcaagtggtctgaactagagaagatggtttatcagcaagactatgtaatattgttataggaaagaggtccggatacagaccccaagagagggttgttggatcttatgcaagaaagaatttagggcaagtccgtaaagtgaaagcaagtttattaagaaagtaaagaaataaaagaatggctactccatagacagtccaaagggctgctggttacccattttaatggttattccttgattatatgctaaacaaggggtggtttgttcatgcctccccttgttttttttttttttaatttttctttttttttaattatactttaagttctagggtacatgtgcgcaacgtgcaggtttgttacatatgtatacatgtgccatgttggtgtgctgcacccattaactcgtcacttacattaggtatatctcctaatgctatccctcccccctcccccaacccccgacaggccctggtgtgtgatgttccccaccctgtgtcgaagtgttctcattgttcaattcctacctatgagtgagaacatgcggtgtttggttttttgtccttgcgatagtttgctgagaatgatggtttccagcttcatccatgtccctacaaaggacataaactcatccttttttatggctgcacagtattccatggtgtatatgtgccacattttcttaatccagtctatcattgatggacatttgggttggttccaagtctttgctattgtgaatagtgccacagtaaacatacgtgtgcatgtgtctttatagcagcatgatttataatcctttgggtatatacccagtaatgggatggctgggtcaaatggtatttctagttctagatccttgaggaatcgccacactgtcttccacaatggttgaactagtttacagtctcaccaacagtgtaaaagcattcctatttctccacatcctctccagcacctgttgtttcctgactttttaatgattgccattctaactggtgtgagatggtatcacattgtggttcatgactctcctttttagaccatatagggtaaattcctgactttgccatggaatttgtaaaatgtcatggtgctggtgggagtgtagcagtgaagatgaccagaggtcactctcatggctgtttttgttttggtggattttggctggctgctttactttagcctgttttatcagcaaggtctttatgacttgtatcttgtgcttacctcctgtcttatttgtgactgagaatgtcttaaccatctgggaatgcagctcagtaggtctcagtctcatttttcccagcctctgttcacgatggagttgctctgtttcaaatgtttctgatgatgatatacagttcaatgaactttgtttcttaatgaaattacatcttctttaatagtttaaaatgattttattttaatgtaatattagccaacatcagaaactctggacactataacaaattacttcttaacacattaacatgtttcttttgtattcacatcacattctgcttagttgttgaatgaagtgctctccatacagaaagttttggaaccactttcagttgatctaatatctttgatatcttttaaagccttactggcatcttctgctcctttacctttagaaaactgacaaataggagaggataaaagattgtgcatgacttttttttgtatctagtcctgtattttacatacatttcagtctagaactaagtcacatggccccatgtcaaacctaaaaaaggccaagaaagtgtcccagtgttcctaggaaaaggaaatgggattagggagcatctagccagtacttgccacacatgagtaaaaaaaaaaaaaaaaaaaacctatcaaatatcacatgtgataatgatgacattaaaattacactaatataattttaacatcaagaataaagtgggctcttaggaaatactttattgagtgattatgattaaaattatttaaggtcagttctatgggttatatagaaacagctttgttttagtaaaagctaaaagtaaaaaaacttcatttttgttaatttctcatttttcataatattttattagagggacttagggtatccttagtagaaacttcaaattttaatcttaaaatatgaagtttataaaatacagaaaatatgtcaatttctataagttaaatagttatattaacatgcaggtaaatgtaactaccagaaaatcttgagtaaagtatgtctattatggagtagaattgggtaaaaaactgtcctcatctaggatacaaatttacggttttaattttaagatgaactttatcttcagacaataatctgttatgacctcatgtattactggatgtaaccaagctaagactggatatagatcccacagatatttttggaaatgatgcctgaaatgaatcgttcttcttccagttctgaaagcttatggccctatgatagcataaaaatcaaacatctatcaagtatttttattttctccagtatcactctttgtaaatgatacttctatctcttattttttgttttttcatcttttatttttaaaataattttctcacaattaatatagggagaggaaaaatggtttattagttacctattcctatatttaaaaaatcctcaaaacttagcaatttaaaacaacaatcaagcattttctcttcaagtctgaaatctgagtaccttagctgggaggttctggctctaggtctttcatgaggctgcagtcatgctgtcagttatagctccattctcatttgaaaactttacaaagggaggatccacttaacaattcacctatgtgattgttgttaggcctcagtttcttgctgccttttggccaagccaggtatttcagttccttaccatgtcggcctctccacagcctgaaaaaatttcctttggatatgcaatggtcttcttcttgagggagtgacccacgaggaaagtgtaccccagaaggaagttgcattacttagtattagaagtaatatagtatgccttttgcttttagctagaaataagtcattaagtcaagctgacactcacggggaaagaaattaagctcaactccttgaagggagggttatcaaaaaagttgtggacatatcttttaaactaacccaagtaggtttggaaaaattcttcacaagtaggtttggaaaaattcttcacaagttaattggtctaaagatgatataaaaggcatgtttactttatatcattattttgaaatacaattaaaacaaacaagattaaaaaggaggcatgaaaaggttactttcattgaaacaaggaaaaaaggcttgaaaataatgaggaaagaaatatccgacaattgcctttgtcgtcagacttcaagacaaatatcagtttacctaatggtaagtcaccagcccttaaaagaaatgtgtactcaattgttcattaataaaggtaaaataatcgggtgaagtctgtgtgaaagtggacaaatgactcaggatacttcagaacatatcgaaggaggcagtgaaataagaactactatgacaagcgttttatatatatatatttttttcaatctaagtttttgtatgggaggaccattgaagttgaggcagagggaaggaggcaagagattgagaaaccgtcagattatagtcaaactcctaacctaaggattttccctgtgaaccacgcagatgtccttaaaaaggaaatagggttaatacagacatataacatctatgcatttagatattactgataatcacattactaagaacagttaaaagaagcaatataagaaaccaaagtagatataagataatagaatatgatatgtaagttttggagctcgggaaacaaatggaagagagaaaaaatgattaaagagttgaaactcttagtagtagtaatatatttgcacctaattagatagtaatacagcaaccaaactcaacaaagtcaaacaaaaaagaagataaaccattacacagtttatggagagaactttttttctttttaaagaaaaacaaggtatgcctaactggtatgaggggaatagagcaaatgagaaataaattttcctgaaaaagaaagtcataagactgaaagttaaaaaggccaactgagtcacagaaaaaaaaatcgtacaagatgactacaccaagacatatccctcaaaattattgatattcacgggtgagtaaagaatcctgtgggtgtccatgcataaaatctggtcacttaaaaatgatgacagttaggccggagtcagactacttcaccatggtaatgtccattgttaccagagggtggaaaaatacacgcaaaatcatttagttaaattagtagtgaacgtgtaatttgatacctgccaagttgtctcttaatgataaagaaagaatacatacatcttaactatgcaaaaaggaatacagcatacaagagcttgtttttggtaaaaaataaggaacttagaaatggaaaaaccatgggaagatacataagtatctagtctcataataagaactatgaataagaaactttgtaaaatatgcttatcaaacaattgagaaaatttaagaagtatacttgagaagtccatcattcttcgtagcagagaataaacagattatttccaaattgaaacaattcttttctaagaaaaaaaaaagcctcttgagtatgaccctggcatttcacagacaataaccactgacgttgtatgttcagccaactacagatacctagcagtttgttaataagagatctgatagaggaaaaaaacacagaaaaccattgcttttatgagacgttaacattgtgtgtgatgacatctgcccattacacaaatgtgtcgaaggcttctacttggttgaagagtttaattaattggctatcaagatctttgtgataatttgctattatacagcatttgaagtgttatctccaacaagttatagattccatcaagcaaaagagtgcagaatgtaagtatatggatttaaacagtggatcattatgaccagaagataaaattcactgctacagcagaatgaataaaaaatgtatctcagtatatctataatctctttacagtagaaacatcactgattatctttgctggggactgggaagctgtacgtagacatgtttcttttcccccccttaacatgaattttacttctaagatgaaaaaaggaagggaagggagccactgtttaacttggcatttgaaatactttctttttcacatttctatttactgtcatttatgttgacgcactggcttaacagcaacaaaataaatgatggagtcactgaatagggctaagatgctttgggaactaacaatgaacagcaaagagatgtctcacaaagtatgggcagtaataataaaatatatgttcagattagtcccttattatttagcctataatttaccaaatcttacttctctagttttccccagccggaccatattttatttctcttgtcctgttttcacaattttcagaacataaaatttggaaccagagaatcttaaaatcaactgtcttcttatacggctaactttgcaggagtctcctctaagaagcttggagttttcagcttgcaattagaaatgactatgatactgagctgagataattagataatatatatacatatataaaatcatgctttataaatgttagcacataagtataataagagtgagaaaaaggggaggaggaggaaaagaagcagcagaagcagcagaagcagcatcagcagaagaggaggaggagaatgaaggagaaggagaatgaagaaggaggaagagaatgacaagaatgaaaaataagaagaaataatagtcatggtagtagtaagcagtttcaagaattcaatagccttagatttatattccaggtttgacatttatatatatatatatatatgtggtgtgtgtgtatatatgtgtgtatatatatatacacacacacacacacatatatatacacacatatatacacatacatatacatatatatatattttttttttatggagtttcactcttgttgcccagacaggagtgcagtggagcgatctcagctcgctgcaacttccacctccattgttcaagcgattctcctgcctcagcctctgaagtagctggaattacaggcatgcaccccacgcaccaccacgcccagctaattttgtatgtttagtacagatagggtttcaccgtgttggccaggcttctctcaaactactgacctcagatgatgcacccacctcagcctcccaaagtggtgaaagtacaggtgtaagccaccacacccgggtatttcctttctagatttagctaattgttttctgtctcagttttgtcatctctaagataaaaggactgattattgccaatggtgattgtgagtgtttcgtgatattatgcatgagaagtattcagcataatgtctggcatatagtaattatactacaagtaaatattagttattaatcacaatttattcagtgcttgcaatatacaaggtatttgcaaatgttaataacaactgatattcctactaatactgtaaagtaggcattattatccacaaataatacttgagtagcagataatcaaagatgtttggttcatggctaaaaaatactactactagaatttgaacttacatgtgtccaactctaaagctcaggagttgtctataacacttattatatgtgaattttatgcagcatagctatttttaatgtttaagtcatagttttaatgtgtaaagatcagaaagggttttttttcccacagcgtaattctgcaagttaattcttaaaatttgatttataaaagttgtgatttataaaaatttatagaagttttccaattttttataaactcataatgcaacaacaaatacaaaattttgacaattttctctagttatttattaaatcatttatttttcttttccttattgaataaaagttttaattgacagcaatataatttggtacagtgagacatattctggttattttggtgtagtattttgctcgtagctcaaaaaaagtgcagctaggccagtcgaggtggttcacttctgcattcccagcactttgggaggcctaggcgggcggattacttgaggttaggagtgtgagaccagcctggccaacatggcaaaaacctgtctctactaaaaatacaaaaattagctaggcatggtggctgtaattgcagctactcaggtggctgtggcaggataattgcttgaacctaggaggcagaggttgcagtgagccaagatcgtgccactgctctctagacagagtgggagtgagactctctcaaaaacaaacaaacaaaaaacttgcatctaggttatctaggattcaaagaaaatactcgtcagtacatgctcatagtgactgctcaatttttatttggtttagaatactgtgaaaacttttgttttacttcgccaagacaaaatatttaaagaaatatatttaaagaaagcaaatcattttactccaaatttgttcttctaaatataaggtgtacatcttttcccagaatttttttttagctcaaatttcctggaacatttatttttatactttttttctgaatattttcttgtgattatctgcaaaagatataaacttctgtttaatacatatattggaactatgtctttactgaaataatttctctttatctgtagcagtagtttttaacaagggtcattttgatcctagagcacatataacaatgtctggataccttttttattattacacattggagagagatgctactggaatctagtgggtagaggccacggatgctgctaaccattctacaatgcacaggacagccccgcctcaacagaaagatctgtcccaaaacatcaatggtacagagactgagaaacctgatctagggctattatgtgatcaaattcatgatcaatgaaaattaagcaaaaaaagctttactttttcacaaattcacaattcactatgctatagatcttagatacgcacacgatgctctgaatgcttacgtaactgtgggctgacataacttgtattatcctctgtacatttgctcatcatttctccagctgacttggtctaaaactcaagtccaagttgacatttgaagtccatttttagtttcactttcttcatgaaattttcattagcttcaaattacttttatcacacacagaatttctctgagtattagctaactaaaatagaatcgagtgtctggtatatagtaggcaataaatttatgtgctcttcccactggcctccacttccttttatgccttttgtcttctgatcttattgactatttagttgtataaagttttgccattttaattaagttgtctttttttgaaagcatgtcttatttattccatgaaaatacctttatgcatgttacatcatttttttacaccccagaattgttagcactaaatgtagtgcttcagtgaattaatgaagaatataaaaaaatgcaagaggactaatattttcatacctgtagcacctaagtagtgacacaatattaatatattacttttgcgtgtgtattatttttaacattctaagaattttacaaactttcaggttttttaagatattgtttatgcttaatattattatccttcagtctgattttgaaaaatgaaaacaaagatatatatttaaaatataaatgtctgaggtttgttttttatgtattacacgtttaacagcatttttagttgattaaaaattatatttggttctttacaatttaataaaacaatgcagttttctagctattccttcttttgggaatttacctgttgattacaagaaaagagcaagaattttgaatataagtaagatggaaaagaaaaaaacacaaaatatcttgctagtttaaggaaatttaaaatgtgtctgttttgtctttacagaaagtgtggactatgggccagtttttgtgcaagaaccagatgatattatttttccaactgattctgatgaaaagaaggtagcattgaattgtgaagttcgtggcaatccagttcccagttacaggtaggaattcactgttaatcatttttcttaagccttaaaaactttccatcaatgatattctgacactctcagggaggattatacatatttgtcttctgattttttcctaagatggcttcgaaatggaacagaaatagatctggaaagtgattatcgctacagtttgatagatggcaccttcattataagcaatccaagtgaagcaaaggattctggtcattatcagtgtttagcaaccaacactgtggggagtattcttagtagagaagctacactgcagtttgcctgtgagtaaaatatatgatttttctatatatatgtatatagtgtgtatatacagtatggatttttaaaatttagttcaggaaagaaaagcctaagatctcaaatcttttttttttttttttttttttttgaggcggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgtttcagccgggatggtgtcgatctcctgacctcgtgatccgcccgcctcggcctcccaaagtgctgggattacaggcgtgagccaccgcgcccggcccttcttgggatattttgaaattttctaaaagatttgctgtcctcaaaataaacttgataaactagcctgacaggttgaagtccttttcatgaaagtagataaagttttagaattcataacagtctattttgaaacccaccactttttatgtgttattttcaagtctttgagttcaaattaagcttcctatgagaaaaaaaaatgataatccaaatttcttttgaaatcggattctctccatctcctttttaagatatctataattctactaactactatagtcaccatttgctatggatttctaagaatataagatagcatattctaaaacttctgcttatagccaggtaacaaaaaatacctctgaaatgctaatattttagattttgactatatctcctagatgtcccagttttcgtattgcaaaaaagatattgtatgtggctatacggacatagacacacacacacacacacacacacacacacacgaatataaacatttctaaagtagataatacacctgattaaatgaaaattagccaggtgaggcagcaggtgcctgtagacacagctacctgggaggctgaggcaggagaattgcttgaacctgggaggtggaggttgtagtgagccgagattgcgccaccacactccagcctgggcgacagagtgaggatctgtctcaaaaaaaaaaaaaaaaaaaaaaagaagtgtgtatatataattaactaaatatgttcttaaaaactcttgaaattattttacttataatgagagcttacaataaattaaaaataggctaataggtaaaaccttttattattattccttaataagtaatcctacttgaaattaagttcttgaggatagaatctctaaaaaatactgagaaagactaggaatctttatattaataattaaagtgtaattgtagtggctacataagagatcatgaaatgatttttaaattaaagttacacctggaagaatgtaataattgatatttctctatgtaatctttcccaggtatcatttctaattaacccagaattcagacaccctattaaagaagtgtgaaatagaaaaggaaagaataaagaattgataataaatacagtttgaagagtaccgagataggtcctagaaaaatgtaaatatcatattttaaagtagatttgcctaaggaattcagataggtacatttacataggccaaagacaccaagatagcagcctaaatagattcttttttattttggaaaatattatgtggtgtatcacagaacctaatactttacattatgcacaattaatcaagtagcctaataaactaaataaataaccctcataatagctcctttattcaatagtcttttcaagatagatgcagaatatcaagaaaatatgctatacaaatattagtggcttataccttacagtttggtctacagtatttgatacaaggtataccagttagctatagcctgtatgtcagttgtttttccctttgtggaagcaaatcatgccaacttttttctgcatgcgtttagagcagaaagctatttattttacatatccatatgactgtcctaggttttctggaaagaccaaacatagttgtcaaatacactcatctgaagtgatgactttggcagcagcgtttacaattcaatgaccaggcatgggaaatactgtttatctaaagtatcttacctatttagcatgaagctgtcttcaacttgatttagagcaatatctgcttatttttaacttaagcattatgggcttacataggtattcagtggtagcaccttatgactctgcccctctctactttccaccaaactcaggtcattggctacatacgcataaaaacccacaaggtacctggttaaagcagacagttacccagggaagaccaattctgcctcaaaattgtttctccacctagatgccattatgcttattcctatgatattgaaacaatgaagtcccatagatgtagtttcatctatttttccagtttatctttgaaaataaatgcaaatatgggcagtagggagaaaagatgaagatttgattaacctaccagtatacctggatgggagtttgggtgctataggattcggggactcagaatcgttcaaagattagggagagaaactgaggtaggaagttggggagaaaaaagaaaaggggttcctgaaatgaagtgaaagaacacaaaggcaaggtgaaacttgaaaaattagtccgcaggctgggcgcggtggctcacgcccataaccccagcattttgggcagccgaggcgggcggatcacgagttcaggagttcgagaccatcctggcgaacacggtgaaacccatctctactaaaaatacaaaaaattagccgggcctggtggcacatgcctgtagtcccagctactagggagactgaggcaggagatcgcttgaacccgggaggcggagcttgcagtgagccgagatcacaccactgcactccagcctgggcgacaaagcgagactccttctcaaaacaaaacaaaacaaacaaaaaattcggttggcaactttcctttacattgagattttctgaagaccaggcttgtaggtcaatatatttaatagaatatactcactgttgctggagtgtttaatgtctgaaaggatttttgtggaggaatgcttattacttttgtcacattttaaagctaaaatattttatatctaccaggctttatttatctaaaaatataaatattcattatacaactaatatttcaaaattaatatatttaatcgactgagataatgattaaagcatatttaatccaattttgttaaacatttattaaatattgaatatgagtcttaaatttattaaatgttttaaaatcagactaaatttataaatcgtcaaaatgattgcaaaacttttcactgatacagtacttataattccactttgtagctattcttgaggcatatttgcatatgttactcagtttataatagttttattgaatacttatttttaccttttacactttaattttatcatatgttgtaaaatacctttttagattatttttatgctgggctagtgctatcaggatcttctaaagtcaaacatgaaggaggactgtattacccaattcaaagtctatttttgaggtaccaaccaaatgagttttgattgcctctttcaaattcgagatctgtttaacagaccagttcactttggtgattaaccattattattgttatatcaatgatactttctaaatcttcaccttttactttttgccttttaaaatttgacaactttgcttgaaattgtgtgattctataacttgttgaacagtgtttaataaacgtaggatggggctctcctaattatattcataaaaaaggtactaatttgtattttataataggtatatacttaattgaagaattaagttatccatatactaacataatatcaaattatccatatactaacaattattatacatatttattgtgataagataaatattaaatataataaaatgtaaagatatatcatcgaagttttctttcttttgcatgaaaattacatattttcaaagaaaactttgatttttagtatcattaaagtcacatggctttttgcagattcaacatatatatatatatgcataattagtatatatatacacatatgcataattagtatactgacactcccttaatgctaggagtactcttattaaccagaaatatattttaaaatgttctgcctttccactaataacagcttgccttcctgctcccaaccccttgtcaggcatagatttacctgcttttcaatgagtgtaatgtcatagagactaaaatctaggtgctgcaggtgcatattagatagcaccaaataagttctggtggtaggtaggataacattattgctaaaccagatagtaaaaaatattttttaaaaataggttttgaatgtctcaagctcacattgacagcttgtatttactgaatgcttttgttgcagacgatgctctgtttcaaatacattaactcattttatcctcataaccaacatacgatttgttcatgttgtaaaatgtaaattcatttttcagatgataactctaatttaaccctaatagtactcaatctttccctattccagtataaatgtgtattggatttcttttttgacttagccaatttgacttcagaagttctttttctaaactttaattaaattggaatctttttaaaaatcttacatgcttgcttcctcagtcatcattttagaatttattaacacctatgtaacaaaaattaatattagtaatgaaaataagcatgcaatcatagtgttctgcatttcttctcattgttcagatttagtttaaaaccacttatttaattttccttacagaagtttaacagtttaggagacattgagtttctttccagatctggaattttgggcttatagtaattttgatgtgtaatcactctttcttactaacatattttttcttttaataaaaccttttcctcataatttatttattgaataacatacagtgaggacctagaaagctacattttctaaatgaatttgagacaggacaaagataactgcagctattgtcaaaagctgatatcatcataggtcctagctttcgcagaaaatgatgacaaggaactgagtattgacaccttttattaatatctggtgatgtagcaaaaataaaattatatatagcatttggaaaaattaagcaagtataaagcaaattaaattgtttttaaagtttcatttctattcatttgtcacccaatatatttacaaatatgaaatagcaaatgtatgcttgtataataatgttactttattaacatatttaatgtttacctctttcgaaaggtgatttttttttacttgctgtgtaagatatatgctcaagatacatgtgtaataaagtaaatatagtcctaggaaaaaatgtaccttataacaggtcaaggtagtacagaccataaagtgaaacaaatatttccctggtggtcagagcaaaagaaagaaagaaaaacatgtaaaggaatctaacagaatctatttcccctgcacacccaacacttcctcaaagaaacaaatctactcttgacaaattttcataaaaattttttgtttgaggctttttattgcaacccctacagcatccctacttcaattcaatagcaagtttaattagcttgacataaagccaaaaatttccttaaccggaactagaatttaatcatgaagccattcactttattcactgattaatttttttttctaattttgatttggacaactaacagatttagcagctgctctgtagtggttcatccacccccaacctgcctcatgggcttaaatgtctacccatgaggaacttcattttaaattctcccataaataaatatttatatataaacatggttcagcttagttagtgttaacacttagtttagcattaataaacctaaccctcacaagggtgtagtaaaaattaatgaggtggagaagctgtgttaatgaactggtttttaaggttaaaattaaaaacataagcgcaaagctggagtgatttcctagggatgattattactgattatcaatgagattatttttgacaaaagatattttattcctgaagcttatgtttgtcatgaggataatttcctcagctactgtagtgatttctcttcagtgacaagcaagaatacaccatataaaactttgtcactctcacactttgcaaacatccttcagaaatccaaagctcgtagcagtttctccacagttgggatttttagaaataattgatgccagaaagtcaaacatataatgaatcaggaataaaatctccttatgctgtctcttacttcaaaaatacctttatatgcaattcttggtaaattgatagttcctatctaaatttgaacatactgcttttcagcgcatttagtgatttagatccagaatattccattagttttccttgaagcagttgattaaaataacctacttaactctttgagagattatatgactttttaggctttggatttaagccctttaatttaacctttcattttcatataaaactcaaaaattacttctctggcttttttcataactttttctcctaaggtaaaattgaccttagagtttaaaaccacattttactagtagtgtttaatacctaataaaatgatttgaataatcccaaactccacagtatatgcaaagctttatttcattagtctctgaggcttagcctataataactttattaaatcatttgaatattaatctgaatgagtcagattgacatggatgaatttactagttgtaaaattattagatgttattacaaaataaattagtgtttgtaactttatcttccatatacaaatgactctttttttaaggaaatcacaactcacaataaaataatgtttaagtgtttctttaaaagtataattactttggtcataatagatacagtaactgtgagtgtgtaatcccttggcaaaatacagtatggattattggattaagttcagaggaaacaatttaaaaatcaaaaatacataattttatgatttactttaaaatactgtatagatggtgtctagctatttgcccaggctggtcttgagctcgtggtttcaagtgatcctcttgcctcaatcttccaaaatgctgggattagaggcatgagccaagatacccagcctaattttatacttttaaagcaaattatgaagagtgaataaaagttgaaatctgttttagactaccctcacactcttatttcttttacataaatcataaatttgcaagtttttttaattcaagtacaaccaaacaggtactttcattatgtatgaaaatcatgaataactctgtctttatgtgacagatgacctgcaacaaaatggttccattttcctggcttggcacagggtatattttatcatagtgctcttttgttttgcttttaggaattcacaaagtcagttcttcattcaagttgtaaagtaacaaggatcagggactgtatacatcttctgacctttaatgctcaagcacatttacttaattaattgtccttaatccttagtagagtgtttgtggagacctttcccaagcataggagattccaaagcactaaagaacaatagacattttaaatttcacttaattgtgtcaggttaacatgataaaatagcaacatatcatgataaaacagcaaaatatcaggatgacttatgatcttcttgagtataaagacaccaatatagtacaaaaaagtatcaacaaaggggcagtataaataaaggggcagatagagactattctaagatcatttcattccacagtaaaatatttcactgagggacaagtcagaacagaatatgtagtaccccggagatcttgcagacttaattacacctgagtcaaagaaacaacaattattatgcattgactttattccacaccaagtgctaaatgttgctatgtttcatgtgtaacgaatagatagacggataattgatacttacatagatatacatagagctatagatgtgtgtgtgaatatatatatgtagcaggtatgtgtgtatatgtaatatatatacgtatatatattatttgtatatatatatttttttgagacggagttttactcttgttaccgaggctggagcacaatggtgcattctcggctcactgcaacctccgcctcccaggttcaagcgattctcctgcctcagcctcctgagtagttgagattacaggcatgcgccaccatgcctggctaattttttgtatttttagtagagacggggtttctccatgttggtcagcctggtctggaactcccaactttaggtgatcctcctgggattacaggcctgagccactgcacccggctttatatatattttaaaataacatggtaatagtaaaatttattgaacatttaaattgtaggccaactgctaaacatatttgatgcaccaccaccccctttaatcctcacatcaatttgatgaaggaagttctattattgacctaatgtataagtggagaaaaaaaaaatgaagctgagggaagtcaaggtatttcttcagccacacagctagtaagtaataaaacagtagctccaaatcaaatctaacatcaaacttcctacttaaaatctttataatactgccttgttcaactcaaaacatactttgcattacatttttgttttgcatgtctgtaattaatgtatgcatgtagaatttactcattatctgatccctctaggacattgttctgggtgttagcctatagtgagcaatggacatattaatagtgcttgaggctagcaaaatcagtacaaaccattctatttcatataaatttccttgcctacctggaatacctgaccactttttctatttcctaacatttttcttctttactccagccccactatactccctctgtattgcttattggaattatctatgcaaaacacaattctgactaggttacccctacataaatctttgatggcttacattaattgcatggaagtttgtaatttgccctacgggtatacagaggacaccaaagaataagaatgttgccttaggaatatgtatccagagaactctgtagggaaagtcacattaggaggtcattttaatattccaggtaaaaagggcttgaattctccctctgtgggaggcttgaaaataaacgagaatttgtaagtgaatgaataggtggtggtgggagtataaaaacatatggaggagttagaatgacatcaagattctgagcttgatcaattctattgaacaatttataatgccagtacataatcaagtcacacagataaggaatgtaggtttctgggagaataagtaagtttagtctgagatagatttattctgactttcaggagaaaatacccaacatttaaaaatatttgttggtgctcaggaaaggcagatgggaactggccacaaaacatgttgagagactcaataaaaccatggaaatgtttcaccaacgacaatttgtgctaggaaaaaagacaacagacctaaacttcaggaatatatgtgtttctctcacagagacaaaataaaggtagaaagaaagaagctagtgaaagagagaagaaaggatgatgcaataaaatagagtataatacaaatgatgttcaaagtttaaagtggggactgatatcacatgctaaagtaactctcaaaaaagacctttgggccaggtgctgtggctcacacctctagttgcagcactttgagaggctgaggcaggaagatcacttgaggctaggagttcaagaccagcctgggcaatatggcaagccctcatctctaccaaaagtacaaaaatcagccagacgtggcagtttgtgactatggtcccagttacttgggaggctaaggtgggatgatctgttgagcccgggagtactaggtgagctatgatcactctactgcactgtagcctgtgcagtagagtgaactctttctcagaaaaacaaaagcaaacaaacaacaacaacaacaaaactttgggttttgagacctttaaaggccaagttcagtatgatagaaacagaaatcataatccaaggcaaaccattttccagctttctctgtaattatgaggctatcctaaactctatatagtcctcaaattaaagtactaggtatcataatgaatattgattttggccataacaggaatgaagatgtgaacaacacagcttcatggacatgacatgagactgaaaccatggtggtctttagtagtagaaagaagagagtccatctagaggatgaggctgaaattagaaaacagagtctgattagtgaaatgaatttctcctttccaagtaaggtatctagatcctctagattttcttcttccagggaaatattctgccatatggaatatagtcagcattgtaaatattatgtcaaactagaaaaatttagagtctgcactctcacatcttgacctataagcttaaactaagtaaaccatttttatatcagccaggaaggtatacaatttctagaaatattttcttcattctttagaactaattttcatttcatatccttagaatttttttcaataaaatacaactattatcataataaaactagaaaccaatatactctttccataattctctaacatccagtgaaaaagtctcatgatggttaggctaaactgataattttcccattttaaaaaatgcagagagaagtaagaggataacaattctttctaagaaggctcactaattacctacgtgttgtgcagaagggctttagcacctgtgaattcatggcctcagttcctaggtgagctttctgcagtgttctgttttgtttttgttttgagtctaattcagtattttgggcaatttctagggctacagctggaatttctcccggtaaattctaacaagtcatcttctgctttttacagagcttttttaaagttcaagtcctcttcagctaactgcagtgtcagccttggttcaaattataaatgatgctgtatgagtctgtgtagagaggctcagattagatacaccttatctttcacaactttcttagaataccctcagacagtggactttcaatctattctacaagaagttgtttaaaatggtacccctggaagttatgtttgtggtgcctatagtctaagtgtagcctcagatgtgatcagagtaacttctgtatgccagagagatgttctgctcattccatgggacttaaggggcaagtatggagtagcactgtgcactttattcttgaatctgttggaagactaaatatttgagaacacattgatcacatagtgctctttgggtcggaaaagctaaaacaatgaaaaatattagctctttgtctaaatctattcatatccatagggacagggttaatggcttatgaaatggttaccataccccaataaagttcacactcctacaaatggcctcaagaccatttattatttggactctgtcatttttccagatttctctataattattaggctgtcgtaaactatatatatagtcctaaaagtatttcatgctcatttatgatatcatgtctttatatcatgttttctctgcctgctgggcaactgttcaataacccacgtctctctgactgtcttcctctccctgttactccctccctccttccctccttccctctctctctatctatctctatctccctctctctctccctccctccctctctccctccctccctctcttcctctctctctgtctctgtctttctgtctgtctctccctttgtctcatatgattcctttatttatttctggtgacatttcattacaactatttaaaacaatggctgaagccattccaagcacaccactgactttattagactataaactcattgagggcagatttcatgtcttttttatttctttattttagtttaataacctacctctaacatgtaagatcatagtcaacacttggtgaatgctggcgtgataagtgaattaataaaatatcctccagtaccacagtagccactaccctcaaaaagaattcccttatgacacctatgagaagaatgatttcttaggaggaacatacagagccatctttaacaattgcaatagagaatcaaatcatacaatttatgcagaaatacttcatcgattataaggcccccaaatagatgatagtcaaataattgctacattgaaaatgaatattaataactatgttgaatagaattaatgttaatatcaatacaaatgttaataaccattttaatgcagtaataatatttgtactcataattttgcatactattggtaatatcttacatatcatattcgatgtctgaagcaaactaagatacccccgaaaaatataggaaagttacctttttaaaaaaactgattttagatgtgatcctaagtgcagagagaagaaaactctctgactttcctttttaaatatagttctataattctagcaatatctctttattgatctccgtggcaataaaagtttcctatccgtttcatagtgtcattgggttgtaaacttaggatatagtgacagaatttatcaaaccaagcaacaaaacgtgttaagttttttgaaaatgtatgtgcaaatgttattctgtttgaattgccagtgcttaaagtgtctacccagtgccactgccataattcatgtcaaaatatccagcaaaaaaaaagttacctctttcagtcaggtttttaaagatcttgttttccaggcaattataagaaaaaaatgaaagtgtttatgtcacgcctcttaataggtggatgaatttagagaattgtctttcctagctcacaggaaattaaatagcattttcaaaggatcacatctgtcacaacagaataaccaaaaatgtgtctataaactgtcagtaaagagcatcacgaggtcatttatatcaattctgttttcataaacatagtaaatcatccacctaagaaatcacaaccattacagacttatttaaattataattcatggaatttttgaacagtcattaaattaccaaaataaaaaattgtataatgtctggtatggaactaggatgtttattaaagaaaatctctatgtctctgtgcaccaatatgcaagcaggcctagtaacttgacctctatttcctaaattccattataagaatactaacagttgccaaagctatcaatgtttccctatcctccatttatttaaaaccctcatgagaaatagaataaatgtgcttacctttagaaagattctgtggcaaaagttttattcatctaatttagtgatattgtgttttcgagagtttttttaaagttatttcttaagatgttataaaaatattttaattgatttacctcattttagaaatgaaaaaaaaaggctttgctcataaaatagaagctacaataaaatattattaccaacttgcacgatttttaaaaatgtcagacatttagattaaatttaaacattaatgacaatgctaataataattgataagatttattgagtgattattatgttctagacactcaggtgaatgttttgcatttaccttcatttgaacttcaaaaaatcctacaaattaggcattatttacatttctaaacatttgaacattaggaaactgtgcctgaaggaggtaaccaacttgctcaaagtagcatagttaaatggagatgaaacaaacatttatctttctttacctgactctgtgtctagatctcttaagaaactaaaagataaaatctcctaatgtttgtagatgttatgcatgtgattgatctctaaatcatctgaaccatcctgagattatgcttagtattctcacaatctctaattttgagatcagactattgaactgaaaaggatcatatatcctctttatggtcacacggctcagattactgaacttaacgtatgtaatatatctgatgtacatatgcacatttaggccatccttttttattttcaattgattatttttattttctcccaactcttattttagattcagtggtttatgtgcaggtttgttacctgggtacattgcatgatgctgaggtttgggttacgggtggtcccatcacccagttacttagcatggaacccagtagttagtttctcagccttccccccaaccccacttaatagtttctagtttctgtttttgccctctttgtatccacatgtacccattatttatctcgtacttacaggtgagaacgtgtggtatttgattttctgttcctgcattaatttgcttaggataatggcctccagctgcatccatgttgcttcaaagacatctttcattcttttttatagttatgtagtattccatagtatatgtgtaccatatttctttatccactccactgttgatgggcacctaggttgattccacgtctttgctattgtgaatagtgcttcagtgaacatgtgagtgcatgggtctttttggtagaactgtttgttttattttggttatatacccagtaatgagattgctgggtagaatggtaattctaagttctttgagaaatctctaaactactttcctcagtggctgaatggatttacattcccatcaacagtgtacaagttgttttcttttctcaaaagtctcgccaacatctgttgtttttgatattttagtaatagccattctgactggtgtgagatggtatttcattgtgattttgatttgcatttctctgatgattagtgatgtggagtacttcttccatatgtttattggctgcttgtttgtattcttttgagaaatgtctgttcatgtatttcactcatttttaatggggttatagattctgaatattaggcctttgtctgaggtgtagtatacagatattttctctgactctgtaggttttctactcttttgacagtttctttttttttgttgaggatttttagtttagttaggtgtaacttgtcaattttagcttatgttgcatttgcttttgaggacttaatcataaattctttcctgaggccagtgtccagaatggtgtttcataggttttcttttaggattcttatagctataggtcttacatttaagtctttaatctttcttgagttgttgtttgtatatggtgaaatgtagaggtccaatttcattcttctgcctatagctagacagttatcccagcatcatttattggttagtaaatcctttcctcattgcttaattttgtcaactttgttgaagatctgatggctgtggatgtgcagctttatttctgtgttctctattctgttccattggtctgattttgtaccagtaccatgctgtttggttaccatagccttatagtgtagtttgaagtcaagtactgtgatacctccagctttgttatttttgctcaggattgcttcggctatttgaatgtttttcttgttgttgttacatatgaattttagaatttttttttagttatgtgaaaaatgataccaatagtttgataggaatagtgttgaatctgtagattactttgggcagtgtgggcattttaatgatattgattcttctattccattaacatggaatatgtcttcatttttttttttttttttttttttgagacggagtctcgctctgtcgcccaggctggagtgcagtggcgcaatctcatctcactgcaaactgcgcctcccaggttcacgccattctctggcctcagcctcctgagtaggtaggactacaggcgccaaccaccaagcctggctaattttttttgcatttttagtacagacagggttccactgtattagccaggatggtctcaatctcctgacctcgtgatccgccagcctcagcctcccaaagtgttgggattacaggcgtgagccaccacacctggcccttcatttgtttatgtcatctggagatttctatcagcagtgttgcatagttctccttggagagatctttcaccttcttggttagatgtattccgaagtattttttgtaggtcatgctttcttaaaatctattcaacagtgtattcacacaaggctggtggtaaacttaagcacactgattatgccgatacaatgatacaaagagaagatgcatgccaactttcatgcatgactttcatttgaatttttttttccaataattcaagcaatatgtagtttcatattatgttgaggacttcatattggttttattatgtgtaggtaaaactcaaaatagtcctaattacaggtgatataaaataaatagaattcatgtaatttgactataaatattatcaggtcatacatgattaaggggaacatcaagactgtggaagtctcagtaatgaagtcgcagtaatgtaatttaacttggttttagcttctaaaataagcacaatccagcctattgtgattgttgtactcaccttaaaagaaggcttacctttagaaattagggatattcaaatattctactttacttcaaactattttctagcatcaaaaatttatacctactgttgttgtgagcataaactaaaataaattgaatacctagtaataagtatttttctaatttcacagttaaagtttagaagccaagctttaactgtaattcaaactttattatctgagctttcaaaatttaggaatactagaaatataaaatttataatcttaatctaattacatacaatattttttccagcataacttgtatgctatagtaaatatggataagactaaatgaatatttaaatacaaaacatacaaattaactgtcaacctaaccatgtttacaaccctggcatctctgcatcatatttaatatgatacttcctttcatgttgctaaatacatttcagcatgacaactagctaagggcaaataaaatttaataatacattcacttttacatgatcttttgaacttgaaactttgtccttgcccagggtccattgaaactcttcggccacaaagcgatatccttcatcttcgcttataacagatgttttttttccctggattctgacatggagacaaattaccatcttcctatataactataaaacagaattgcttttctcattcatggattatgtggactttgtaggcctgtctcatttccaaaatgcacagtattgtacaaaggagtagaaaaaacaacaaaacagccatgtatgctgtactaactcctatactaaaatctgactttgttgtctatttcttataaaattcaattaaaatatattttttatttagtttataaagtaattactgattaattattaattatatctaatttttcaaatggtaaatcactggtaaacaatgacaggaaaaacacaaggccaaccagtgattcatcatttacatttgaaaggatcttagtaagagaaaagcagctcattggatatttaattcttgcataaatataatagctcattagagaaactttcacctactaaaacctcatttaataaatgagatgatttttctcaatggcttaataaaggcatgtaaccttcattaatttacattaatgatgataaattgtgagaagtcgatctggggaagtgtatatatatgtgtgtgtttggttgagaggtggctttgattacactaaaaagtataaatagcaatctaggtcatcaacttgtattgctttattataaaatattaatcataataaactttagaaattaacattagctcaagcaaaaactgaggattagtttgctgttggccttctgttgtgttagagaaaataatatctatcctatttatggcctctctcctagtgaagagtaaaatagaaaatacgtgagttgctctttcttccgtcaaactggagcccaatataatgaaagagatggaaaaaagcagatgcttttctctccatagaaggacaaagtcaatgagagataatatagaatgggaagtagacaaactggttagtatagtcgtaggacacaatggagtagagattttcaggtaggaggatttgccagtcacgtcaaattcagctaatttgcagggaaaagggataaaggagcaacatttgtcaattaatagagcacggttgtatataaaagtagcacttccattacaggaatgaggtagaagtatctaggatgtgaggaagtgaatatatagtaagaaaccgggaacatcaagactgtgaaagtctcagtaatgtcatttacctgggttttggcttccaaaataagaacaattcagcctattgtaattaattgttgtactcatcttaaaagaaggcctacctttagaaattagggatattcaaatattctactttagttcaaactattttctagcacctaaaatttatagctactattgctgttgttagcctaaactaaaataagttgaatacctagcaatattaagaagcgttttcctactttcacagttaatgtttagaaagcaagctttaattgcaattcaaattgtatgatctgagctttcaaaaatttgcttctttggaagttaggcaacagatggatagtggaatttacagtaataagtcaagggggtatgaaggtacacagagtgaatcttgggcaggttgttttcttatccgtaattgaggaatgaaagtaatatttatgtcataagaaatatatggggaaagacatgtgagtctaatgcttgatccctgagtctgggatccggacttcgctcacggatgtatctcaagtgctttatatggtgtctggtgcatattgttaatgcatgatatataatagtatgaaaatgttaatattactgaagttaatgttattaatcttaagaatattatagtcacttatatacttgtttttttgtcttctactagtgaaagaaatccatttatccttctaccagatattaactgaacacttagaatgaaagagatactatcctgtagtaatactaacagtaatactaacagattactactccctttctgtgccttctcttcctgccactcactctctgctatcgtcctgccactcactctctgctatcgtcctgcaggtttttggcacgtaatattctaatcttaaccctctccatatcttatttgtgcaccctttttagatgatgtttttacccttggctgccaccttggacttgctatagcactgtagtcttccctcgattccacaaacccacttgcccattagggtcttgttttctcagctgcctggcatgctgattccttggatcttcctatgtttccctctttcaactcaggatctcggctctgataccattttcctcaaagagcccctccctgaactccctaagtaattcattttaaaaatcgacttcttttgataggtgtcatagtgaaattatttgcctcggagtttttggggatttgatattgcattaatgcattagcaaaccgatggaaaaagcaataaaatattttctgtgtttataatcactcacatataaatacatgaaagtgtacattcttctcttgaagcagttttcatataccacgattactgtttgtttccactaaaaggtataaaagcttcaaatactgagataatatttgtgaactgttaagaataaaaacaatcattggcatataataaaatgcattaaattaataagtggatatcagttacatgaagaggaatcagttgcctctgccttaatctatgtaacaaatattaacaaaacacctattttgtgacaggtactggagtaagcatcttccatctctttgtcttgagaccttgtattcattcaaggtttgcatcaaatgtcaacttttcttttgcatcctctctataacctccttccttctgtgcttcaatagcatcataccttgttatattgtagcaatttttatgcagaaaattttcatatgtcttcataagaatataaatgtctgaaagtttgggacgagatctttgaattctcaagaataaagaacagtcactgggacacaataaatgtatatcagattaacaaaaaaaatgccaggaatcagaagaggaattcaaatatatgtgtaatattatctatttttaaaatactatgaaaattataatactatagattttaatcaattttttttattttaccaggaaaaaatcatggcttataaaattattaacaaaatatatatattgaaatgaatatgttatgatataaaataactgccaaatgatatataaattaatgatataactacttgagaaatatattttaagtaatctaaacaattacttacaatgaagggaaaatatcagaatttttagataaaagtggctgagataaattatatttatctcatacttactgaaaatgtttcttctaaagtataaactaaaaagtgttattgcctaagccacatgcaactcttttacaggccattaattaatagtaatgtgtgatttgttaagtttattgcattttccacaactcattaaatttaggcttataagtagctgtaacctggtttggtttcacttgttttaattattttttgatgatttaagacactagccatatggattcaagttttttagtttttattttcctacaccataccatagtagaactattactgttgttatttatattttttaaaaaattcacttgtttttctcgagaatttgtgactgatttttatgttatactgcataattcagtaatttcacacattaacaacatccagggtcatgtgaggatgagttttctagcttctgaaatgttctgaggatgtaattttttaataagaggaaatgtgatctcacagactatttgggtgttttccaagtgacttgtcacgaatggttttgctctctagtgcacttctgagtacagaaaaccaataacccaaacttttttcccccagcactcagagaatttggggaatgacacaactcagtagttattttgaacattttctaaggtacagaatagtggtaacttctcctgggtatttagtattttttttccatttaaaataaaagcttttcttttattaattacttaccttgtgcttggaacattattagatacttatatattttaatttgcaatacaatctgcaagaaagccatttttattgtaatttgctgctgagaaaactgaggctgaaagaagtccaggttctttttcatggtgtggctaaagtcttctcaaaactcagggtatctgctatgcatggtagatttaagtttttgggacacttggtactaaaatatgcatcttgtgactccaagccacttaataacatctttagagctgaagtttaggaactagtgctaaaatgagtcaagtaaaattctactgttgtatgaatctgactcaggattacttatttgctattgtgaccattgtgaggaagtgttgcagggtgctggcacctgctggcttagcccatgggcgctaaggtcagactacatttcagcaccttgggcactcctcccttgtggtcatttctcttcactgagaggcacattatagtcagtacttaccaatccctcttcacccttcccacaacatctttgtatagataggtggtcacctgagagacagacatgcttgggttatttggaattgtatagatagttggaggtttttacaattttaggtgtgtggaaactatataagttaatgcagctgttcacatagactatattgaagaagtcttcaatcccaaagcattgtccagttatttagaagtaaacctggaattccagtcttgatctgagtgacttcaaagcttgtgtcctttcaactaatgctcttgtaaagaaagagcaataaacatgttgcatcttgcagtcaagatcactgttgtccagatttaagacctatctttcccacccttcatattgttttcttcttttcacataggaaagaagcagcataaggatttgttcttaagtaaacatgtatttattgagtacctactatgcgccagtaccatgctggattctatcataagaaccagagtgcatgaggtttctttggctgttgtgacagattatcacaaacgtagaggcttaaacaagagcaaatgtattatcttaaaattttgtttgtcattccaatacgggtcttgcagagcaaaagcaaggtgttggtgggactgcattccattatggaggctccaggagaaaatcaatgttcttagattttccagtttctggctgctgcccacatttcttagcttctgatctttttcttccatcttaaaagctagaaccatagcatctctctgactttgctcccatcatcacatctgtcctgactcttctgcctcccccttctacttttgagggcccttataattacattggcttcacttgtataatccagtagaatctctctattataaggtcaggtgattaacagacttagttacatattcaatgttaattcctttttccatgtagcctaacatagtcaaagatttgaggattcagatgtggacaacgttgaattgttttgcctactacctggaaaaacaggaaattgcccaggttgtgccagatatggtatacaagagacaaaaggcaagaagtgttctacataaaactggccaagcgcggtggctcacacctgtaatcccagctgtttgggaggctgagtcaggcggattacctgaggtcaggagttcgagaccagcctgaccaacatggagaaaccctgtgtctactaaaaatacaaaaaattagctgggcgtggtggcatatgcctataatcccagctactcgggaagatgaggcaggagaatcacttgaacccaggaggcggaggttgtgatgagctgagaacgtgccgctgcactccagcctgggcaacaagaacaaaactccatctcataaaaaaaaaaaaacaaaaaattgtattctacataaaacaatcagagaacaaagcattgtataagaaaatatgcaacaacaataacaataattgtaaacagagcttaagccaacatttgttgaaaatttgttgtatgccagttactgtgcttattgctttgtatacaatagttgttttaattttcaaaacaacttgtaaagataagccatcctcattttgtgttgataaagataaataggctaaggcttggccaaggtttcctgggtaacaagtaggaaaatgagatttaaacttaggtttctgatttcaaagactgtgctccatttcgcaaactattcatatagtaaaacagggtttagaacaaaatgatttcaagttggttcccaactttgaagagtgcatccagcatgttgtcaacaggaatatgctgaaagaggcgaaaagggagtgaatggaagtaggaagtggtaaacagcatggtgtgtagtaaggaagattgactgttggagagtgttggagtttgtgctgggaagtcagggagataaatactattaggaaaaatgagggcgttttagctggtctttaatctcttgagtctgcacattcatcagcaaataagaggggacacgtataggtttttaaatgatgaaaccatgttttaggtacattagtctgacagcagtgggaagaatgggaaagaaaagaagtagaacaagttttaaaatgctgacaggcaatagcagtgatttcaaacaccaattaagttggaacgttcagacccaagctcctgtgactggtaatcacccctacagtgtcttctgattcagccccacttattatatttatcaacgtctcaaaacttaatctttttaaaaaataaaactcgttttacctaataaaacattatgtttcagataactttaaaaggatcatttcctccgtagatttttgttaggtttaggtctttgaatgtttataaagtgttctcacatacattttcatacctgggcctgtgaatttggtgaagcacatagactcacatgggatacacagaggaaattaaaactccaagaaattgtgaattgtcaaaatcaagagtaacaatttcaatccagaactcatctcaaagatatggccctttgtgttatagattgttgggtagtagataaatatatataaaatttaacattttgaatatatcttacattaaagagaccctaacttttgtttatttttatgaaactggtataattttaaactgagattacttaagaattttagcaaacatgcaaatgacctcttcaactatccactgcctaaatgtcctttccatcacccaaacggcaatcatagtcacttctacttccgctgtatattgtaaatatatagcagaaacatactcatttcttcagattacacaccaaaaaacacagtcaccagctgcaactttctgacaggccaaaatatgaagaattgttaatatatgatcaattgatctggatcgagcagagtgcagcttactgtatgacatgttgcttttcatagacgttatctctgttcaatttgcttctgcatttaagatattaaattcagatctatgtggcaaagatgattagaaaaaggtaactcctcccttagggatctattttaaaatgtcaaaattaaaattttccagaaagttttgagcagttttagcctcctggctgatgcaatatattgagtagcactgttagcttaaggatgctgtctggaaatggaaatgctgatttacccttcccccctgccatgccacctaattaaaaggcaccactctcagtggtaggcacactaatacatgattttgctagtggaactgggaatagcataataaatgtgttgtgattgaggatatatgctgtgcctatatttggaaagaggaaaatgtttaattgctctttaaacaaatttgattgcacaaatgtagcatgaagaagaagaaagacgtgatttttttttaactgaaggcaaaaggtatactcattttacctccaggttgataattctcctgtgacagtgtgaaagtaattttgtccaaggaaaaaacaatggtttccaaacagccactgtcacttcactcttccactccttacacgttccaaccccactttaccatcaatatatttgacaataatataatataaataatagcaaggaagcttttctgttagagtaggccatgtatggatataaatgtcatttttatgtcataactagacatgataaaatataaataaactgatatagtatttaaacataatgacaaggtcacaaatacatctttttttactgtgtaagccaaccaaactaacaatttcaattataagtttagtcagaagtaaacattctaccatcaatggtagacatagacctctgggtcagaaaattaaatttacatttaaaatagcaatgttttccctagcttttctttgtaattacggacaatttgaaagctgccttaggaattaaaaaggcagtgatctcaccaaaaccttcatcatatttcccctctccttaaaggatgaaaacagaagtgagttatatgttaatctcatatactttggaagaggttcaatgattttgttacatttgagaggttttgtctgatttctcagacttttgagtttcatagcaataacatacattgaaagcgaatatatttatagccattatttaggttccatatggccgattgtatttcttgggaggcgtgacctaactatagttagagctagcatatattgccttaaaaacatgggaacactgggtaaaatgcctaatttatttgtaagtagcaatttactaataatagaatcaaaccaatcttagttattgaatttaagaaactacaaaatttcacagttacatgttattactattgttgatcccctgagagtagaactaagggaaatataatcactaagccctaggtaataaaatcagttcttgtagaaaatatgaccacaaaagagaattttcagtgtatagaaaaatattaagcgaaaattataaactagtagacatttaaataatcagagctctacaattttttaatgagcaatgaagattgattaaaatacagaccctggttaatataatcattattcagatgatcttaacattagtgagcctaatctggattgtttaaattgcaaataattgctgccttaattgctattaacttggaaaaaatgattttcttctttcaagattaatcatcaggctggtgttaacagctgtaatttggatcatgatgataacaaacacaaaggcagttctcttgaaactccaactatccagcatgtgtttaatgtcaggtactgggaaaacgtgatttatatacatttatggcttagaaaacaacaaaaggacataaagttgaagggaggaaaaatatgatgaatatttttgtggatccattgtcttttttctagcacagcttttgatttgtccacaaattttaaaaaagctggaaaaaatcctgctgaaatgtaaagttgattttgtcaccaagaagtctatgtttaaatgcctgatggtacaatgtttacttctgattaaatctagtgattgaaattattagtttggttggtttacacagtaacataatagatatagttctgatctagccatgatgcatattggctatatgcattctttatatatttatatataaatataatattgtaacaaatgccacattaatattgttaaatttattaaagaaaaacatagcccttagagaaaaataaatggaaacaatggttatgcacagtaaaacaaaacaacttttttaaaggacatatttatgaacactgtattctttattgaccattgcctgtcatctgcgggtcacaatagtagcaatacttttgaaatatatcaaacaaaacattttgttgtatccaaagtgtccacctgtttttataacaagtgattctaggattcatcacaaaattaacacattaatacactatgaaatgaaaaaaaatttgaaattggcttttgtttctttgctttactggaaatatattttgtggtgaattcatctgagttattttttacttccagaaagatgattaccatatgtattttatttataaatttcggttctgattccaaaaacacaatatttaatgaaaatgcatagaacaaagccttgagatgaaaagtctttaatattaaaatattaaacacctatgtggaaggaagtttcttgcctcattccctaaggacagcagttggctaaacaagtataagtgaaagaattacaattgaagataccctgcagaagagaaaagaaaagtcctgccacccggtactctgaagacaaaaatctgtatctgctagcaggagactttgtttgcaagacagcagaggtgattcctagaagccggactttctggtggaaatcatgatttttggtttcatctagtcttccaataacaagcaggttgagtcctgaaaaagcataagcacaagatggcattatatgagtaacatgtaccagtttctcaaaacatttcatttaaagatatctttacttttatgtctgacatactgtccttaatagcaatcttaacacttctgaattttaaattgttacatatttgagattatattttcataaatcatctaaaaaataagaataactctatatagctaaccaaccgtatactaatgaacaatgtggctgagactaataacatattttggtaacaggctgtgtccacttgatgtttatttcatttttacccttataaatgtaatacaagcaaaacagaccacaacaatttttattttttaatgaatcactattacaaacacttttgtaactgccacccaggcaggagctagaatttcggcgatagtttcagtagctgtgccacatcccaatctcagacctctctcactaaccatacataaccatgttcctgaatttaaattgttacttccttgagttaacttagtttgtattacccatgagttcattcctaaagtttgattttgcacattaaaaaaaaaatacgcctttttaaatggcagaaaatatttgaaaatgatgcctcaggataaataattagtattcagaatctataagaactcaacaagaaaaaaactaacaaccccattagaaacgggtcaaaagacatgactacacatttcacacacaaaaaaaggaataaagcagccaaccgataataaaattctcaatatcactaagcatcaaagaaatgcaaattaaaaccacactgtgatatcatcttaacaccagtcagaatggcttttattaagaggtcaacaaacaacagatattggcatggatgcagaaaaaacggaacactcatacactgttggtaggaatgtaaattcaatctttatggaaaacagtatggagatacctcaaagaactaaaaatagaactaccattcaatctagcagtcccactactggctatctacttaaaagaaacgaaattattatattaaaaatatatctgcactcatgtttatcatagcactgtttacaatagcaaaatcttgtagctaacctatatgtctatcaaaggttgaatggacaaagcaaaggtgatacatacatatcagcatggaacacaatgcagccataaaaaaagaatgatatcatatcctttgcagcaacatgaatggagttggaggccattatcctaagtgaactaactctgaagtagcaaatcaaatattgcacattctcacttataagtgggagctaaacaatgggtaaacatggacgtgaagatagaaagaataggctctgggaactctgaaagagggaggaaggaatggggatttgaaaaattacctaccaggtataatgttcactgggtaatggatacactagaagcccaatacctaccatttcacaatacatccatgtgacaaacaagcacatgtagctcccgaagctaaaattaaaataaaaaagatatgtctgtttaattcctattaatctgcagggtcttcctccgttcctttccttttcttaaactcatctgttgaaaacttaagttatttgactgaagaaatccccacagtctggattaggatttttctgattagacacacatggtttagagctcaacatgttgccagaattggtgtatttcccacacattggcagctggatccagaggcttgagcagactcaggttggagccctttgatgatggtgatgaattctttcctcaggagggaatatctagttgtgtttctttttgtgttgttagtagctattgacggataatacctacatccattaacacattaggtttgcaagttggtgatattctaatctatcatttatctttttatttgttagttggaatacttttaaaaggaaatacatcttcgtaatctgctattaaactacctaatggtagatgccataaagaaaagatatatgcttgattcatcccctttgtcagttccaagtcaacaaattgaattatttgaagatgaacaatttacttgataaaaaagtaatttatggatttaaatacattgatagatttgcagttcaataacttgcaatcattattcttttggaagctcaatttttttccttttggccatgggagtcccttcaagtaggctcctggagccgttcacaatgaccctaatagtctgtgccagcttcctctcagtgtgctgtgacaagccacaaagttaaaattcatcatttcttctagaaggtctagtttctttggttgggaaatggtgtttgaagaacacagattactggaggtgctcattgctgtagcgttagtaagaatcaaatatatcaaattatactgatacatataacccaaattgaggattatagttttcttaatcttttctgaacatctgtatccctttacctccacactgaaaatctttgttctaacagttaccaggaatgacagaatagatctctcctaattattctttaacttcatctcacatacacacgtgaatctcagaaaaataatacttcgatcagtgaaaagtaattactgagaatttttcttttcatacgttggtatgatttttatttagttcatagatttgtttgaatctgtttatcataactgggaagttgattattaaaacactcttcatacttaaagtggagcaaaataacaagttatcaattttctttcatttgctttttttctatatgctcctgttattaccactgaataatataggaagctcataaattttcccatagcactaaggtattaaaaattataaaatgtggatgatatgtgtacattcgtagttctgtgtgcactgtattcttttatatagctcctggaaaacttcagcttcctcagatatacctccctaatctctcatattattttgtacagtcctaaagcattccatacccaaacactcgacacatttgtggtaactctttccaaattgtcttgctaaaagtctgtacactctggtgtaccttttttaaaggatatatatatatgaaatacataatagacaatacacatttgcaaaataaatgactcaatgaataaatcagccttcccatattttacataagtgttaaaaatattgacttaattgtataagcactgttatataaggtcatttttgtagtgatttttcacaccataaaaggaaatcacaaaagttcaacagatttttatatgctttaattaacactctaaccctggagagttagaagaactctccaggctggacattgataatttaatactagcacaaaattaggaataatgagtgaaatactacatatcatctcctgctgaaaggcatcaaataagctttctcatttttttccagttttgtgatgcatagttgctactgtctagaatactctgtaactttcactgagctgagctatccctatgccatgcgaccaacatccgtaaggaaactcctcacatttccttatggatggttgttcaggacctgcatctggaaccccatggcttcaaatgttaggccctttttcctaatctgttactgctaacctctgtttctggctttttgcactgtccgctaactatacctttgtactgatatatgcccctgatatctggaaattgatgttctagtcttgatcccaggctcccctcattggttaactgtgttcccttcctacactgcattctccctttgttccaggcaatgcatgagccctatttagcttctttctcatgatccagccgcactatatgtacctggagttgatgttgcattaaggagtacagtggggggtatggtctgaatacatgtacatttattgtactataacacatgaggcattcaagtttcttggtcgagttatcaaatgaataaatgatctttcagagactgccacagaagcatgaataacatagtataaaaattagcatcattttagaacttagcaaactttcttacatgtattatgtcaatgcccctaaaccttgtagcaatcctgaacaaggcagattattcagttttacacttaatgaggctcagatatattaagtgattttctaagttcacactgaatttaggtgagagaatatgattgaactccatcaccttattgctatactaaatgataaatttcattcttgcatcaccaattgtgtaatagtgaccaaacttcttaacttttgtgtgcctcagtttcttttattcttttattcttttaaatgattttctctgtagaagtgagttatctatgtaaattgcttttaaattctagggagaaaaaaagagctgtaggagtgataattagatgccatgatatagatggttttaaatggagttgaaaggttcatggaataaaattctttccatattttcattaatatggatttttaataccctttggaaattaactttaaaagtgttttccatctttgtgaaaaagaaactttatttccattgactataaaattctttataatagaacatgctccagttttatgaaaccccgtaggataaatagtggcttaaatacaccggcagacagatctatctttaattgaactactcagccagatcccattgggagtaaaaatctagtctttcaaagacattggaaattttgtttctgaattcaggtccagtatatcaacagtgacatatgcaagtaggaactggttctgctcatttactctgcctttgaaatttaccaaaaccacattcttggctcctaagtgacagagataagtctctttctatggatcccacagcattaaaaaatctaaacacaaggtaaatttatatctgcatttccaatcaaccattcagatttagtggatttttaagtttatttcttcataatctttagtttaaaaaaaaaataaggaaagtgctgttttaacatgtagaaagggtaattttaacataacagtcttaattgcttaaaattacatgctgtagtaatatacaatactgtgcagctttatacagtactatatctgcatttgcattataggttttcaatcatatgttaagctttcctcataactattaaatctgttcatattgcctattgactttgtaaataatgcataagttttccatgtcagtataataccaatttatttcaccattcactatcaaaagtttttaaaatattcaccacattctcatcttccagtttattgctttgaagggtaggattctgtgagagtgcatggtaatgaacttcatattaagcagtctacttcaatacagtctgccttaattattacttattaagacaccccacaagtttcacaccagctattttctgttaaatatgtagcatacattataactgtaccaaaaaatgatggcatctggaattgtagagcagaaagaaagtttgagattatttcttttaaccttcttattttagaggcaaatgaagttagatctaggaaattaagtcttttctaacatgacagaattgactgttgagagccctggaatcagagtcaaatgtcttggctcccattcttaccttctttttgctttttcttttacactacttcttctgtgtgttttgtcataaaagatatataagttgactttactttgatgaagggaaagctactaatggcatgtgagagaaggactgaagtggggataaatagttattgtacaacttacaattttttcaaattctgaacaacagtgcaaggtagtgatggcatgtgcaataggtgtcatgcacattgtaaaaaaaactacaggtaaaataccattaaaaaacacactctaagaagcaaagcctttctgtcattaatcagtactttggttttgattatttaagatgatacctctggctcacgcctgtaattccagcactttcagaggcccaggcaggcggatcacgaggtcaagagattgagaccaccctggccaacatggtgaaaccccgtctctactagaaatccaaaaattagccgggcgtggtggcgcgtgcctgtagtcccgctactagggaggctgaggcaggggaatcacttgaaccccggaggcagaggttgcagtgagccgagattgggccaatgcactccagcctggcgacagagcgagactccgtctcaaaaaaaataattaataattttttttaaaaaaagatgatactcccaaaaggttctggtgaagatacatgttttgttttttgtttttgtttttctcttgagacggagtctggctctgtcgctcgcgctggagtacagtggtacgatctgatctctgctcactgccacctctgcctcccgggtccaggcgattctcctgcctcagcctcccgattagctgggattacaagcgcgtaccactacgcccagttaatttttgtatttctagtagagatggggtttcaccatgttggccgggctggtctcgaactcttgacatcaggtgatccacccacctcggcctcccaaagtgctgggattacaggcgtgatccaccgtgcctggccagtgaagataatttctggtaagttagtgggaaaaggaaagacctcacaaaatcaaagagtaagggaagccttaaaaagtagaaagggaaaaataaataaacaaaactgcatgaaagcttctcttccctgtcattataaaattaattttttcttagttactgatgatatatatcaccggaccagatagtacacattggtagcttttggaaaaacttggcattttgaaattggacagaacaggtaaacatagaagctcccaaaactatgcagagaatgaaatgctacaggtttaagaaacttctatcgatgttacttctgtctacatcatacctagtgcgaactgtgtttgagtttgggttttttttctgatttgtttcattttgtttttaactgtggctcctaaattttaaaacactgctagctaccgtttattgagttcgtttatgggcagtcctatgtcaaatagtattaacactttattccatgcaatgcttacgacaacttttacacaagctgcttgaaattatataggtttgcaaattatataaaagaaagagattaagaaactggcctaagatcgagagtgtgtggaaactgggatttgactttagtaggtctagcaagaagtctatgtccttaacaactccatagtcctcctgcacactcattttcaggagaagcagtatttatttattaaaatacttttcctccttaaggacaaaaatgtcaacaaaaacaaaattcattgcagtctgtgagaatatctttcaaagtgaggtgggtttccctactagccaaccaggtttttctccccgttcactattcttgaactaatgccagattgaagaagtaaactgtatatagttacatattacattttccctcacatgcatagcgtgtgttcattaatattttgcatatgatcaatgaggcaattgaaaacattttatatcatggaaaatcatgaaaatataaatggacaataaatagcattcatgttgccattgctctgtgtccctcttttcctctcacaataaatgttttgtaattcacagagtggtacatggctaacagttgcttatgcaataatactcatagaataagaaatagtactcatagaataagaaaatagtactcatagaatcagaaaagtaaatacaaatatgaaagagaataactgtttctactccattcattttttttcactcgtggttaatgaaatagaacaaaacaggactggcactgtaaatgaccaactggcgattaaaataagcttcaaaagtttttcggagttgatgaaatccttatttcatgccacaagcagctcccaagagactaatgtttgatgtgcttgctcaattttacaaatacaattgaaattgaaggtgtataaaaaatctgtagacaccaacattttctgtaatactatgaattgcttttgtcctttgcaaaatgttattctctggccttgacaaaaaataatttgtttaaatcaccttctcagtggagaatttcaaggatattattatacaacagtagggtaatagaattgtcatctctatttaggtgtaggaaatattattttggagatagtaaaaactcacctctaccacttcaaccatctatttgtgaggaagcacagggaaatgttatgacttttttaatatttaaaaaaattgtctctctttgaaataaaacttataaagtgtacctaaaaattgtcatggttcattagaagctatccactgagaaaattaaggctaactatggagatagtaattgactttaagagttgcaaactagtttcaattaaaactggcagcaattatttagcacacatctatgatttattggaaattcagacagattgtgcagtagcattaatagaggtatgtttctggattggtacaggtatgatgagtgagatttttttctgtgctgcaggcagtctaggaacaagagctgctggaggacacatttgatctacatactacacactcttgtgaaatacaaaccacagtacatggtttcacaggataggaaacagtttttaagttttgacagttgaattataatgattatacaaaataaaatgcctactcccaacttttgtaaattatagccagaacggagaatgtttttagttccttatgaaatgatttatgtaagtgatatttatgattttacatggggaatgtatggtacatttcctgagaaaagtcactttgattctacattagttatgctttttaaaaattcattgaagtccactattatgaattacagcatcattgttctcatatcagtagcatacaatatgtcaaaagggatttaagggctatttaaacattttaaaaacttgagtcctcaggtagtatatagtgataacaatgttgttatttttaaaataaaataaagggggggagctggcttagtaagtgctgcgtataaactaaatctgccctgaggcaatgattttttactggtacagaagctgctagtgctgggttttcggtcattactatgatttgtagcaaagctagctctccctccagccgtgtatcgcagagcttgcagtttattcagccgactactatctgagagttgcacagtattgtctgataacattctatagcttccaagtaagttactcctatctcatcttgttcatcacagtagatcacagtcttagctattactgttgatcaaatatagcactgaatttaccactactctgctgagcctgaatggggacaacagaagcctgacagataagctcagatagtgtagtttagcactgaaattgtggagaggcatataacctgacacaaagccatctcagcctattttagcaaagatgactgagggactgtgaagctaaaaggcaaaatgctaataaagtcttctgctgaaaataagtttaattgtaaaataatacatagataacacccttaatggtcatggtttatattttatatatgagttttcatcagtaagtgatctagatactcttgtgaagctctcctgttaaaagacttatggttttcataaaagataactattgctggacttgcatgaagtgggatgaatttataagagcacactcactgccagcctatgcacccacccctccaaagaaaaatttttgctaaaaatgaactttgagcagtaaacacccaataaaagagatttggtttaaaagtagacgctgaagtcagttatacattcagtagcctcaagcaagaaccagcagtaaaacattctgagtaaatctgaacacaattttgagaacaagagatctctaaatcactcattttttatttttttaatttaatttttgtgggtacatagtaggtgtatgtgtttatggggtacatgagatatactgatacagacataaaatgcctaataatcatatcatataaaatgaggttatccatcccctttagcatttatcttttgtgttaaaaacaatccaattatatatttttagttatttttaaaatgtgcaattcaattattattcgctatagttagcctgtcgtgctatcaaatagtaagtcttattcattctttctgactactttttttgtgcccattaaccattcccatgtcctctttattccccccacctccattcccagcatctggtaaccatctttgtactctctatcttcatgatttcaattgttttgagttttagatcctacaaataagtgagagcacatgatgtttgtctttctgtgcctggcttatttcacttaacataacaacctctagttccatccatgttgttgcaaatgaaataatctcattcttttttcttttgtggctgaatagtaccccgttgtgtataagtaccacattttcttcattcatctattgatggacacttaggttgctttcaaatcttggctattccaaacagtgctgcaacaaacatcggagtgcagatgtcactttgacatactgatttcttttgggtgtataccaagcagtgggattgttggatcatatggtagctcagtttttagtttttttgaggaacctccaaactgttctccgtagtggctgtactaatttacatttccaccaacagtgtatgagggtccccttttctccctatccttgccggcattcgttatctcctgtcttttggatataagccgttttaacaggggtgagatgatatctcattgtagttttgacttggatttctctgatgagcaatgatgttgagcacctattcatacgcctgttagaaagtcaatttctaaatggaatgattggcatgggcctggcttccttgttaacatgctcatggtgtttactggcagaaagattatgaagagtccctattaaacaaaacaaaacaaaacagtgaaaacaaaaatcccctaatcactcaggatactcctggcctgtcttgataacctattatgtatgaacctggagtttatgtatttataaagtatggctgtctggagagtgagaaaagtcactatcttctatctgttgaattaaatagaaaccaggagagccccaaaactaaatcagctttctttaagaacagcatgtccacacccttttcagactcactatatgttaatcaaaaacaaagcaagtcctgttacagaagataagatattagaagccacgtcttctgcaactcatacttttccagaaaggaatgttaattttctgcatgatattgcttctaccttttaaatcactggtaaaaattcatattggggaatatgtacaattaaagtgattctgttttcacctttagtgttcaaacaagttggaaggtagctgtaacggcccccaaacagaagcacccctgaatcctgagaagcaaatggaagtgctccctggaggaaagatcctgaatctatattcagaaattctatatagacctcagaaattctaaaagttaacatgaactatatatgaaataacaatcaaacatcatcattcataaaggaaaatgttacaacaaatagtaaaagatcaaagagaaaaaatattagatttgtaccctgaaaactaaaataatataatttgtagatacggaatataacataactatgtatgaaatgtttgaagaaaatagtaatttaataaaaataaacaagaactaagacattatccaaattgaccaaagagatttgaaaaataatcaaatataacttttaaaatgaaatatgtttactgaaatatttaaagagtagaatagacattgttgaagcagaagagaacggaaataatagtgaaagaacaaatatttaaagatgcagtggctgagaattctccaaaactcataagaattatgattccacagatattgtaggtacgtatatactgagcaacatgaataataatgaaatccacagttagacacattatagtgaaactgtagaacatatattacagagatgttaaaaacagtaagaaggctgggcacggtggctcacgcctgtaatcccagcactttgggaggttgaggcaggtggatcgcctgaagtcaggaattcaagaacagcctgaccaaaatggtgaaaccccatctctactaaaactacagaaattagctgggtgtgatggcatgtgcttgtagtcccagctactcggttggctgaggcagaagaattgcttgaaccagggaggcagaggttgcagtcagccgatgtagtaccactgcactccaccctcagcgacagagcgacaccccatctcaaaacaaacaaaacagggagaaaaatccaggcgtggtggctcacacctgtaatgacagcactctgggggggtgaggagagtgtatcaccttagcccaggagtttgagaccagcctgtgcaacatggcacaatcctgtctctacaaaaaatacaaagatagcagggcatggtggcatgtgcctatagtcctagctactgggggcgctcaggtgggagagccgtttgagccagggaggtcgagtttccagcaagctgtgatcatgctgctgcactccagcctgggcaagagggcaagatcctgtctcaaaataaaaaaaagaaaaagaaagaaagaaaagagagaaaacaaaagcagtgagaaaagacaaagctgcctacacaataatgacaagtaaactattcagcagcaaccaaagaaaccacacaacttggtgataaagtcctcaaagtgatgaacaaaaaaatagctgtcaacttagaattgtgtcttcagaaaaataatctgtcaaaaatgttatttacaaaattgtaaataagcaaaactgagagtttacaaccaataattataccctcaaggaaggattaaaatttttatctcaggcaaaaataatcctaacaggaacgttttaagatgcagtaagaaatgcttagcaagatattggtgaattgactatccagccaaatacgcatcactgcacataataataacatttttgtagttaataacgtagatatctctagaaagtttggtgagtaataaagagataagacaaaaaatatattaagaatgagaaaaacggcacaactccaagtgtaatagagaattgaaagaagataccatgaatacatttggcaatgaaattgaaaatgttgcaaaaagtcctccaaaagtaaaattttccaaaactgattcaagaggaaattaaagcttaactagaactttgaacattaaaaaattaatcattaacttaaaacatttctacagagaaaatactaatccatttttattgtaaatcaattccatcaaacttgcaaggaaaagatcactaggaaaatgtgtatctacattaaaaaattaagtttatattcaaatataatctctgataactttgagaattaaatgtaaaagtcaaaactataaaacatttagataaaacatatagaaatatctttatgatcttgaactagggaaaactaagatgtttcactgtaatatattcacatattcagttgcattcatattaataactcttatttaaaattcagcataaaaatgtacatactaaaatctgaggaaaaagatctggacatatataactgacaagtgattagtaatcaaaatatataaaggacttctacaaattaaaatatgtgtaagtatgtatatattttatgaaatagtcaatgcatattaataggtatttacctaagggaaaacccatggtaaaacataaatatgctcaaacctaataaatagaaagattcaaagtaagtccatattttataccatttgatgtctaataagtagtcaaaaatgttgaaatttcataatatcaagtattagagaggtgtgggttaagaattcataaacagttgcttgtaaaaacatttgggaaaaccatataccatgagacatataaaagactgttcttagcaggatcggttgtcttaacaaaaatactagtaatgacgctagtgggtatcaatagaaacatggattaaaaaaatacagtacattcagaaaatgaaatatgttaatatgttacagcagtgaaaactaatgaatccaaatgcacgcaatagcatgaagaacccttaaacatagcattgagtgcaagcaagttgcaacctacttcatttttctaaaattcaaatgtaaacaatatattttgtgataagcatatgtgaggaaacttcttttttttaaaaaaggatctataagcgcttatctcaaaatattaggagaggggcaggaggaatataaaagataggaagaaacgagaatacaaaagaccgattatactagtcaggttctgtttcttaaatactgtggctggttcattggtattcattaagttttccataactcaggattatgttacatacatgattttgatgataatattatataattattgtgtggttaaaacattaaatattttatttctttatgttcatgtgagttggacatgcatctgcactttctctcatcctgctttccctaaggcagtcaataacataactgccaagatttccaccgtggttttgaccaatgatgtggtctctgctaatgagacctgagggagaataattcataaagattggcagagatggtaattttttgtaaatgtgaactgagatttataagtcctttaaaactattatttcagcagtaaggaagtgttacataatcattaagaacatggtcaaataaattttatgggatttctagctctgtaatttactagctgaatgtcctagtgtattagtcagggttctctagagggacagaacttataggatagatgtatatatgaaggggagtttattaaggagtattgactcacacaatcacaaggtgaagtcccacaataggccatctgcaaactgagcaaggaagccagtccaagtctcaaaacctcaaaagtaggaaagctgacagtgcagcctttagtctggtctgtggccgaaggcctgaaagcccctggcaaatcactggtgtaagtacacgagtcgaaaagctgaagaacttggagtctgatgtttgagatcaggaagcgtccagcacaggagaaagatgaaactgaaagactaagcaagtgtagttcttccagcttcttccgcctacttcactctagcctagccatgctggtagctcattagttgatgtccacctagattgagggtgggtctgcctctcccagtccactcactcaaatgttaatctcctttggcaacaccctcacagacacacccaggaacaatactttgcatccttcaatccagtcaagttgacactcagtattaaccatcacacctagggagtgttatttatttcctaattctcggttatctcctgttcacaatagcttctacatcataaggctacttttagaactaaaagaggtaatacgtatatagcactgaacacagtccctggcacatatttatgctcattatatgttacgaatcattatcatcgttccatgcacttatctgtcatataagaggtagatgcttactcttctattttcctgaattgctaaggagaagggatgtacagccacagtgcaagcaagttgcaacccacctcacttttacaaaattcaaatgtaaagaatatatattttatgataagcatatgtgacctgaaatgttttcatttttctttgcaattaatactacttgacaaagttgaaatgttgatactactctaacaatatgttaacttagatgactgaaaagagcacagagactcagatgttaaactgtgattgacagtcaactgacaacaggaagtgcctaataagcctatggtactagtgacaacatggcagggtaccatcggggaaacatctggggcatcaagaaagagagctgaaacaggcttatttttatttctaagatcagaaagcctgaagctgaatcacatttgttaggcattgattcattcttggtagtgagctgtcagcaatgggcaacatcccaggaaagaaaacctctgtggcaataacagagagataaagaaaggaaatattaacaggacattatcctcagtgctctcaaaaaatcaaaatcctgagaggtgaggaattacggaacagttgagcttacatactctagtgtaagctggacctgagtttgacacattactgcgtgacgcagggcaaatttaatttctctaagtttacattatgtcatttactaaatgaggaaaatgctcacagttttgagttgtcaagaggaagaattcgtataaaatgcttaacattgtcattagcaaaagggagggttcagttatttaattttcattattgccatcacttaccatcatcatcatcatcataatcatgattaactgacatccgtagaattttacaagtatagagagcaggcaaaatgaaatttgttatccagcaacgatccttattatttaacaaattgagagaataaatagatattgtctaaaatgtcatacaaacatacatatatgggcattgtcataacctgcatatattacatttcctaaaataagaaagactggatgttgtcagcatgggcttatgtcacattctggttcctttctccagagcaggtgtgtgtgtgtgtgtgtgtgtgtgtgtgtgtgtgtgtgtgtgtgtgtgtgtgtgtgtgtgtgtgtatatatatctctccatcatatatatgaaatgtgataattatgagaaagtaaaatacagtattctataaatagtgacacataaaatagattatatagtcctctgtaccattaaaaaaaagtccaacaagctcaaaacattatgtgttatgttgaaaaattccactagacattcttttttttttttttttttcttttgagattgagtttcactcttgttgcccaggctggagtgcagtggtgcaatcttggcttactacatcctctgcctcctgggttcgagcgattctcctgcctcagcctcccgagtagctgggattacaggtgcccactgccacgtccagctaatttttaaaatatttttaatagatactgggtttcaccatcttggccagctgggcaggctggtctcgatctcctgacctcaggtgatctgcctgccttggtctcccagagtgctgggattagaagcatgagccaccatgcctggtctagacattcttatacttccaaaatactattgaggtgtttttgctacagaaaataacttatctaaaaattatttttaaaaattatattctacatactgatttattttatcttcacctcgataagatcacctttttcattgtcacaaaaaggactacaattagagatcttagttaatcacatatgttttctcatagtgcttatttgtcatggaccaaataaattattactcatggacaggaaatcagaaacttatgttgggtttcccctcaatgggcaatatatttgacatgaagaattgaataaaaaagcaataaagtggaagaatgtatgaaagttctcagaaacaacaacaacattccacagtggtgggatatgtcaacaggagccaattgaaagagctcacaatggcagaagctagaacaatgagaaacaaaagaaagtaatattgaattataacacaaaatataaaatatctatgaatcatactgaagtatatatatctcagtatataaagaaatatattccttctctctcttccttatatatatatatcagtatcaattcatagatacttattttatattttgtgtaatattggattatatataagatatattcaatgttgaatatgtacatatgtattcaataatgtaagtctatatacatatatgactgaaacatacatgtatgtatacatacatatatgattgaaatagacatgtgtgtgtgtatatatacatatatgattgaaagaattactaaaaggagagaatagacaaatttcccattcagagttccaaataatttttgaagatactccgccctcatggagacaaaaaccaaaccacccactgcttaagtgtggcatgtacttagagatttccttccaaagaatcagcacggaaaaagggaaaaggaataattttatagaggggaagcctggcaaacacaatctcgactaagggataaaaatcaacatcaacatgtcatggtgataatatgaatcctggataagctgtgtttgaaatggcactttacctctgtgatctttctctctcaaaccaatatccccagtaagataatgggggaaaaaaatcagaccattgccaattgagggacattttgcaaaataactgaccaaaactgcaaataaaagggaagtatgagaaactgtcacaaccaagagaagctgaaaaagacatgacaacaatgtaatatggtcttctggatgggatttgaacagaccagaaaaaatacattaggtcaaaacttaggaaatctgaataaattgtatactttagttaataacaatatataaaattggttgattattgtgacaagtctgccatatttatgtaagataagggaatctggatgtgggtatatggggactttctttactagcttctcaatttctcttacagtctcaaaccattctaaaatgaaaagtttattttttattattttttgatgtcccaatatctttttattattattattatattttaagttctggggcactagttcagaacgtgcagatttgttacataggtatacacgtgccatggtggtttgctgcacccatcaacccatcatctacattaggtatttctcctaatgctatgcctcccctaggcccccaccccccaacaggcccaggtatgtaatgttcccctctctgtgtccatgtgttctcattgctcaactcccacttatgagtgagaacaggcagtgtttggttttctgttcttgtgttagtttgctgagaatgatggtttccagcttcattcatgtccctgcaaaggacatgaactcatccttttttatggctgcgtggtattccttggtgtttatgtgccacattttcttaatccagtctatcattgatgggcatttgggttggttcgaagtctttgctattgtgaatagtgctgcaataaacatacatgtgcatatgtctttttagtacaatgatttataatcctctgggtatatacccagtaatgggattgctgggtcaagtggtatttctagttctagatccttgaggaatcaccacactgtcttccacaatggttgaactaatttacactcccaacaacagtgtaaaagcatttctatctctccacatcctctccagcatctgtcgtttcctgactttttaatgatcgtcattctaactggcctgagatggtatctaatagtggttttgatttgcatttctctaatgtaatgatgagcttttcttcgtatgtttgttggccacataaatatcttctcttgacaagtatctgttcatatccttcgcccactttttgatggggttgtttgctttttttctcgtaaatttgttaagttctttgtaaattctggatattagccctttgtcagaaggatagattgcaaaaattttctttcattctgtaggttgcctgttcactctaatgacagtttcttttgctctgcagaagctctttagtttaattagatcccgtttgtcaattttggcttttgttgccattgcttttggtgttttagtcatgaagtctttgcccatacctatgtcctgaatggtatcacctaggttttcttgaaggatttttatggttttaggtcttacatttaagtctttaatccatcgtgagttaatttttgtataaggtgtaaggaaggggtccagtttcagttttctgcatatggctagccagttttcccaacacattttttaaaatagggaatcctttccccattgcttgtttttgtcaggtttgtcaaagatcaaatggttttagatgtgcagtgttgtttctgaggcctctgttccgttccattggtctatatatctgtgttggtaccagtaccatgctgtttttgttactgtagccttgtagtatagtttaaagtcaggtagccttgaggcctccagctttgttctttttgcttaggattgccttggctatgtgggctcttttttggttccatatgaagtttaaagtagttttttctaattctgtgaagaaagtcaatggtagcctgatggggacagcattgaatctataaataagtttgggcagtatggccattttcacgatattgattcttcctatccatgagcatgaaatgaagcaatataactcctaaatatattgcatgagcattaagtgctctatttggaggaagaatagaatcttttcagctgggagtctcagcaaatgtttccaggaaagattgaggactgagatcaacactgaaatataaaaattaaccactccacaggaatttttcatttagtaggaaaattccagaacatgaaaatgcctttacatcaaaaaggtccacttttaaattttacagtggcatctccaatatgaacaaagaatatcagtgtcattttcttccccaactatgtatcaagacactcttataacaccctaaaaaagcacatgttcttatttgtcattactatcatttaaataaatctgattattattttgagcaaataataggtggacaacttggactaccacatcatgaaagatttttaaatttgttatctgctctcttgctaaaccttaagaaactttagaaaaaaaagtttgcgttcagatagtaattcaataatgtattaatttattagacaaatgtttgttgagcacccactaaatggcagacaggatttcagacacagaaagcacaataatacctaaagcactgcagtctctcacaagctgatgcctctgtgttcatggcaaggatactgcaggaaggatgtagtgagttgtgggcaaagaaaaaaaatcagatcctttttgatttctatttaggttgaatttgattgtctccaattcaatgataatatggtaacatatgttctgataataaaattagcaccattctatccattccttcacattaagctaaccaacatcacattgtctttatctatctatatatgtgtgtatatattaacataagcatatttatatattttgtcatatatttggctagagcaaataatatatagtttttaaaaaattatctggctttgcatagtttaatcatttggggctaaggatcaagagagagagtgagagatagcatttctctttgttttctgatgtttgtgcagctgttgccactgccttgccagggttttttttttccaaaagggagctactggtatccttaatgccagctggtggcattcttttattaagcaagatgaaaataaaattatctcttcctgctgttgctatagtgactgctgtacttaccatctcccgttcccacctagtaggtggtatataggtttttctggagccaaatatattgctcatggtggcatagttcacatttcaacctggtgcttcatttgtccacagactgttccttgtttatgatgcaaatgatctttctcgtcctcactttctaagaagcaaggtttaagttcaatactattaatctctgttaaatgtaaaggcttataaagacaccagagtcctaaatgtgatgtgaatagttctggataaccaaaacctaaataaacaactggagagtttcaaattttataggtttttttttcacaagctatttttgtttaccacctgcaaaaatctaactacaactgaaaaaaaaaaattcccagtatattatgacaggtaccagcagcaaaaaaaaaaaaaaccaaaaaacaaaaaacaaaaacaaaaacaaaaaaaacaaaaccaagcaaaacaaacaaacaaaaaaaccatgaattcacagcagttagatcaataaattttgagaactaaatatttataaacagacaaaaatagggaaatgacttttggttagctgttccttggaaagttttttcaccttactaataaaatatcaatgattatgcagaaaaacaagtgctagctatgataattttgaaatccaaagtcaaattggagaggatttatataaaatgtaagttacgtggttttggatttagaaacatctaaattttaccttatgaagaagattagctctgcttactgaaaaaacataggaagacatattgtccttcctcatggcataccatcaccatcagtgctactgcccaaagtcaccagagtatttttcttgacatgccccaagcatttacaataatttgtagttagcacttcctataaatatataaggcagaaatcaggtaggcctagaaaaggcacatcgcatttgaattatataaccccagtggataaagtgctaaaggtagggcataaggatattaagaaccttggtagcatcagataatagaattgtgatttttgctgctccccatcagttcagtgtcagtactaggcatccaagaggggacaatgtctcaccttagtccagcagagctgtcctagataaatgtctgctagacctgggaatttgaaaagggctagtcaatattgacattccctatagttagttaccatagaagaagacttgatctgtacagtaagtgaaatgaaaacttctcataccctatctggtggcaaatgtcaaatgaagagatatctcctcaagagacagttaagaggtttcagttcaagatggctggctagacccagatagtgccatgcctttctcatggaaaggaaacaaaataacaagtgaatactaacacttcaagtggattatctaagagatcactttgtgattcaccagggaagtgacaggacccacatagagcagagaggaatgaagccatgaagctgaacattaacccacccagaactggtatggagccgaggaaagctccctaagttgggaaagtgagtgggggaagagtgagtgagtaagagtctcccctggggatcacacttctgccatggacttttgtagttcagctcttgactccctcgggcttccagaacagcagagagctatgtggagtctgtgcagaggcactgctcaagcccacatggaaccaaccccacaagcttttggttttctagcagcccggttccagcagccactgccccactgagaaaggagacacagcatttttccgtgtccctagaatagatggcgcatccatagtactaagaagcagctagactccatactgcgtaagtccttgcctctgcagctccttagtaggtgggactcactggcttgggtccccagcacagcctccctgaatttcctgaacactgcagtcatggctctgtttctctgagtgcataactcccagaggtagctaacaggcccttcactatcactgctgccttcactcctcctgtccccaagccagggagggaacaaggaggtggggcacatttgtggacctccagtatggatgtcatagctgacatatggaggaatagtggtaggcttgtgccccacaagtccctgccttcactgctctctgccaaacagggcttgctgcctttcggcccataacacacttactcatcccctggctgatcactgcggtcatggctctgtgttctgagtacataccttccagaagtagctgataggccctctgtgatcacagctgctgctgtctctgcacatgctgctcccagattgagagagactgaagagatgggtcactttcatgtacctccagcatgggactccatagctgagatacagaggagtagcaggcacgtgatgtaccccacaacttcccacctctgttgttccctgccaaacagaactcactgacttccaatctccaatgcagcctttccacccctgcctgatccctacaatcatgggttattcctctaagagcccagtttcctgaggccagcaacaaatattcacaattgttgcttccattgattctgcccctaccacccccaggccagttcaggagcaagaaggcttctcacctttgcatgcttcaaacaatgaaatttagaactccttgtgtgggagggaggttcaagcacacaacatgccccatagctgtcagctgccactgtcccagctgagggttcctgctcttccaatgaagggcccacgtcacagctgccctgccccagcctgaatatttaagctttgacccagagccctgttaaaaacataaaccccacaggcctctgatattcccttgggatcccaccacctaagcattctgcctgccctgacctgaaagttctgccagtgacccgggtaccagcccatccctccccatcatagcgagcatctgaactagactagaccaagtggaagaaagaacttcaatgcgtaaaaactgttcttttgaactagcccagtcagttgcaaataaagaaaaaaatttaaaaaacaaaacctttgagaaataagagattatgtaatgtaactaaacctacaagttattggaattcctaagagagaaaaagaaaaagtaaacaacctggaaaacatttgagaggataaataattaaaaaatattgctagaggtagatattcggatatgaggaaaccagagaacacctatgagataatatacaagataaacattactgaggcatttggttactagactatccaaggttggtgctaaagaaaaaatgttaaaggcggctagagaaaaggttcaaatcatctacaaaggaaaaccaatcagactaacagtggacttctcagcagagaccttacaagccaaaagaggttggtgttgtatttttagcctcctttaaaaaaaaaatgtcagctaagaattttatattactacaaactaagcttcataaatgaaggagaaatactctttcccagacaagcaattactgagacaatttgtcaccactagaccagtcctacaagaaatgctcaaaggaattctaaatgtggaaactaaaggatgatacttggcatcagaaaatgacagatatatacagaactcacagaccctataaagcaactgcgtaattaaaactccaaaacaactagctaacaacactatgtcaggaataaaaacttacatatcaatattaatcttgaatctaaatgacctacataccccacttaaaacatgtagtggcaaattggataaataaataagatctaatgatctgctgtcttcaggagacctatctcacatgtaatgacatccataggctcaaagtaaatggttggagaaatatctgtcacacaaattgaaaacaagaaaaagcaggttgaacaacagcatcaagtcagaaatcaaaataaaaagtttaatgaaaatagcaacataacatacaaaacctcctgaatacagtgaaggcattgctaagaggaaattttatagcattaaatgcctacataaaaaatagaaaaatcttcagctggaaatgtaatgctgcatctcaaagaataagaaaaacaagaacaaatcaaacctaaatgtagcagaagaaaaaatactagagcagaactaaatgagtttgaggccaaaaaatgatacaaaggatcaatgaaataaaaggttggttctttgaaaggataaaggaaattgatagaatgctagctagcctaaggaaaaaaaagagagaagattcaaataagtacaattggaaatgattaaggtgacatcacaactgataccagaaaaacaaaaaaagatcatcagagactagtatgatcaccttgatgtacacaaactagaaaacctgaagacgtaagataaatagcatagttcctgcttcaataagctcacttattcattcactcaatcactgcttctttcaacaaatataaattaaatgcctattatattctagacacaggcactgatgatacagcagtgagaaacaatgaatttgccttttgaagaacactaattgttttcattcattttgttatttaaagaatattcctagaaattatgtattttcattgtgtggtgactaccgtgatttttttttcattttacaatttctgctttatgaaatcttactactttttatctttattctaatgattctctgagtttagcagatatagaaacataacattcccaagtaatgttaaatttatatctcttttaaacaattttatatcctgtatttttctcatttcacctattctactgaattacttagaatttcaagatcaacgtaaagttgcttctttagtggaaatgcctctaatgtttctctattaagtataatatttgtttcaagttagatagaattaatgaaactaagctgttgagatcttaatttggttctcagcttgaacattattagcgtatggaagtgctactgacttttgtatgttgatttttgtatcctgagactttactgaagtcactaatcaggtctaggaatcttctagaagagtctttagggttttctaggtaaacaatcatatcttcagtgaacagagataatttgacatcctttttcccaatttggatgccttttatttctttctcttacgtgatagctctgtttgggacttccagtattatattgaatagaattagttaaagtagccatccttgtcttttcccagttcttagtgaaaatggtttcaacttttccctgttcaatctgatgttgcctgtagtttgtcatgcatggctcttattattttgaagtatgttccatctatgctagtttgttgagggtatttattatgaagagatgttggattttatccagtactgttttttgcatctattgagatgatcatatagttttcattcttatatctgtttatgtggtggatcatgtttattgatttatgtatattgagccatccttgcatcccttgagcgaagcacatttgatcatggcaaattatctttatgatgtattgttggattcagtttgctagtgttttgttgaggagttttgcattgatgttaatcagaaatattgacctataattccttttttattgtcattttgtccttccctgattttggtatcatggtgatacaggatttgtagagtgagttaggaagacattccttctccttgattttttggaatagttttagtaaggttggtaccggcttttctttgtacatctggtaaaatttggctttgaattcatgtggtactaggctttctttttgttaggagattttttcttattactgattcaatttcattactcattgttggtctattcagggtttctatttcttcctagttcaatcctggaagtttgtatgtttacaggactttatccatttcctctaggtgttctagcttgcgttcataaaggtcatcatactagtctctgtatcggttgtgatgtcatcttgatcatttctgattctacttatttgagtcttctctctttttttttcttagcccaactagcgttctatgaattttctttatcctttcaaagaaccaaacttttacttcattaattctttttatctttttttttttggcctcaacctcatttagttctgctgtaatatttgttacttttttctgctacctttcatttgttcttgtttttctagttctttgagatgcaccactaggtttctaattaaaaatcttatattttttgtgtttactgatttatgtatattgagccatccttgcatctctggaaaaaaaacacatttgatcatggtggattatctttttgatgtatttctggattcagtttgatagtattttgttgaagatttaatgctataaactttaatgctataaacattcctcttaccattgcctttgctgtatcccagaggtttttgtatgttacatttctactttcattcattaattttttttttatttctgacttgatgttgttgtttaacatgatcttttttgttttcaatttatgtaatagatatttctacaaccctttactttgaacctatggatgtcattacatgcaatgtgggtatcttgaagaggtcaaatgattagatcttatttatttatccaatttgccactatatgttttaagtggggtatttaggttatttacattcaagattgatattgatacatgatgttttgttcctgacatagtgttgttagctagttgttttggagtttcaaataatttatttacatcttaatactccctttttttcatcactctgtttcccagctagcctcatacatgtctctaaagctttatatgttactatatctttatggtcaaaagatctctacagtgattcagaatgtcggctctggcatcagacatcctacttggaattttgcctctattatttactaattgtgtaacattgggcaaggtacatagcttctctgagcttcagtttctcacaaaagtgtctaactaaaaggatattttaataagaaatgaattaaaacacacatatataaatattcattgtatagtgtgtggcaggtagtgagtattcagtaaatggtagctatcatcatcaccatcttgtctccattgtcaatactttttaaatgttttgggtgagatgacattagaactataaactggtaagattttctgagaacttcttttggtcatacattttctattttttttttcttgaaatggagtctcactttgttggtcaggctggagtgcagcggcacgatcttggctcactgccacctctgcctactgggttcaaatggttctcccacctcagtctctcaagtagctaggattacaggtgtgcaccaccatgccctgctaattttttgtgtatttttaatagaggtgggtttcaccatggtgaccaggctagtctcgaactcctgacctcaagtgacctgcccactttggcctcccaaagtgctgtgattacaggcacgagccaccatgcctgacctggtcatacattttctattcatgagcatagaatggtttatttttttctaaatctaaattcagctcaccactgagatttattcattcaggaatatctattaagtacctaatatggtgcttggcacatatgcatgcaattaatattagtttaataaaggaaaaagctgtgaattaaaaaagaaaactgaactgttatttggtatacatggtgctagatgctggatacaaggatacatatgctacctttttatgttatttaataatggctgtcatttattaagggttcagtgtaagttaaggtctgtttttggataaaatgcaagcgttatcccctgacaatcattttgaggtaggtattgttattcctgttacacaagtaaggaaattgaggtttatctaaggttacatggttaataagtggaagagatgtaattcaaatccatgtctttctgattctagaggtcaagcttttatacattgcagatgtgtaaataacttgacctcccaccacaatgacatgaactggcaatacggaaaagtcattgactttctaatagtagaagattagtaaccttttctactcctgctaattttagtgaaccagagcgtggatctactcctctgtttttgtacagcccgcaagctaaggagtttttttttttttttttaacatttttaaatgtttgaaaaatccgaaagaataacacttcatcacatgttaaaatcatataacagtacctacattataccctcaattttgccttttgccttgcaaagcttcaagtatttactaagtgaccctttctagaaaacatctgcctaaccttgaactagactatttgggatgcccttcagtaatgtgagtaatgcttatgccatagttgatttacagaaaaaaatgtatcactagtaaatagacatattagtcctacacagtttctggaactgttttcttacacttcagtgcaaaagagctagagcaacaacaaaacagaagcaaaaatcaaaagactactagtacattgggctgatgcttcatgtaaaaatgagattcattctctcaagaattaatttatataattaatgaaaaattccacacaaaagtaacctgttaaaaataaatgattttaaatacccttttaaatgtgcagacaataaactgaatccttccttaaacttgagtattacccaaagattattttacatactagttgagcctaaatgaagatcacaaattaaaactttctgaaataattaaaagataggaaagaaagaattgggccaaggacggggagcagatttgctttaaggcaaggcatgaagtttttagccaagatgtaagataagttgaaaattgatcactagtcaactgagttatgaaatgaaacagcttccaacgattttttaaattaaacatggtataaattattcagatagaactgttgagtttatagcttataagagaaaaaatgcaaatctatgttacttgattaaactatacaacagcaaatgagctaagggaatcaagaaagcaagcaatttacttcttcaggtacttgatcaggaggccaggactattgtgagtgctctgcaatacacgaatgaagttgaaaacaaatttggcagagcaaaacactcaagcacacatatgcgaacagcataagaattcctgtaaagggctgtttagatttttactttggttatggtataaccataaccaaaaccgtaaccatagtataatcatggttataccataaccaaactaaaaattcaaaacagtcctttacaggaattcttatgcagtttgggactggattggatttgcaaagggaaaaaaaaactatttctttatgaaaatgcagttatcaggttgaaaagcataatgttatactcacagtcaaactgtcttaaaaatctactcaccagttaattatgtttttctcattggatatgtggaaaagaaataactgtgtcatctagaggggctgttctaagtagagtctagtggaggcaaaaattgcctgaggagttgaaagaaacatagcagagggaaatttctagtagataataactgccatcacccttggtcagaggaacaccgttagctttaaaactatggtagtttccaagaaactctaaatataatttttttagagagaatattttcaaactattcatctgacaaaggattaatatccagaatatccaaggaactgaaataactcaatagcagaaaaacaaataatctgatttacaaatgggcaaatgagctgaatagatacctatcaaaacaagacatgcaaatgggcaccagataaaagtattcaacatcataatcatcagggaaattcaaatcagaccacaatgagacatcatgtcatcccagttagaatggctgttataaaaaaggcaaatataacagatgctggtgaggatgtagagaaaggggaactctttttaatgatatttttgttttcttttattgcttgcaaatattgtatatagttctatcatcatatatagataattttgtatcttatatatgctttttattatacgttaagttcttgaatacatgtacagaatgtgcaggtttgtaacataggtatacacttgctatggtggtttcctgcacccatcaactcatcatctacattaggtatttctcctaatgctatcgctcccctagcacccaacccccctccccaagcccggacaggtcccagtgtgtgatgttcccctccccgtgtccgtgtgttctcattgttcaacttccacttacgagtgagaacctgtggtgtttggttttctgttcctgtgttagtttgctgagagtgatggtttccagcttcatccatgtccctgcaaaggacatgaactcatccttttttacggctgcatagtattccatggggtatatgtgccacattttctgtatccagtctatcattgatgggcatttgagctagttccaagtctttgctactgtgaatagtgctgcagtaaacatacatgtacatgtgtctttatagtagaatgatatataatccttttggtatatacccagtaatgcgattgctgggtcaaatggtatttctggttctagatccctcaggaattgccacactgtcttccacaatggttgaactaatttacactcccaccaacagtgtaaaagcattccaatttctccacatcctctgtagcacctgttgtttcctgaccttttagtgattgccattctaaatggcatgagatggtatctctttgtggttttgatttgcgtttctctaatgaccagcaatgatgagattttcttcatatgtttgtcggctgcataaatgtcttcttttgcaaagtgtctgtgcatatccttcacccactttttgatgggtttgtctgttcttttcttgtaaattagtttaagttctttgtagattcttgatgttggccctttatcagacagatagattgcaaaaatatccctttctgtaggttgtctgttcagtctgatgatagtttcttttgctgtgcagaagctctttagtttaattagatctcatttgtcaattttggcttttgttgtcattgcttttggtgttttagtcatgaagtctttgcccatgcctatgtcccgaatggtattgcctaggttttcttcaagggtttttgtggttttaggtcttacgtttaagtctttaatccaacttgagttaatttttgtataaggtgtaaggaaggggtccagtttcagttttctgcatatggctagccagttttgcaaatagcgtttattaaatagaaaattctttccccatggcttgtttttgtcaggtttctcaaagaccagatggttgtagatgtgtggcattataattgaggcctctgttgtgttccactggtctatatatccgttttggtaccagtaccatgctgttttggttactgtagccttgtagtatagtttaaagtagggtagcatgatgcctccagctttgttcttttttcttaggattgtctttgctgtacgggctcttttttggttccatatgaaatttaaagtaattttttctaaatgtgtgaagaaagttaatggtatcttgatggggatatcattgaatctacacattactttgggcactatggccattttcatgatattgattcttcctatccatgagcatggacgccttttccatttgtttgtgtcctctgttatttccttgagcagtagtttgcagttttccttgaaacggtccttcacatcccttgtgagatatgttcctaggtattttattctctttgtagcaatcgtgaatggaagttcactcatcatttggctctctgtttgtctgttattggtgtataggaatgcttgtgatttttgcacattgattttgtatcctgagagtttgctgaagttgcttattaaggagattttgggctgagacgatagggtttgctatatatacagtcgtgtctcctgcaaacagagacaatttgacttcctctctgcctattcgaatgctctttatttcttcctcatgcctgattgccctctctagaacttccaatatcatgttgaataggagtggtgagagagggcatccttgtcttgtgccggttttcaaagggaatgcttccaccttttgcccattcagtatgatactggctgtgggtttttcataaatagctcttattattttgagataagttccatcagtacctagcttattgagagtttttagcatgaaggggtggggtgttgaattttgttgaaggtcgtttttgcatctattgaggtaatcatgtggtttttgtcactagttctgtttatgtgatggattatgtttattgatttgcatatgttgaaccagccttgaataccagggatgaagctgatctgataagctggtggtggataagctttttgatgtgctgctggatttggtttgccaatgttttattgaggatttccacattgatgttcattaggaatattgggctgaaatttctttttttgttgtgtctctaccaggttttggtatcaggatgatgctgccctcataaaatgagttagagaggagtccctcttttctactttttggaatagtttcagaaggaatggtaccagctcctctttgtaccactggtagaattcggctgtgaatccatctgatcctgggcttttttttggttggtaggctattaattactgcctcaatttcagagtttgttactggtctattcagaggtttgacttctttcttctttagtcttggaagggtgtatatgtccagattttctagtttatttgcatagaggtgtttatagtattctctgatggtagtttgtatttctgtgggatcagtggtgatatccactttgccattttttattgtgtctatttgattcttctctcttttcttctttattaatctggctagtggtctattttgttaatcttttcaaaaaaacagctcctagattcattgaggtttttgaagggttttttgtgtctgtatctccttcagttctgttctgatgttagttatttcttgtcttctgctagcttttgaatttgtttgcttttgcttctctagttcttttaattgtgatgttagagtgtcaactttagatctttccagctttctcctgtgggcatttagtgatattgatagaaataaatttgatttttaacattaggcagagtatccttgaattcatacaatatagaagagtaggcatttaggtatagtgctacttatgctacagctcttcaaactgcagagcaccgtcaggaggttggggtgggtatttttacattatagtcttttctatattcttcaaataaggaacaaaactatgttgtccagttgcctattattttccaaaaagtgtatcctggaatcttagaataatcccctttattgttacgtcttgtaatacaaagattggggctgtatacatatattattaaaaatatttttactttatttaaaaatatatcttttattatatgtcaaacactataaaaggctttaaaatgtaattaattatgatgtgaatataaagtcttctaatgtataatttaatagatatatatgacacattttctcaactgtaatggaagaatattcatttcagcaacttttttctatgttaggtttctgagataaatcatgctaaaattacagaaagttgtaaagttgtaaataagtgggatgaatttttatactgataacattgttttgctcttagagtatcaaatcaattatcaaaatataacatattttacttgctattcattgtaataatgggtattaggaaaattctttcataaatgtgaacctacccattgaactaagttcgaaattataggtaatataaaattacacgttgaaaattgttctgaactgacagtcataggctgtgagttaaaatcatgaagtttttagcatctagagatgtagtcccagtgtgaaaaactatcttgcttcaggctaaatctggctatacaagtgtttttgtttttttacacttgcagtgtaagagcagaataggcagatagtccaatttaacaaaggctgaagttgtgccaggggaataaaatgaagggagaaaggggtaaggagtcatagtagtaggcaagaaagtaattatataaggaaatattatgaaataactgaagagggtagttaagcgtgaaagcttgagagacaatttaatacatctgcaagttataagaattgctatactaaacgattttctggttttactatgacatccttttctcatcataatggatttgtagtactcaaactctctgtgtatgttgtatttatcctttcacatttttctttttaatgcttagctttaaaatttcctaagatttttagtcaattaagactgatctgaatttggaaaaaaatgaacttagaagtaaacaaattaggattattatataattgtttatgtagatgttagaaattttatcaaatgtataaaacctctgccagagttcatagactatattcacattaaacacactgatatacaactttttcattgtagattagttatcatttgtattattcagtgttgaagtagctttttgtaacacatgaaatacaggagaaaagacctaagatcaaaaatatttttatcacattctgtggacagtttatcatttcacaaaagcatttgcaatttactgtttcacttatgatgtaattaaaagtgtctttttcaagggaagcatatgctggttttctttggtttcttttttataatccctttggaggactgattaatgtctgataatatgtaaagtgaaaatggcaagccatagcaagagattactcatctgacctgttatatataaccagagaaaaaacggggctaatgaaagtttcattacaatttgtcattatctttacagattttccttcctctttctccagctgaatcttaattcaattcttatcttcatataatggatgttagtatattttttgagatacctataattagctcaactgatattttggagagacagtttttattaaaagttaacatttcctaaaggtgatatgttgtcccattcataggtgactgataacaaatatttaaaagaattatagcattatcaaatcaaaaccacaatgagataccatctcacaccagttagaatggtgatcattaaaaaatcaggaaacaacaggtgctggagaggatgtggagaaataggaacacttttacactgttggtgggactgtaaaccacttcaaccattgtggaagtcagtgtggcgattcctcagggatctagaagtagaaataccatttgactcaaccatcccattactgggtatatacccaaaggattataaaacatgctgctctaaagacatatacacacgttatgtttattgaggcactattcacaatagcaaagacttggaaccaagccaaatgtccaacaatgatagactggattaagaaaatgtggcacatataaaccatggaatactatgcagccataaaaagtatgagttcatgtcctttgtaaggacatggatgaagctggaagccatcattctcagcaaactatcacaaggacaaaaaacgaaacatcgcatgttctcactcataggtgggaattgaacaatgagaacacatggacacaggaaggggaacatcacacaccggggcctgttgtggggtggggggagaggggagggatagcattaggagatatacctaatattaaatgacgagttactgggtgcagcacaccaacatggcacatgtatacatatgtaacaaacctgcacgttgtgcacatgtaccctaaaacttaaagtataataataataaaaaaagaattgtagcattatatcatgtggtgtaataggaaagtatttaatcaaataattttattgattaaaaacattgtaaaccaagagtatcataatagctctagatttttaaatgctaatttcaaagctgaattagtcactttgaaaactcaaatcttttctgctgtgagttcttattcttgttacctaattttagtgaatgtcagtgtcctaatcataaatggacataataagccctcccatatctgtttacaagttgatcacagacccacaagtttacatttgccaataaaataccaaaaaccttcatttttctatggcttttctgtcaaggtaccattcaacactcacatttttattttaagaactattattaagaatcttatttgctctagagtgtgttatggtagccattctgtgcagacaaatgactatgtattagagaatgctaatttaatttttttctcaaaacatgtgtaagaactgctttttctattcttcctcagaaactggtctttaataagatgtccttattgaagattattttaaaattcctaaaattagtgtggtttaacttccaaacattgaattgcttttgtcctggtatagtttttaaaactttagaatcaatcacattgactttgatttgccaactctattaaatatatgactgcagtgaattttttacttgcttttcacatagaaaaacaggaattagtatctacttccaggaagcctggcatagagtaggtatgttagtagctagtgtaactattttcattcatttccttttctctcttttctcttttctaaacatttagaaggtcaaaaatagtttgtgaatgaagtttgactaatttttattatagggtatttgcatggaatgcaaaaaaatttacagtgacctgaataatcctgatgatagtaacaggaacaatgaatacagccaatggaagacttcaatatgcaatcactttgcaagtgaggcagcaaataccaagtcagtattacaaaacttgtccgttgtttttacagaagtcatagaaattaaagttgaaggcctctcatgttgagaagccagctcagttccttaatctttcatataatatatatgacactcaaatgtaattaatgaaactttataaaatttgtctctgacacttagtctaatataatttgccttttcaatggtctttttgtaaaaagtcaaaatctcaattttataaaaaattttaaaatttgcattaaatcgtatctgtgttcacagcacttttagagaattaattgagaatccttggagcactgatagtctaaaactcattagggccacctacaggataaatgtatagccacgaatacctcagtattggcactccattcctcttcctttttccaaacacacctcctataagctcaacattgccacttattcagaacagacttaagactgggaaacataagtccaggagacaaatcaaccacagcgttttacttctaattgtatagcttttattctcctgtcttgagccttttcctcactcctccccaataactaaaccaagctattatatttaacatacgtaagatacaagatcagtgtccagaatctcttatgtactatctcttttgatagtttcaggtactctatttccctccaacactttaaaataatgctttttagggaataatttttgaaatatttttcaggtgtttgtgtgtgggtacatatagctcacattctacctactcaacatgtctcaggaggttaaaaaaaaaaaaaagaaaaataactttctgagtagtttgccaagtttctctgccaactctattaccacgtgttatctttatgaagtctatgaagtctttcaggagaaatccccttaggattgggtatatctctaccttgttttggctcctcttaagtttagagtcaaatttgtagccaacttccaataatttacaacaatatatagtgtatattcctaaatacttgttttgccctgcagccttctcaccatgcttattttgtcttcacctagaattcctcaactattgttttatttgtttacttattattattgaggcagatacatattttaagctacctcaaatactttgtggaacaatacagggatgaaaagagtaactgaagaatgtcaagaaggaaggaagacaaggcaaaaaggaagaggaagaggaaggaagggagggaaagggaagaaaaaaggaaggaaataaaggaaaaatctaaagtctgtgtgtatgtgtgttcatgtattaatagctcccatttagagaaatagtgtgaagtgctacatggtaaatgttcatggtatgtttttggtcactcatgagtgtggctgtgacaagctgagctttgaggatttgggcttatatacctatttggtgacccagactcctgtgagctatgaaaagttggcccaagtaggtatgattaattcatttatatatgtatatcctttacagtttttctgcataaccagtacctaacacagtttttaatatatagtatgcattgaataaatatttgttaaataaattcataaaatggttcattttacatctgatcaatatggctcaaatctcatatcccaagtctacactccatcatctaaagctcttaataacatctattattgtatgtttttcatagttttttttttttttcgtagttcttctaggatgaataggtgcagtaattctccaagctacagttctagttacagctcttcttttaaaccctgtgtgagcttcttaactcagaaaaagaaaggtcagagcaaagacaaagtctagggccctgtgacttttgatcacaaaatttctcatcttgtttcttaagttgagtatttgtaaatgtgccttatagtaagtccagaaagatatttatttcagtgtgtaatttgaacctgaattttagagtcttcgtattgtgatttttatttttactcccttttattcctgtaaaggtataaaatagaacacacgaacatgtatttttgaccttgtgtaattgcaataaaacaattcaagccaatatctataaaagcacttggtcttttttccatttatcttcttggtacatgtaacgtgtcatctattaaaataacatgatagacactgaacctgcacatacatccaccgaagtatttcaaagttctctgattaaatacctccaaagaaattaactcctttctcttcttagtgagagatgaacaaacagttaaattttcactcaggctattcagtctaaccaccatccccatcaaccaagaatttttttacataaaccattctgccttagatcaaccatcatcttgcttggtacagggaccacttttacattgtagataataatgtttcacttttctttatggtaggaaagagttaagtgagaaatgtacataccccatgaaagtacagacttctttttagtatttatatgtcttcaagaaagaaaaaaaaaatctactcacaatataaaaaaatctatttatctttgggcttctggtgctaaagttcccaggaaataatgacacagagacaattctatgaggaaatgttgaattttgcttgtattaaaagctggtacaaaataaagcaattggagtgaagtatcatcttttgggtcattgggatctcaaaacacaatttaggtcatagttattctataattttcttttctttgtgtgtttaatttctagggcatgcctgtacttcaattcctcagaaataggcattaatttaggactgttttctattaatcttgtaaatacaataggttgatttgaaatgtcacaaaaataagcataatataaacttgtagtaaatggattgaaatggatatttatgttttagagaccattttaaaaattcagttaaaataaattgatatcccaatgaccttccagaatttgtagattcgatgaagatgaaaagaggaaagtgaaaccacataatccctagagatattaaaatcaagcatggtggctttcccctataatcccagtactttgggaaacagaggccagaggattgcttgagaccagtgttggcaacatagcgagactctgtctctacgaagaatttgaaaaattagctgagtatattggcatgtatctgtagtcccagctactcgggaggctgagactggaggatttcttgaccccaggatttacagactgcagtgagttatgatcacatcctgcactccagcctgggcaacagagggaggaggctctcaaaatatacattaaagtcctgccacaaccactgcctaactatcttgtattgtatttctaggagtaaagtaaaaggaagtcaaattagaaatcttgccatgctttgatttcatattaagatcattttttggaaaaaaaagcctctaagaatcagtccttttgagtttaaagccatgatttgcatatatttgtttgtttgttacagacaatcatgtgtatgttgtattatctcatacatatgaaattcaaaaagagacaagcataatatttggtaatagaaatcagagcagtaaccttgtaggtacatatatttgaaaatgactgccttgatttttactgctactgaagttagtgtatatatttttaaagtaacaatcccccagaaaagtagaactagaattgctctttttcttttgtcctgctactttatgaaaagcttaactgtttataaagaaacattgaattttgtataaaatcttaaacacattctgcaataatgaatacttctctgtttctttatttggtgtcatgtcttcactacttattagacccccatgattttggatgtgtttaagaagatttggttatacattcagcaaaataattagtaaattcttacccatctcaaaaatataatgtatagaatttttcttagattgttatagactagtaatttatctccttcatatccactagtgtattttcttgagtgttcagtttatttgtcaaattaatattaaatttgaagctctaccttgtattgctacaaagcatattattttagcatgaaataattaaaatatattttaaaaatctattttacaatttgtgcctaatggaagaaatggcagaacatttctaagaagcatttcttatcatggaaacatgatttacagacccagaattctgggacagtttatttataaaaatattgaactcctaccatttgcaataaagtagtctaaaagttgtcttattgatcaacctatcccaggaaaaaggaaaggagcgtaagtactgagatataaatagtttaataagcaataatagaattacaatttaaattacacatcattcccttttggaccattttctttttaggaaaatcttttcaaattgtgtaaatgcaacatagtttaagggaaggccattgatctccaatactataatcccttttacatagaagtgaatatttcgttaactaatactcccagactaatcaaaatggatgagagtagttaattcacagagcccattctaggctttcataaaatgaaagtcacataactttcttattcacatttatagaaaaagaatgctttttctatttttactatattttgttagagcatacaagcctctctaatttggcatgctcatgcttggttttacacatcattcttagcctgacatataatgaagaagccggtgggacaccaagtcctctaaccagttctgtttctcttttcactatgagagaatgggcgttattggtagtagaaatatcactacgtaggaaatattataaaaaatgactctttgtgttaaaaatgctatactccctagcatctatactggcaacttgaatggactgtaaataaaaataaagagtgtggtttttctatgggtggtatagatttatttccattgtggtatttaaaattagatgatgtagatatatgttaaagccttcttgtcactgattaacaaacaaaagacaccttgtgaagataacgatagaaagtaagtacaagttacaatcatagcaattctttacattcttttctgccttggatctaaatgttttattatgttgacagatctgggaaattttagtggccggacaagaagtgcagtctctgtgagggaaggccagggtgtcgttctgatgtgctctcctccgccacattcaccaggtacagtaggatctcattctttgctgctgctgctgctctcttttgctatgtgttcattcttttagacagtatattgatgggagaacatttcaggtgaaatgtgcatggttttcttgacatctatcagagtgccagatgagtaattcaagatcacgtactctaaatatcattagacaggatactgaactccaataagattgttttattgccattctaactgttaactgtcactgttatgcctctgtcttccatcagtgaagaatatattgcctagagcacaaaggaagcgataaactgagagaatgaaaacttttcaaaatagtttggagtatcagagttgagttaactgaataccaatatgcgtcttgtttcaaaagataaactggatacttagttgtttatggtgctctttgccacactggaattagaacttctaagaaatgctttttttgagtttcaaacaaaactgcaatttagttagtactttttggctctttgaggtcttgtttgtaaaagtcatggtgagtactttatgtggcttgaggaagcagaaaactaagctctgctcagattaattatacgtccttttgcaagcttacacctaattatatctattttgtttgagtttcataatttgagatgagtactcctttggaacttagtatagctttactataagttaagagtgaccagcatcagttaaagagagagagaaagagaaagagcacaaggaagaaccaaggaatgaaggccttaattaacaactggtaacagaattgaaggtcttggtatgtcagtaattttttcttctttaattagagtgatggccatatttgtttctaggttatattatcagggtagtaatggagcacaatttggctctactgtacatatttttttaataacaaaatggcctacattgattttcttaagacttctttatctttatctgatcccccttctatatttttaatcgaaagtatgctgcatatcaacagggacatatttttgaaaacacttttatttgaaactcagataataattacaattagggtaattattgtttgagttgtacccctccaattgttgagttgtaccactccaattcctgtacaccagtccagttattctaatctttctgtgaaaggtttgggaagtttacattaaacatatctattcttgcctgcatctaaatccagatttaggttctttcaagacaacatctgttttaatttttttaatggataagacaaaaatttttattacatttagggaaagtgtatagcattaatataagtcatgtctcatattggttattaaacagatttcatccaagggggttattagttgaataattgttagagattgcagaaaaggggaaaagaaggggaaggagaaagagaatataacaggctttatagaggatgactgatccatcactagactgacaggagttaacaacataaagtgacccctgtgggaaaataagcaagattttctgagatatgatctttattttaaggctggggaacgtgtatttttaaacaaagtgaaatggaagaggataatatagaagtcaaaacttcgggattacacataaattatccaattggcagagaaaactgtatacagatttctggtgggagaatatagtacaatgaattgcatatatggtaagataaacataagataagaataggcactaataactgattaagtaataatgtgatctctgattgagatcaatatatgtaaattaaatgactgttcagtaatcgtgttttacatccgaactcatctgcttgaccaaggccaacttgatatgttattaccacagctgcagtctctcaattgccatatttacaagcttcttattttctgaacagcatccactgtcttctactcacccctttagtaccctgattgcaggagtcctttcatgtcatggaaatctacaaatcattgatcctaccctattttcattctactccacctcctttgattcttacttttctccttcagttattatcatattcttttatacagcttcaattttgtcatctctcttttgctttcgcacactgacattccagtttgcaaaaccctaatcacaatatagatccaactcttagcctacttcacatatgaatctattcagtttaatattactgttaaacaatcccaaaaaccaaagcacacatacaaaacaaatgaacaaaaaaccagttatacagactgctgtcaatttaaaataaaaatgatgaactttacatcttaatgttaactagaatttttttaaaaacctattatttttactatacttttgtcaaatgttttatgtgtcttccccagtctcactctcaggtgataaacatgcatcctattacgttgtgaaagagaaagcaattagaaaataacctccacaagctctcatcaccaagtcacacaccaattagcatttgtagccatacactctgacttcccagtttttagtatatattatagtatatagtacagtatatggtacagtatagcatagtgtactatagtagagtataagtcagatacaaaagaatttccttttcaaaggtttggcttattcagcatccctgttcttcgtcccctacttccaaggccacactaacttccttatcctttgttcctccctattttaatttcagtaaacaactttcccaacagtccttatttacagagcccacatttgctacccactctgtaaattacccctcccatcgcaacagcttttcctgctgaaaccgcccttcctgccagtgtaaccacattcctgcacctttcaagttagccagccaggttcagcttagattgtgcagtccaactccagccagtggaggcaggacacagtagcagggataagctgcattaaggataaaaaccccttcctgcctttgtttggtgtgctctcatgaccagacttgggagcagcattcttctgcagaagcaaattttgccttgctgagaaatcctgtctttacgtgctctttttcttgcgactccaagctttacttccaacggtatagtatagcatatgcatttgttgcagttctaagactaatctctcaacttgtgtggcgctgtagttcatctttttttgcctactttaagaaattgtttcagcagtaccccttcttctgcatttttatcagagtttgattcctcttctggagcagtccatcaacatggaaacctgctattctttcctccatataaaaataaaacaaaggaaaactccatcggccaatgccctcttcattcagctactacatgatttttggtttccctttacagtaaaacttcaaaaactttgtctttatatactctatccaattctattcctctcagtcagtctgtgtgtttctctctcttccccctatttttgtctctactctctttctaacagatttattgacatgcaatttttatcccataaaattcacgcattttaagtgtacagttcaatgagttttggtacatttatataattgtgccttcatcaccacaacttgaaagatacttccatcatttcaaaaagtcattcaatccctctcctactcatgtccctaggcaatttttgctatgctttctgtctctatagttttgacttttctagaatatttattttattttattttattttattttattttatttaagacatgtttttgccatgttactcaggctgttcttgaactcctaggcttaagtgatccgctcacctataatcccaaagtgctgggattataggcatgagccactgggtccagccagaaatttcattttaatgcaatcatacaatctgcaatctatgtatgtgcacgtctgtgggtgtttggtttcttttactgggcagaatctgagattcatctgtatcatggcatgtatcaatagtttgttgctttatattgctgagtagtatttcattttaaggacacattccattttgtttatccatttggattattttcagttctcatgtgggttatttctttctccataaaacactattttcacttagcttaaaagattcctcactcttgatattcctccactctttcttcttaatctcctttgctgatttgtctcatctcctcaaactcttaattttatagtcccccaagtgtcagtactataacttcttatctccttaataaactcacactttgttagttttcacctgataataaagctttaaatatctaaatatctaaaatctccctaacatacatctctaacccagactctggcttgtatgtatatccaactgcctatcagtatttggctaataggcacttcaatcttaaccatgtctaaatctgaactcctggttatttcttccccaaaccttctctagctacagtcttttccacctctattaatagaaatttcattctgtacatcaggcctcagagccattcttcacttctcactttctctacaccctacatacaaaccatcagtaattttactggtgtcagcccactttctggtccatagacaacttcttgctgtgtactcacatggtggaaggggccagacagctctcttgggccttacttataagtacactaatctcattcatgagagcttcactctcatgacttgatcacttaccaaaacacttgccaactaataccagcacattggcagttaggatttcaacatactacttttgaggggatataaacattcagaccatagaaggtggtatttggagatggggcttttttttagttttatatgaggccttgagggttgggcctttatgataagattaatgactttattagaagagacaccagagagctctctttctctactgaatgtgagaaaacaaagaaggtgtccatctgcaaaccagaaagaaagccctcatcagaaaccaaccatgctgtcacctaatcccagacttccagcctccataactgtgggaaaataaatttctgttgtttaagtcatccagtctgtggcacgttgttatggcaacttgagcacactcatgcaccatctcattcagcttaatatcaaagccaaagtccctaccatcgcttggagaaccctcgccatttgcctccaattgatctgtctgaactcagctactgctttccctcctactctctttcttgtagttattgtcatttccttgatgtctcaaacaaccagacaagctcctaccttaaggcctttgcagtcgctattccctaggcctggatcatgtatatcccaggtatatgaatggctcactccctcacatccatatctttctttaaatatcaccttagtaaaaccttttacaatcttcctcttttgatttctactccacaattcgtttctccatctttgctttatttttctccgtagtactcacagcattacatatactgccttaatttttctccataatgctcctagcattccatatactgcacgcatttacttacttcgttgttcatagtttgtctccttcggttacaatgcaaattctactaagacataaattctgcaggttttgttcactgttattaccccattgcctaggacagagtatgagctcaaaaatatttattgaatgaatctatgtataatattcagaaatatatgaaatgagcccaggttttaataaatatcagaaactttgatggaaaagtcataaataagaataggaaaaaaacagatcagctatgtaacaagaaaacctttcttaaaatttacctttttctcataattatattgtgaaatggtgcattaattttaatgtcttgcttatttgcttaaaagaagaactttgaaactctcttgggaaaatatagtcaaaaaagcttgctgaagaaacagaatatattagtccattttcgtattgctgtgaagaaatacctgataccgggtaatttataaagaaaaagaggtttaatggactcacagtttcacctggctggagggcctcacaattatggcagaaagtgaaggaggggcaaaggtgcgtcttacgtggtggcaggcaagagagcatgtgcaagggaactgccctttctaaagccaccagatcttgtgagacttattcaccatcatgagaacacaatgggaaaaattcacccccatgattcagttacctctcactggatccatcccacaacacgtagggattatgaaagctacaagtcaagatgagatttgagtggggacacaccaaaccaaattacagaggaagtgagaaaagaataatccagggtgaagtttctgatctgacatttattagcaatgacttcaacaactgcctttgtttgggtggaatgagattgatattatgaaattagtaaataacctgatacgtgctagaaatcttagacccaagtttctgtttcatccaaatagtcatgtagattatcatagcatacttgttcaactgatgcttgattgcattttgtttcccaatcttgttttacttccgtttttcaaatcataattagtttgttattttatctattggaacaatacaatgtaaagtgtcaggagtcaaattttattatttttatctttccaagtagattatatgttctttcagtatatgaagcttaccaccttccacttcatattcccaatacgtagcacagtgtctgatccttactaggtgttcattaaacgcatgttaaataactgagtgaaatgcagattctaacagttgagttttgcaaggttttagacagtttctgtcagccttctggtattagctcattgtatcctatattcatgacagatatttgggtcacttaatatcacattcatgtattgctatttcaaattgtagcagctactatgattcagtggaagctgtatgaaatgataaaacagtttacacatcagagaatattaaaaattattcagaaacagcccacagatccattttcttattacctcaaatagatgtgcaatgcccatttttcttcaaataaaagcaaaagcttgaattgacttgatagctaaatttctcagttttcttcccaagagatcaatattaatctctgtcagcaacatatgtacatgaaaataccttgtttggatactgaggtggttattcatctataagacaataaatatatatatttaaaatgttaagcacacctagcccaaatgagttttgattgccaaaaaacgtgtttttcagtttagtaattttgaaattgagggttatattgtaaaggaaggctttgtgaaaatgtagaaatagcctcataaaacctataaacctatataaagttattttactatttagaagctatcatttatagatactttctacataaataagtcatttattactattttacttacatatttgactttattatgtacagaaatattcaaaagcttacgttgaagtggtttatttactttggggtatatacccagtaatgggattgctaggttgaatggtaatctagttttagttctttgagaaatgtccaaactgctttccacagagactgagctaatttgcattcccatgaaaaatgtagaagtattcccttttcactgtaacctcaccaatatctgtctatctaatctatctgtctgtctatctatctatctatctatctatctatctatctatctatctatctatctgacagagtcttgctctgttgccaggctggagagcagtggcatgatctcagctcactgcaacctccacctcctggcttcaagcgattcccctgcctcagccttccaagtagctggtaggtactacaggcgcacaccaccacacccagctaattttttgtgttttagtagagacagggtttcaccatgttggccacgatggcctcaatctcctgacctcatggtccgccggcttctgcgtcccaaagtgctgggattacagacgtgagccgccacacccggcatctattatttttgttttactttttattaatagccattctggctggtataagatggtatctcattgcggttttcatttgcatctctctgataattagtgatgctgaacatttttacatggttgctggctgcttgtatgttttcttttgagaagtgtctgttcatatcctttgcttactttttggttttgttgcatttgcttttgagaacttagtcatattttttttgcctaggccaatgtctagagagtgtttcttaggttttcttctaggatttttatagtttgaggtcttatatttaagtatgtaatccatcttgagttaatttttgtgtatgatcagagatagggatccaacttaattctgcatatggttagccagttttcccagaaccatttagtgaatagggtatcctttccctattgtttatttttgtcattttttttgaagatcaattggttgtgggtatgcagctttaattcaggggcctctattctgttccattggtctatgtgtaccagtactatactgttttggttactgtagccttgtagtatagtttgaagtggttatcatgctttttctgtggtttatttgccctctttttactttcacctatttttattaatatgtttttaaattgtaattttccttctattcatttcaaaatttaatattttatatgctgttttcaaaattatatgtaaaatcttaatatagctatttaacattatttttgaacagtttcaatgcagttgtttttggtgattaatgaatctgttcattcaaacagaatttgaagaagtaagggtgtgtaaatttctggctctatgaaatacagtacctaagaaatggagaatttggtttaggataggaaaagattagttgagttgtgaatacatgaagtcttatatatctataggtagctcagaaaactggatataaatctccagttcttgatacacctgactcccataaagtgcaaaaccatagacaggtatatctcacttaaatatgctctccaaacaatcagtttctctactatcactcctccagttataggtggaattgtggtggtatgcatatccatcagggggaatactagtgttgtatgtacattggatctcagagggaaggaaaataaaatcataataatcagttaagtaggaagcgccaaggcaactggagtaagtgcataaagtgagtatttgcagactaaacttattttatttctgcatataagctttaagccatcatagaaaatagctgaatttataaagtaatgagctatatagcgaagcttaatcctgagcactcagcaaacatagtgtataatgcatttggttgtccttttaacactccttcattgtaaacactctaacatatagtatatccagtttggaaataatagtcaaaatgcaatggacactgaaggactaaagatgctgacacctttctagctgctaaatctaagcaacccctcattccccttggccttgagactccttggaagtattggttagagtagagcaaagaggtcttcagtttttgtgtatgagctgtaacacttcagctggggcatttcctattaaagaaagaaagaaacaaaagagataatttttgttttgtgggttttttttttcttttggattctaaatacttcttcttcaacctagtttaagacaggcagacaggttcaccattctcaaaaccgttgtaaagacagataagatataagtaaacaaatccagagaatataagaggtagtcccaagaacactatgatgaaggaataccagatattctctgcttctaaatagctatattgtaccatcatatttcacctgggatttggtctcagacatccagggattctcatcctggctctgacatttaccattggtctgtctgttaaattaagctttaccttgcctgtagcgaaggaataataaaagctacctcacagcattgttgtcagaattaagaggtagtttatgtaagataattagctcaatggttggaggacagtgagcattaaattaactttgtcttgataatctgtcttcaaaaaccctctttaaaatgcaaatgcttttgagaaaggggttgccttaaatcattatctgctaacattaattaacagttggcagagattagttgacatcaagctgacaaggcaactagaagatgaatggcacttggaaatgggaatctcagagtttaagaaggggaagggatcaagaaaaggaaaaatgaatcctgacagttaagtgaaagggcatcaagtatcattgctatcttcaggagacctctttatcctaaaataataaataaataccagaaattgttcctttaaagctatataaaatggcaaccaaaatttcacagaggtaaaaacaaaatatttttgatggtagttttatttaaaatgagattttacattatacaatgtaaatcataatttaaaatgatgtaattacaacaagtacaagaaaaatggacaagacttttttggcatctttaatcttacaaaatagtaagataccatgatactccttgcttcaaaattaacttttataccacaaacacaaaaagtaattgttccaaaaatatttaaggatttccacaaatttctaaagatttcttagttgttttatttcaaatcactatatattaaattacataagatctttattctgtgagagtttatcacacagactttcattttttgataattttgctttattgattgaagctgttttccaaatgtgtctttgttaaattaatgaaacccacaacttttacaagatttacagttttactttgaaatacgttaatgttgtattcttacattttataaataacttatgcaaaagatattggcaagatggaaatacatagattctaggaagtgtaattgagtgagactaattttaaaagtaatcaattagtcattattatgtgattatgacttcttttcctaaaaggagcttgtaattagggttacttgagttatattatttggacacagagagctctatttttaagttttgcctagaattagccatctctttggataaatggaagcaaagaaaatcagtattttacattttatgtatcctattctatctttatccctgttttataagtaagttattgttaccaccacattgcaaatggtaatattgaagctcagagagcaagttgcctaaaatcccatggctaataaataaaaacacagagatccaggtctgtgaattcaaaccctatgtccttttgactatatcatatggtccttacacattcagtatattgtattgtattagtgcattatcccgctgctatgaagaaatacctgagactgggtaatttagaaaggaaagacgtttaattgactcacagttctgcagggctgggggcctcaggaaacttaaagtcatggcaaaagggaaagcaaatacatcctttttcacatggtggcagcaagaagaattgccaagcaaaaggcggaaaagccccttacaaaaccttcagatctctggagaacttgctcactgtcatgagaacagcatgaggataactgctctcatgattaaattacctctcaccaggtccctcccacaacatgtgaggattatgggagcttcaattcaaaatgagatttgtatggagacacagccaaatcatattattccacctctggcccctctcaaatctcatgtcctcacatttcaaaacacagtcatgcccttctaacagtccccaaaaatcttaactaattctggcattaactcaaaagtccaagtcaagtcttatctgagacaaggcaagttccatcctggtatgagcctctaacatcaaaagcaagttagttacttcctacatactatgggggtacaggcattggataattacacccattccaaatgggagaaattggccaaaatgaaggagttagaggccccatgcaagtcctaaatccagtgggacagtcaaatcttaaaggttcaaaatgatttcctttgactacatgtccaacatccaggtcacactgatggaggaggtgggctcccatggccttgggcaactccgccccttacagatttgcagggtacagccccctctcagctgccttcatgggctggcattgtttgtagcttttcaaggctcacattgccagctgtcagtggacctactattctggggtctggaggacaatggccctcttctcacagctacactaggcaatgcccaagtggggactctgtgtgggggctccaatcccacatttgccttccacactgcctcagcagaggttctccacgagggctctgtccctgcagcaagcttctgcctggacattcaggcactcccatattctgaaatctagccagaggttcccaaacctcaattcttgacctctgtgtacctccaggctcaacaccacatggaagatgccaaagtgtggggcttgcaccctccgaagccatggcttgaactttaccttggccccttttagccacagctgggatgcagggcaccaagtcttgagtctgcacaaagcagcagggccctgggcctggcccacaaaaccattttctcatcctaggcctgtgggcctgtgatggaaggggctgctatgaagacttctcacacgctctggagacattttcctgattgtcttggtgattaacatttggctcctcattacctatgcatatttctgcagctggcttgaattcctcctcagaaaatgggtttttgtttcacattatcaggctgcaaattttctgaacttctatgctctgtttcccttttaaatgtaagttccaactccaaaccttatctttatgaatgcataaaaccaaatgcttttaagagcacccaagtcatatcttgaatgctttgctgcttagaaatttcttctgccaggtgccctaaatcatctctctcacgtttaaagttccacagatccccagggtgggggcaaaatgctgccagtctctttgctaaaacatagcaagagtcacctttattccagttcccaacaagttcctcatctccatcggagaccacctcagcctggacttcattgtccatatcactgtcagcattttggtcaaagccattcaacaagtatctaggaggttccaaactttcccccatctttctgtcttctgagccctctaagtctctaggacattccaaacattcctacatttttctgtcttcttttcagcccttggaactgttccaacctctgcctgttacccagttgcaaatttgcttccacatttttgggtatcctttcagcagtgccccactctccgtggtgccagtttactgtaatagtccattctcatgctgctgtgacaaaatacctgagactgagtaattgataaaggaaaaacgtttaattggttgacagttctgcagggctggggaggcctccggaaacttacagtcatggtggaaggggaaggaaacatgtccttcttcacattacagcagcaaggaaaagtgctgggcaaaaggagggaaaagccccttataaaaccatcagatcttgtgagaacttactgacttcatgagaacagcatgagggtaactgcccccgtgattaaattatcctccactggttccctcctaagacatgtggagattatgggagctacaatttaagatgatatttgggtggggacacagtcaaaccatatcacctattgttactggtggcaagtctgaacagggtccttggtcctcgattcttgtcctgttggaagaaagaatttggccaagaagaggtagtagatttaaggcagaaatgagagtttattgaaacaaagaaaagtccatttggaaggacccaagttggaaactcaaaagattgactgcctcgcctgatccttagctcagtgctcttatagacttattatttcctgctttttatcctggtcttttccccttgtccttcctgttgggcaggatgttggctaatcgcagtatgtagagtgacttgccagtgtctgggaggggccacatgcatcatttggtggttgaggttatctgcgtgctctcttagagcagttttcccttgccaatctagctcccccagaggaaggtcatatactgatcaaactgccattttgctccttactgcatatgcctgaatatattctcagaaaaaggtcacaatctgccattttgtctcttactgtgcatccctgaacatgtcccaagaggaagatcaaattccaccattttgacccttactgtgtatgcctggatgtgtttgttcaattcctaggatcttactgggagtttgttgcccaaaagctcaaggtgtttcctatgtgttaggaaatgttccttcccctcgtgccagtcttgaccactcatttctgaggagaccgcctgacaattgcctgacagtcacctgacagttgcctgatattctttggggccctattctgccctgttcatatctgcctatctacctactctaacaacatggtctgaaattttactaaaaatgtttattttgtgtatacgtaggccacttgttaacatgtttgttatgccaattcaaataaacaagagatttcatcaattattttgattgacttaactaaattgttgtctgaattaaacatttaatgcttcccaaatcaaggatataaacagtagataaaaataaacacatacacacaaacacacacacacacacacacacattttagtatttttaccaagtaaaataatgcagtgcttaagtgtctattttagcagttatttagaagccaggcaacatagacaatacaaggatattgaaggaaatgcttgagaaataaaggaattatttatttttattatatcatgtctgttttcctttgtgagtaaaaaatgtataaattatatactctcaaattaatcagaaaaagactgcttcaacctaaactgtgttgtccattgaagcatttgtaacaagtgctttaactagttacttaataatatctgaatgtagtgcttatcaacagatacattttgacattattttaaaatctgcagagatcattttaaaaatattttactttaaaatatttcaatagaaaaatgttttgttcttttcattgcttttcctgtacttaattgtaatatattttccagatatcactagaaaggaaaactcaatgtgtttcagagtctttagttttttaaactatctgacaaaacttacacatggaaaactaaactatcacaaagcaaacacttcaatatggagtttgttttagaatatttagacacagcataaggaaaaagacttagaacactgcaataaccttggttttttttacttagattggttagggattttgacatcaagcagctctagtttacctaattatttttgattgtttaattggatttgaccacatagtaaaaggatttgacccaagtccttaaaatagcctatttttgtttcatctttatagtctacacagaaaaatgtaaaaaataatggatcaagaaagcaagcaactcactcctttgataactggttcccattagtgggaataactagtgtttccatgttacgttcatttggtttggccaaagtggtcaaccagtcaaattagtatgttaaatgcagacaagttagtgtgcaatatttgctagtagtgcttgctctaaaactgaaggcaggaagaaagaaatggggtaacttatgtatgggttgagcatgaaaaatgtggatgtgtcagaatgtctggaaagttacgatatccttctaattccagagagtatctaagctagtcctccctatctgtcatatgatgatatatttttcatatgaatttatcaccatagaaacctccaatatctccccatcacctgtaaattaactttaagttccttaacctggcactcgatccttttttgagtctcctgtatagtttgccatttgactatgaagcacctaagcttctgtttatcttactcactgtattcatttttttcagcttccttgcctttgatcatgtcatttccagtgccagaaatgcttacccatctcccttatgcacttttgttgaaacgtgtattttattttattttatttttttgagacggagtctcgctgttgtcagcccgggctggagttcaatgggtcgatctcggctcactgcaaccttcgcctcccgggttccagcaattctcctgcctcagccttctgagtagctgagattgcaggcacccaccaccacgcctggctaatttttgtatttttagtagagacggggtttctccatgttggccagggtggtcttgaactcctgacctcaggtgatcgacccacctcagcctcccaaagtgctgggattacaggcatgagccactgcacccagtcaacttgtatcattttttaaagtacataccttaaaataactatagtatatgtatacatatttcttgggctctagggtcagaaggattcaattttgtcacttatcagcaatgtgactttggggaagaaatataacatgttcttaccataattcctcattttcaaaattttacatgtatatgctgaaagatttaatgagatgatatatgtaaagtattttacccagtgcctgcttcttggtaaatactctataacttagtgatgatgatgatgatgatgccctcttcattttatccgtttatggttaacaaagtaacaaaggatttattcttctctcctggccccctgcttcctcattagcattcctaagtgcctatgaacaagttttcttctcttgtctaaatcttgtcacatccttcactgcacaacagtcatttatgacatcttatttttcctactcgatgtaggctactgaggcagtcccagtatctttgtatcttttatagatttgctgacatagccctggatgttatcaggtacttgataactactgtttattaattgttctaaagcaaataatgaggcctgagtaccccactttaaatagttaattttgtatatttcaaaagataatgttacctttctttatattttttcaataaagaaatatagtgatgtagttatttgatcacatataatataaatcttactctagagaaatagaaacaaatagaaaatgttatcttcatttaggaatttcaattaatgttctcagttggcaaattaatatttgagtcaacccttttctctttgttttatgtcacttattaaatatggatcatttttaattagttttattgaggtatattaacatataatgaacatcagcaacttttaagtgtataattcagtgaattaagataaaagaagtcatgtaaccactaccataatcatggcatagaacatttccatcaccacaagaagttccccagtgctcttccctttccaatcaatttttcccccaattctcatccctgatattcattgatgtgatttctgtccctatattttgttttgtccagaaattgtttttgaagaaattctacagtatgctcctctcacttggcataattttgagattcaggcatgttgctgaggcagttagttgggtttttcttaaataattgctgaatatttcattgttgcaatatattaggttggtgcaaacgtaattgtcgtttttgccattaaaactaatgatagaaccacagttatgtctgcaccaaacctaatgcttcaggtgtttatccatttatcagttgatgtacatttcagctgttttcaatttttgactattatgaataaagctgctatgggattagtatataaatcttcaagtgaagaggtatatgtctttgtgtgattttatgttttcatattataggtgcttacttcattttctccatgaaagtaacttgctttcagcatttatatctgtggagctataggaaaatcttgttattaccctttatgttgctatcattctatgtttgaaaatttatacataattttgatgatagtatatattgtttgcagcattttggaatgaaatatatgtttttcttctgtgtgaatttggggactttatagcacatgtattttcctcctttcctagttagcattctttccatttctgtctgaagaaatcaaatattagtcatacagatgccattacaatgaaagtgcaaacagctgtggttatatttacttgctttttctttctcttagttgaagaatctttttcttaacccagagttcagctatatctttacagtttctagacagaagcattagaaattgtaaccagccacatatattaatacacatatttttgagtttaaataacaattgacagttgttttaaaaatctcaatttatattggaggtccacgtgcacgtgataaaagcaatcaatatatatataattgctatatttgtctcatataaacattttctaaattattcgtatcccccaccacctccatttctttcaaagaagtagaaaaaatagtttaatacgtacaacgattctataatgaaattgaaaatcaaaatatgggcggggcatggtttctcatgcctgtaatcccagcacaaggccatggtgggtggatcccctgaggtcaggagttcaaggccagcctggccagcatggtgaaactctgtgtctactaaaaatacaaaaattagctgggtgtggtggtatgcacctgtagtcaggaggctgaggcaggagaatcccttgaacatgggaggcagagattgcagtgagctgagatcgcaccactgcactccagcctgggcaacagagtgagactcagtctgtgtgtgtgtgtgtgtgtgtgtgtgtatatatatatatatatatatatatatatatatatatatatatatatatacacacacatatatatggtgattagtcctaaaacaatacaaattacaaatgtttatagtgaaaaagtactaatatctagaaaatggaaatacatctccagcatatatcttcacatagaaatatatcttcacatagatgtatatctatatcaatataattaaattttatacgatataaaaatattaataaattagcaaacacctgctattgttcagattctatgaatatatgacctagaatagtgtattgaagctagccattgtcaaccagggttccaaaagaaaattgagccctatagaaaatgatatgattgactgttttcttagttcccccaagaatggtacgtaactaaaatcattctaaataaatagaagataagttagtttattacatataatacatgccttaggaccttagagattaggtttttttcaccgagcattatattataaacatcattccatgttaaaaattatttaatccccaatttttaatggctgtatgtattccagaaagattatttaatctctaatctgatactagaaatttgagggcattttcaaaaatatttcttattgtaaattgctttgcaatgaacattaatagagaaccgtgtgtgtgtgtatgtatgtatatatatgtgtgtgtgttgtgtatatattatatacatatatgtaattattttttgataccaaatttctagtggtggaatttccttgtgagagaatcagtattaagtttgttgataagtattgtcaaactgtctttcaaaaagagtgtaacaatataagttagcctcacctagtcatttgtgcactagttttgaatctcttttctcagcctgctggtaatctttactattaccctttgctcaaaccaatgaactttaagttgccagactactagttagtcttctgtagaggaggttgtgtgtagagcaaagagaacaagtatatttcctagcctttcttttatcctaccatgctggaattcagttcacttttagttttatagagggcattcattgccattctctcacgtatgttttgattcttcctgtctacttttacgttgtatttccaccaggaataatgaatcctatcccttccatcaaatctatttcaagaaagacactttgcaaagcagaagggctccaagagcacagctctagtctctcttcaatgtttataaggcacagtcattatttttacccactgctgaaaacatttgcaggggttattaaaaaaattttttacctaaagatactaaatagcaggggttgcagacataagcatccacctgttcactggcttattcacttaaaatataacaagcatgttgcctaagcaaatgtccagtaagttttctttctgttgtttgcgtttagtaaagttctaaaactatacaattttctctttctttccttcagactataataggaactgggtgaatattatccaattaattctgttacacaaagggccttatcttttttcttatccttattttcaaaaggacactgcctgctacgtgcttagcaacaagtagtcttttttttgaacaagatgagaagaaatccagactatcctataacagtggaagagttgtatgtaaaccttattaaaaagtccaaacaatatcaaatagtataggcttatttctctctagcttgctgcaaggttgacatcccagagaggatcagggcatatggggagtaatagtcctgcagatcaagcagccagatgtgactaagaaaatgatgaaagtgaaatctgaagcactactgtcattgttgtctcatcatatttataaacaaaacattcctggttgagatggaagtcttttgtgttaaatgtagggttctccttaaatattaacaacaggcaaggcagggatatgttataagagttaaatgtaaggttcctcttaaatattaaccacaggcaaggcagggatatgttatagaaatgtacatttcattagcaaggaaacaaccatgatatcgatggagttcttaccacatgagacgcacagggatgattaagtgtatgtaatacagtacatataaggtaggtctccatattttattctcctgctaaaaacactaaaggaaaaagaaaaaaaataaaacaggatcttgagctagatctatgatctttctaaattaatttagttaagatagctttttcaaatggattccttttacaaaacatgttgttaagcagagttctttagagcataaaatatagtaagcggtgtaactgtaattagaatatgcccatgtatgatggggagacgaaagtcagcacctaagagctgcagttctgagatctctctgcaaagctggtctggaggatagccatataaatgcgttctcttatgctgttcttacacattgcaaaaaggcatgaagctaacaagcatcgaaaatgagtgccgttagacatggtggatcattcactggaaccgttcttcccctcagggagaatgaaagtctggagagagaaaactggctgacctcgctcaatcagcacagtctgaatgcaggcagaatggccagcggtgacagggctgtgcttcggagatgtgtgtgctcaggctgcggttcaggttatgtcaacaaggatcactctgggtgccattttagtggctccatgttgtacataagagaaagacggaaggagaaaagggaaaactgtgggccactttaaatgtacttgagaactttgcttttcacttaggacatgaactctctctcagcctgtaagcagctgcagctcgaagcttgacaaacaggccaggaagatgggaaagtactctagtagcagcattgcttctccagtggaaaaccgagagtcctaaatgttacagtgcttcagcctgaggtttaactgatagaatgccttgatcttgaaactgaaccaggcatcagtaaactgtagaagtttagcctgttgtgcatagaagatacaactttgcattttataccttttactgtgtttaacaaaagaaacaaaacattccaaaaacctcttattaaatacatatcctgctttctgttttggaagtagtgtttgtatcatgcgaataggctctaaagcttttaaaatatatattctctattctaagaatggatctaacaaaataaatcaaaaggaattttatttttaaaggatttgatggaggaaagggtgagatctgtgatacttatagcttccaaatctgtaggttcataggacaagtgactccctatgcttggaaagtcttcactattttaattacattctaggattctagttataaaccatacccatgtcttgtacaggaaacaaaatacataatttcatcaatccttcgtttcaatagaataaaatgaagataaacaataatattattgcaaataatagagactgcttagcaaaatatctgacacatagtaagttcttattatatacataggtactaaaacggttactatgtaatatttgagagacagatttattcttggagcaatcagctcttagatctatctacccagggaatcatggcacataatgggaagtacaagaagccggtaatagttctgaattattttaagccatggtaaatgggagaaaatagagtattaattcaataccagttgaattagaataaccttgaaatttttgtcctgatatatagaattgttctgtctcaaaaatcttctttatctaaaagatattctaaactaataacataatcaatttagtaaatgcttgcttgctagacaccaagccgcaatctacatactttacttaaatcatttctatgtaatagttacaaaataataagaaaaatatatctctacttctcaaatagggcaacaaagactgaggaacatttagtaaatagtctaggtgatagaaataataaatggtaaaggaaggatttgaaaaattttaaactggaaatttgctttagaaaatctaattgccttatatctgaattagtatttgtatgatttgactcattctaaattatgaggtcttacaatttattactctttgtaaacactgaaacttgtataggtttgcccacagtagactgactaccttttattgagctgatttatcaaccctccggtgtttctaatttctgtattctaaaaaaaatttaaaaagatgaactcataagtcaacaaaataccttaaaatggtgatttaataatctgaacatttctctaacaatgtaagaaattgatttctttcttttctatttagttcagatcacaagtaccttaaatactcgtgcaaattgcttcttcctcctttattatgtttactataaatttgcgtttttcccattatcttgaagtaatttatattagcttcattttttagcgcaaccaaataagttctagaaatacatattttgttattttaaaaacgtgaaaaaataaaattaacctcaaaatgattgagtaaaaagaagtcagtttaatgcattgattcagaattcttcacattatttgcaagtctgtatctctacaaggtaaattatttatgcagaatcaaacaactgaaaaactcttttaatgcaaacttttttctacaatgtgtaagattttataaaaagaaggaaaaatgacaatctaatagtgtccatgtgccactgtatcaatagtcaaccaaatatttatttttttaattattttgatatttaatagaaaaaaatagggcccaaatcactaccaaaacatgatctgaatcattaccaaaatattaagctatattttgacccattagatcaaaggtaaataagtcccttatcattctgtgctgtgaatatgattgagtcctaatttgaattcagtttaggaaacggtactgagaacctcctctatatgtttgtgttatggaagtaaaatcatgaaggaggtattgtgttctgctcttaaaaataaaatgaaaactcaaagcagttagcttttatctgttgatctatctatttttaaaatgaaataatcaccaaataacccaaatggttggcaaccagaatatttcacttctggattagttctcaaccaggaatgattttaccgtcaggatacatttggaaatgtctagaggcatttttaatttctttaataggagcagggggaggagcagcaggatgctatcagcatctagtgggtgaaggtcagtgacgctaatacacatctgcaatgcagaggacagtctctcatgacaaagaattatcagcccccaatgtcaagggtgctgagattgagaaaacttgatctagatcatatggaggttatgcattaagatgatattttacatcaacattaaatttatgtaatttgtgctctttagcttttagatcctccaaatattagtattagtagagattgctgactctttgaaataaagagacaataaactaatgaactaaagtaaaactggaaagaaggcatagaccatgagcctttccaagaggagtatagtatttcaaagttattaacatttaaatggccacataaaggctagtacctagtgttctcataaagatactcctacatcatttaatcataaagtgtttatttaggtacagtattacaacgacatcaacattattagtatccccttagtcaccttctacatatgcattttcatctcttccttgataaaattattgatgaaagtattggtgtatgagacagttcttgtccactttaaaatacagttatgttgtgttttaaaattttggcagtcttagctgagaacttcattagagagttcataaaatcaatgatgtgtgcttaccattccaccacaaagatctaccactggaaaatatggtatttttctgcagatagattaaagcatacattttgatggaatttccttgtaattaaaggaaagactcaggctaagttaaaagtaatgcaaaactgtacaaggaagcaaaatctcaaaatggtagtcttgatagaaaaataattaatgaaaaaacaaggatggcatgttttgtattaagaaatattcaccctaaactgaatcagtttgaaaaaggtagggaaaaacattgggacatagaaatgtgcttacaggtcttccagttcatttaaaaattttatacgtttcattaattttctctcccacttccaacatttgtgaaagcaattaataatcatattgttgcctctataaattttatttatgtcaatctaacgggacctatacaatttagctagaatactggaattggttcaagtctcatgtccttatctcaacatatctacctatatattaggatacatgcattcccagggtttctagaaaaacttccagacaaatcattttaattattttatttatcatcttataaagaggtaaactttacccaatataatagtttttaaaataattattttatggcacatggtagggaaacattttactgtctgcatttattttattttttattcattcaaaaattatttattgtgtaccagccactttttacactactgaggaggtatggtaatggacaaagcagataaaacatagtcaagatttcttccctaagaaaacacttactgccacgcaagagataagtaatagaggtaaatacataagacaaacacacacacacacaaagagaaagagagatagatagagattgattagattgattattgatagttctagttaaggtcagcaaatccataaagacctcccacagggagtcatttgagcagagacctaaaagaagttaagtaatgagccatgcaggtaactggggaatgcgtgtttgaggttaaggtaaaaattattgcacgtgtcctaagttggaaactaacagcagggccagtgtggctagggtggattgaagaaataaaagacagtgttgtagttaaaaagagtcaggcaaaatcatgtcagtcctaatagagtttataagtagaacttataaatttagtctattaccaagggttgaaataggatgaaaagaaaacacctgatttcactaaacttaaaataaccaaacactgcattcatcatcagaaagggcttcataaactacttactggatactctagtgagttgaaaactgtttttgaaaattagagtaataatacccattagcaatttggggcaactcaagatagctccaactatctttactggtaacataacactcttttcaaaatttctaaaattaaattaatttaaataagtttatttttcacctgtatgccacgtttgcacagtaagtgtatgacagagttcctgctctagatgagtatgtgatctggtagggaagatgatgcatccagagaactatgggagaacataggaccactacaagaggaatgtgttgtgtggatgatggaaagggcgtagggagaccatataatatatataaataatatccaaactggatcatttttgagaatgaaaagggggaatattaatattctttctgggaaaactggtgtaaattggcagtgttgtaagcaaactggtgcacgagttaatgatgtatctacaaaatttcagaaaagaagggtgaattgtaaattaatgtgactttttaaatctttaagttctgggatacatgtgcagaatgtgcaggtttgttacataggtaatgtgccatggtggtttgctgcacctataacccataatctaggttttaagccccacatgcattagatatttgtcctaatgctctcccttcccttctcctccacaaccccgacaggccccggtgtatggtgtccccctccctatgtccatgtgttctcattgttcaagtcccacttaggagtgagaacatgtggtttttggttttctgttcctgtgttagaatgctgagaatgatgaattccagcttcatccatgtccctacaaaggacatgaactcattcttttttatggctgcatagtattccatatgtaccacatatggaatatgtggtgtatatgtaccacattttctttatccagtctatcattgataagtatttgggttggttccaagtctttgctattgtaaacagtgctccaataaacatacatgtgcatgtgtctttatagtagaatgatttataaatccagtaatgggattgctgggtcaaattgagtatctggttctagatgcttgaggaatcatcacactgtcttccacaatggttgaactaatttacattccctccagtaggttaaaagcgtttctatttctccacatctttgtcagcatctgttgcttcctgactttttaatgatcgccattctaagtggcatgagatggtgtctcattgtggttttgatttgcccttgtctgataaccagtgatgataggctttttttcatatgtttgttggccgcataaatgtcttcttctgagaagtgtttgttcatatcccttgcccactttttgatggggttgtgttttttcttgtaaatttgtttaagttccttgtagattctggatattagacctttgcaagatggatagattgcaaaaattttctcccgttctatatgttgcttgttcactgtgatgatagtttcttttgctgtgtagcagctctttagtttaattagatcccatttgtcagtgttcgctttcgttgccattgcttttgatgtttcagtcatgaagtctttgcccatgcctatgtcctgaatgatattgcctaggttttcttctagggtttttatggtttaaggttttatgtttaagtctttaatccatcttgagttaatttatgtacaaggtgtaaggaaggggtccagtttctgttttctgcatatcgctacccagttttcccaccatcatctattaaacagggaatcctttccccattgcttgttttcgtcaggtttgtcaaaaatcagctggttgtagatgtgtggtgttatttctgaggcctctgttctgttccattggtctatatatctgttttggtaccattaccatactgttttggttactgtagccttgtagcatagtttgaagtcaggtagcattatgcctccagctttgttgtttttgcttaggattgtcttggctataggggctcttctttggttccatataaaatttaaagtagtttttttttttctagctctttgaagaaagtcaatgatagcttgatgggaaaagtattcagtctatgaattacttcaggcagtatggtcattttcataatattcatctctgggacacagctaaagcagtgttaagagggaaatttatagcactaaatgcccatatgagaaagcaggaaagatctaaaatcaacaccctaacatcacaattaaaagaactagagaagcaagagcaaacaaattcaaaagctagcaggagacaagaaataactaagatcagagcagaactgaaggagatagttaagaacgtatctcaaaataataagagctatttatgacaaacctatagccaatatcataccgaatgggcaaaagctggaagcattctccttgaaaaccagcacaggacaaagatgccctctttcaccacttctattcaatgtagtattggaagttctggccagggcaatcaggcaagagaaagaaataaagagtattcaaataggaagagagaaagtcaaattgtctctatttgcagatgacatgattgtatatttagaaaacctcattgtctcagcccaaaaactccttaagctgataaacaacttcagctaagtctcaggatacaaaatcaatgtgcaaaaatcgcaagcattcttatacaccaataatagacaagcagagagccaaatcatgagtgaactcccattcacaattgctacaaagagaatacatacctaggaatacaacttacaagggacatgaagggacctcttcaagaactacaaactactgctcaagggaataagagaggacacaaataaatggaaataatgtgactcttaaaaccttctttgaggcagtagtacttgtacttggattgtgtccaagtgtgcaactgggcagaggaaggtgggagtgcattctagtctagggaaataacatgatgaaagacacatggatttgagaatcgcccaatgtaaaatgaagcattgatgatagtgaagagtgggtgatagtatcggatggttaagaaagagatgggtacaggtatgacagcaaaccagactatcatagattttaaattccatgacagagttccatatcagagagccatttaaggtctgttagtaggcctgtgacctgtataaagagtaaaactactcctaaactgcaatttgatatgagattggaatactgcagagcaacatatactataaaatttacagatattttagttctgcataatggataatttttgcatggtaaattggaacaagaatagaatatgggtgtatgactgtcctgcaaagtcaaatgcctcttttatgtatatatgtagttttaggtaagaggctatgttttatgaagtttttttagaatgactgctaggatgattctgcatagaaggtaaacatagcaaaaaataaaacctctgtgcgtgtgtgtgtgtgtgtgtgtgtgtgtgtataggctagaattttcaataataatgacattttgagcacttactatatacctgaaataatgatgttaacacttttttttctgaaatttcccacaaaatcctacccgctcagtgttattatcatttcatagatgaagaaacagaactgaagaggccctataaacaagctcaagactgcaaagctgctaggtgatggtgcaaatattcaagcacgtttttgcattggtataaaggcatctttttctatggtgccacattaccttacacgctcatcgagttgagccccctgtgtctcagttcttccccagaggtctcagctggaatacgaatctaggcacttaatacacatttcatgtcactctactataatataaattgtgttactaacaccagtgtttaagctttttattttttcactacaaagaaggcataagtacaagcatgaaaaaaaaaatctattttcttaccctgttcgttgtttgacataaagtatctagatttttcttgatttccagtttaacagtttgtgtgcagtcacaatttctttgggtgatccccaccaatcagtatctctcgatctcatctttaacggtcatctcctaaatcagtgttttgtgaataaatttattcacctaacaactggtttgtattcttgaaattttcagtaatccctacagatatacagttctcctatttccacaactataatattgtgtaactctcctgggttccaagaaaattatagtatttttatttaagctataatagtttctagtcttgagatttgggaaaatatcaccgagtcaatcaccagaattattaattaacctacaaactaggaacagaggcttagtgggaaaaatatattacagagcccacacttgtggagaatacacaaaacacatctgagtgatcgatactcaacaaagaagtctgaacacgtttagattttaaatagtcaatctctgctgtatcttggaattagaaaaactgataaagactgacagtatgggaactgaccaagggaaagccagtttagaacaccaaatcctagaaaactactgggcaaaaaagtaagagaaaggggaaaaataacttagggagaatcaacaatttattattccatgaaaacctttcatccatgtatccatagtatgtatattacatatatctctgatagaacatgaatgttaggttcaaaacagtggccactcaattactttaaatatgacaattttttccaagatatactttcttttttatgtgttctttaattgtttaaatcccctattagtactagaccttattattttacagctatgcaaatatcaaaatacatttgcaaaaaaaattgtctagtaagatatgatgatgtctactttgcaaatatattttgatgataatttgatgaaattaactacatcaatttcaagattatgaaattaatgtagatataaacgtaattataaaaattaatatataagcatgattctacatgattatgaaaatgagtatgttttacattataaatgtgattatgatataaacaaaattagaaaaaatataaacatgattataaaaattaaaaactatgtgattttacagagaaaccccttgtagaataagaaagaaaatgcattcttaatagtttttgtactatttatattactagcataacttgtaccaatttttctacttttgaaaaagaactcaactaaaaaaaaccccagccaaaactttcatgttatgtgcatatgaattaatagtaatttaagatttattacagtgattacatatcaacagagataaatatgtgttttatgattaggttttttttttttttaaacaggtgagcaatagggacaaattcttgatgtagaaaataaaccatttcagtgcctgttgataaatagacagtatccactatttcttcatggtgcatggcaacgtgacaaataaattaccttcattaaagatttgcatgaaggattaatgagcattagttaagccataaaagcacaaaaaacatttttgaaaaattacattgaatataagaataagttgaggggcagacaatctcgttataataatttatcttgcctgaagattctctgctgcacctatgtgataaatgaagcccaaaagcaactcaagttccacatttaacatagaaaatttaggcagttcacaactctagagggttttgtcctctgtgactcacctacctataagggggacaatttataaaacacttatttgtttctgttagtattcagactgcaataaatcttcaaattttcaccataaaatctgcataacatgaaattaaaagaagttaagcatttttaaaaattcatagtgaaaaaatgttgagtgttttaaatacctgccttatgaattttcttttgcttttaattcatagagctaagttaaaatttaattattcgtgttatgtataaatgacaattatcctttggataaaaggtaatattttactaagtaaaacacaggaatataagaaaactttattttgctaaccgaggtcttaattttccttcatttggaatactgtccaagattaaacctttctacgcatcaaacactgtcatcttgtggactgccattgatttcagaaaatacaggctaatttaaaaattattatctgtgcgacttttcatggtaaaatatttggacaactctgtaaatcttaatgtaagtggagatgaggaatagtatccttgtttgtaactgtgcaataatgaagcttttacatttatgaacatctgtatttcaggtccccgtgctggtattttatagtaggtctctacccagcaggccacatccttactgtttgatatggttaagacttgcatggcattgtgaccatggtttaattacagtgtgacttaatggttaatagaaataatcaccagcctgcttttgttctggtctggtgagtgaaatctagacaccgctctaattagtcactatttcaaacatctaacttttatttgcaaaattacatcccatgcatataaacctcaatctagtaaacatttgaaaccactattcaccaggtttccttttctcttttcaaataaagatcgatgctttgtaataattcttaagttattggcaactctatgtcttagttttcccatttgtaaaataaggttacctattcctatgagaattaaatgaattaatatacatagagcacactgcctggcacattctaagtgtggtacacatttactagattgtattggtgctccatccagaccttcacccgatgcgtgcgcacatccagcagctgctatgaagattggctgcttcctcttctccagaaaatttgccacacctggaaaatcgtgcttcctgccctcattgcattccacctgccccagccagcagctaataacttatggatacaggggagagggtgcaaatagcctttgctgatactctttgccttcttttgcctcacttaccagtgctgcagtgaaagttgtgtttgagaaccccaagtgggatcaatcttaagctaatctccaacagggaccacatccctggttagctttatttttttctccctcatcttacctcgcttctcttagtttttcctcctggaaaaatgttgtcaaatcatatctgagagtcctcttcactgactctatttctataaacccaatgaaagacaataagtatctactcttgttgttgtcgttatgcccactggtgtcttgatttaatgaagggtaaatgctgagattacctttgtcatgtccaaagttgaacggagtccatggaacgactccacagcctttcagtagttctccatatatatctttttttaagctaacattttcacaaatttgataagcacattaaggtcatagtccctggcaagattctggggcacaaatagactgttgttggttaaggcagggatttgggggctttatcagtgaattatgggaaacctggagtgaatgctttttaatgcaaagtttggaacctaggttgagatcgttccgctgactcttgcacactgttgagtaaacactggccctagacctgctaagagcttacaattcaatacaacgtaaattaaaaaccccttagcaaagcaagaaatttaggccgccttttgaaaagggttagcaatgacctttatatctagacacagggctcctgggataaaaatgtcctccacactgtgaagtattccacagagaaaagaaaaatagttgctgtcacccagttggtataatcacttgaactctagaacttggaattcactagctcagacctgcttaagttgtggatcatgagatgacgccagtttagtactgttcttattatacatattattttatttatcttatgtttttctaaaggtgttttgaattaaatgtgcataaaatattttcctgtcttggtgacataattatgaagaactctgcttcttttgactttaggtaacaaacataatgaaaatacttgtctccaaagcataaaaaagagaaaattattactttgttttgttcaaccaagataactaaaatttaatgtaataatacagcctactttgttttaaagtaatttcatttttcaaacatatgacaagtattctcttttgcattcttcacaacatctttaaaaatatcttgattctgaggctgggcacagtggctcacgcctgtaatcccagcattttggaaggccgaggcgggtggatcacgaggtcaggagatcgagaccatcctggctaacacagtgaaaccccatctctactaaaaatacaaaaaaaaattagccaggtgtggtggtgggcgcctgtagtcccagctactcaggaggctgaggcaggagaatggcgtgaacctggtaggcggagcttgcaatgagccaagattgtgctactgcactccagcctgggtgacagagcgagactccgtctcaagtaaaaaaaataaagtaaaaaatcttgattctttctcttggtactaaccaagagtcagacagctttattctattgtaactttcaggatcttcgtctctggttgtgtttttatagatgaaacttttgacacttggaaattaaatccaattgtacgaggtacaagatgaatttatattctacaaaattgtgctttatgctagatagtttatcctgagccaatagctcccctattgagcagtttcttcatgttgaacactcatttaagtggcttgtgtaattctcagcattactaccacgtagacattattgtcccattttatggatagtgaaactaaagtttaggaaaattaaattacaataatgaaagaagattaatataatgataaaatataggcttagagtgagaagagaagttttaattttccctctgactctaatcagctgtaattttccactggttctttcacctatttgagcctcagacctttgatgttgaagatgattaaaataataataactatatttctgtagaactaattttacatgaaatattgcatttaaccttccctttcttccatcagttttagtttacagatgagaagattaatgcttgagcaaaattaaatagctttcctaaaggtcatgtagttagtaggtcatgcagccatctttgaatgcctggtctctgtgattttgaagtccatggtcttactcaaaatgctaatttctaatgtgtctgtgtgtaatagggaaagtggggcgcacagaccaagggaagaactaggtaaaaaaaaaaaaacatgaaaagtatgtgactcacggtaaactcttatgctaattttttcccagctctatctgatattttcataatatcctcaactgtgctttgcatatttcactactacttgttgatatcccagttgccttgatctcagttcccaccccaaatctaggagccaaaatgatttttctatatgatccattaaataacttgagctgccaatcagcttcttcaacagaatattaataagcatgctcaagcagaggcaaataattggtcatccatgaggctattaacctctgatagggattggactacctaaaatttaatatcccttatctctaatatttcatctaacttacctagtagaataaatcatgaagttatttgatagtacctttgtaaaaatgatctttttctcttttgctcattcacagtacattccagattgttaaaactgtctatattactataataaatagagactcagtgtctctatttagcccaacaacaagcatcctctctgactcatattctcaaagccagaacaagccaattttgatcttagaaaatttgtaatgaagtttaatatgtgaaaataaatccactcttgttcttaaaatttagggaggtttgtataaatagattatagatacatttctatctcaaatatgcatttattcaccaaatatttatggagcaactacacaccaagtatcttgttgagttttaaaggtatgatggtgaagaaggtagattcaatctctgctcttcggagagtaattgacatggctaatagtgactttttctgtttcaatcaaggtacacatcagcattgtaaaatatatttcccaccaatttcaggttgtccctcatgctcagtagtaatgaataattaagcggacaattctctacaatttctatcataatgtcactaattcagagatccaaagtggtaggattgggtacaaactttcaaaaaagaaaataattgtagtgaaaatttttaaaaccctatttttctccaggaacttactaagttatcctatttaagtgtcttcacttcaattaagtcatcatgaaagagaggagatgagtcataatggatgatggaattatgaaaataaatgtgattaaaagacaatttgtaaatattaaaatgctcctgacatatactctcctaagcagcatcagtaaaaattaatacaagcatatagaaaataaataaatgcaaaacttgaactatttaaaaaacaaactaaaagttatttattttttatttttttgatttggggtctaactctatcatccaggctggagcgcagtggcacagtcacagcttatggcaactttgaactcctggcctcaagctaccctctcacctcagcctcccaaagtgcggggattacaggcttgggctgctgtgcctggacaaaagttatattttcataataaagaacaaattataaatatgatttttggcaaatgaaacattaaatctcatattacagaaataacaaaaaaatagggattttggtaaataaggcctgttaactgagaatcttaccataaagttgagcattttataaaaatagagaagcttctgatttttaagtttttctttctgtacttacagggataaagaaaataggctccctgggacagtttcgttattaattgagtcattcaacaactcagatgctatatccattgtgttctctccaaattctttgacccaaagcctctgatgtgtacacacactattagaaagaagaatggttatttcccaacatgtagttatattaaagaatgttgaatcactgtgattactcattgaacttgttttcaaagacttcagagagtccagtatgcagtttcattccccattctcacactttttttttgttaatggcactgcagttaagagaaatgagcatcattgtccacatgtgtactcctgtttttgtatactctgtagatgtggaaatgcgtcacttaaataatcatctttttaggggagcaaagagaagatcttctgtttattgacactgaatcagttgcagcaattgcatagaaagtctgcaatatttgaatccctaaaatctggacattcaattagggcaggagacagctaacctggaaatgttctcactaccaaaatttagaaatgatgactgaaataaagcagcgaaaattccaatatgtagctgatctcacaagaaagaaaaggaaatcccgaagtatcagaaacaaataagaactaaaatccaaagtatactctctggtgttaaccctgaggagatcttggaagcaaggtacattttttatatgttacagaagtagaccctaaagtctaaaacctagaggatgaatgatcatgccaagggcaaaggacaagtccttgggcctgcctaagaatggaagttgaatagcagtgtctgcccaagtcagactccagatggaatgacctgctggttcagagtagaagacaaaaattccccaatgagaaaccaaaagcctatgcagcacatgtatttgtggcccaaatgcgtattaccacatagtatcaaaaatatgcgattgaaatttaacataaacattgatccttttgttgcaattgcttttggtgttttagtcatgacttcttttcccgtgcctatgtcctggatgatattgcctagattttcttctagggtttttatggctttaggtcttatgtttaagtctttaatccatcttgagttaatttttcataaggtgtaagcaaggggtccaggttcagctttctgcatttggctagccggttttcccaacaccattttgtatacctgtgtaacaaacctgcatgttctgcacatttatcccagaacttaaaggataataataaaaaaagaaagtaaactacatagaaaaatggggaaaaaaattgatcctaagtagggttcatgcaaaagcattctcgaggaagactttcataacgtagatgcacagtatatctcaaagtggtcattgtctgctgaaatagggactactcactgaagaatcagaccaagaacttctaaaacattttagttgctttagataaccatactgttaaaaaaaaaccttaaaaagtgggaaaatcatagttgaccaactaatctcaatatcttctgaaatgaatgctactactactaaatgtttaccaccgaataagatcggcatgcattcaattatttttaagggccaggtgcagtttgtatggaagaaagtggtgtatgaagctaaaggctgtggcaccacagctaaccatactatttccctgaaatattttatagttctcaggttacaatgtaatactaaaaataattatagatttatagtttttttatgattactttgaaggcaatattaaataaatgtgaatagataattgaaaaccttataggaggaagtaaacaggaatattaaaagatgtttagctcagtccaatattttcatttttggcactggcagaaaatccactgcaaactcaggttgtcagctcttctattgcgtactatttctactttttatacttcttggaattatgaaatgcttcactacatgaaactgaaaacttacttgaagaactaaataagcatttttgagtccccaaatacttacccatgtgtaatatctgagaaaataccaattttgtgtaaatgtttttctcctattctaaaaatacaaaacattaactcaacaaatatcatctgtgtaacagaaacagtatttttaaatttaatgaatgatgtcctgtaattgttagttgctttcttttctctgtaactttaatataaaccaaaagctaagaaaacccttattttatattagattttagtaaaataataaaaaaatttgattttagtaaattatctaaaataaatatatattaaaaaatatatgaattatgtgtgaatgacaagtaacacttccattatagcaattaaagggattcacattgttaaatgtgagaaagccttgaatttagagtctacttgagctgtataagaacaagttgaagtatttcaattatactttatggagttccttcattcctttgagtaaagtcatgtggatattttaaataaattattaataaaatattaaatgtactgaaggctgtcaactgggtgatggtaacagtaaaaaacacttttctttataaaacaattgttaaaatatttgaaagttttggattttgtatctgtatattgtaattatgcattaatgcaatacaacatttcaaaattctcaggcttctgctaaatatgtaatttcccctttttttttgagacagagtcttgctctgttgcccaggctggagtgcagcggcatgacctcggctcactgcaagctccgcctctcagttcaagccattctcctgcctcagcctcccaagtagctaggactactggtgcccaccaccaggcccggctaatttttttttttttaatttttagtagagacggggtttcaccatgttagccaggatagtctcgatctcctaacctcatgatccgcccgcctcggcctcctaaagtgccaggagtacgggcgttagcccccgtgtgcagcctatatcatttattttaataataaatattagcgaaatcttgcttagaatcaatgttcaactcgtcattgaaatttttctgtggaaaacagacctgaaaatatttaagtatccattattccttcagacttgttttatatcctctttactgtttttcttatatttaaatggtgcaggtagaaggagctcctaacataataatgtttagttaggctgggatgataacagaaatgttacttttcatattttatgaatgcatattattcattaagttcttaggtacgttgtcttggtggaagcttatgaagtacgtaatattctaattatatgaattttaaaaatgaacctcaaaaagttagttaaatactggctcagtttaaaccatcatactgtctctgaaagtcccaatgaacttaaacttaatttagaagttaaactaagttacaaaatgggatgtgtgtagagaacatttggacagaagacatgtagtttgcctttctttgataagtttaattgcttaagtgtccctgtctcacaccttctttacaataaggtctatatctgtatcttcttattctacattgtttcataggtttgggtaaattttcttcattaaattgatctttgagaatggaaaattgtctcttacctttctattttcagtgttatcatagttctgagtacctaaaacatgttcagtacacattggaattgaaagaataaataaacgagtcaaggtcagacatcgtaagaaatatttcagatctcaccgtagtcattaacaataatcctttgaatataaaatactaaattatatagatacatggatcaaatatgtatgaccttgcaatatatctaatgctttctaaaggctttgttgtttgagctttgtctgttaatgaaaaaatcaaagtctttcgttgaccaaattttgtgtattttcagagatcatctatagctgggtatttaatgagttcccttcctttgtggcggaagacagccggcggttcatctcccaggagacaggcaacctttatatttctaaagtccaaacatcagatgttggcagctatatttgtctggtgaaaaacacagtgacgaatgctagagtccttagtcctccaacgccactcactctgcgtaatgatggtaagttgcttggcccgttaaaatggtcagccaactctaatttggaaaataaagatgtattagtgtgtgttttttttttaagacctggaacttacaaataaaataaaaaggcatttgccatatttagacactacatttttaggccaggattttgcatgccttagaataaaagtttagacataagaaattgatgatccatggttgagaaatattcaccataatgctactctaatgccagaaagggagaaagaatctgataaaaagaaccataataaatactccacagttctttcctttgctcttcagtgcctctatataacatatgtgtatgaattgcaagcattttatgggttcacttttcattacatttttattttagctgccttcaaattgaatgctcaggttttaatacttcatggtatagttataattgtgattattacttttccaataataggagcagttggaactgtaacttttaggtgcaaatcaggcagaagtgatgattctataattatagtattgccatctatccaaagtatcttcaaatttaaacacctcatttgtatttatagacatgtacagttaagcattgcattaaagaattcaagtgctatattaccattgatatatgatgtgtagtttgctctgtcatgcagcaaaaaatctatgaaggcgttattaagaagcatgagaatcctggttgattgtgaaacttaaaaaataatctatttaagtgctgttttttcatatgcttggttttagaatatatgctgctggaatgtatgaccagagctatatcacaagatttttgcttactacttagtttatatagactttgttgtttgcgtgtgtgtgtgtgtgtgtatatatgtttatatgtatatatataaacatttaaatatgtgtatttatgtaaacaagtctatgaaacttcataaactgtgaagtatgtattatatatacatatatagatagagatacacagtattatataaaatatatataatagtaacaacaccatcaggtaaagggtaaaaatgtaatattcattttaaagagaagaaagccagtattaaagaaatgatgaaaattgctaaaggcctcacagttaggtaacggcatggagaaaccagtagaaaaaagaatgctgacttggaaaccaattcaggggctacaaaaactaatccgccaagaggcgataaatgactgaacaaaagcagtgatggtagcactggaggacaggaaacattaactgggatattaagaaggtaggattaccagcatttgataattaatgaattacaggctttggagtaggtggaggctagcatacacaaatatttcaaggctttagcagagttcattgaatgggcgatgattctcctcatcagaaaagaacacagctgaagaagtagagaagtagttaaaaatgaggaattcagttttgaatatgagatacagggtacatgggaaatccatgtgaaaattgggaataggtaatcagatacatattcctaatacccataagagagagctgggctactgaaagagatttaaaagtcatcattgtgtattacatcaccatagaataatgtgtatatattatgccaacttcaagattgtgtaagagtgtctatagatggaaaataaagaaatgcagttttacagtttatctaattaaaagctttgaattaattctctataagctatttctccaaaacttctgagcccctttctccctgatttcttaagacgttattgcattcttatctgaaaattataacttttttggctaacaattaattccattttcactatccatctgtataataatactttatatttgaatagtgcctgaggttgaggaggctcttccaccttcttttcacaccagagacctctttctacacattgccgatcacaagggagagtagcacatgtgtaagacagtgtccatgtgcaagagtgttttgcacttttggttcatggcccagatatatcacttatctttacgttctaccttccatgggcacacatttcatgaataatcattcgctgatatttaaatccctttgcctctgtgtcttctgttgcccttgtttggcaaaaccccaactccagtgaactcaattatactcttaccctgtgactgccttgagattctgaaagctacctgaaatgtttacacccaccaggggttcatgatcatcaatttcaagtgggctctcaacattgccattcaatcccaagtttctgtggacagcttaatttgctactctcccctaaatttttggaaacttctgtgctttccttagactggattgcctcacgaccaccacttcacaaaaactgtgtaccttatcaaatcatcttcctactaataaaatttaaatcttaactgcatctccatctgcattgttatctcccatcctatttcaatagagatagtatactgtccatcctcctgttacaaccaattcctccatcctgtactattgagaatcattccctccagcctttcagaaaattacactataagtcattgcttcttatataacagaattctaggtcactaaactaatactgttttggtcattatgttaattgaactgactgtagcagttgacgttgttgacacttttttcttttacaaacgtctatattttcaaaaagtcattatttgagaagtactatataaaaggctcaataaagcaagtataaatcaataaaacaaaactgttattttaaggttgacatttaacaaaaacaaaaaaaccaggtaggaagcatctgctaaatttctgttacatcgttcagtaacagtcttattttttaccagagaagctacaaaatttacatttgtttttttctgtaacttacctaaggctattgctttctcggcttttatttgtccattttttttttaaatccacattgaatgaatgtagtgacatagaaaaacaaaacaaaacaaaaacccacaaaatcctactcacctctccctgccactaaatctcacgctggagagccaaacttctaacttcccttttttgttgttgttgttccataaggttctcataaaatgctagaaaatatctgcacgtcttggttactcaagcttaaacaataactgtttattccttcatttgataagtgtgcataagtttcttccttccattttaatatgcatttttaagtttactgttgcttatcctttaaactttaataatatactgaaatttctactgctcttttaactcgagtctaattcatagctttttatgtcatgaaatgaggatcattttattcctcctttttccttcatctttcctaagctacttttatgttttttttcttctacttgtattttggcaattctgtgcagcaaatacaatcttatcttctatacttcttcttagactaactctataaactggaaaatcaataaatatctacagattattaatatataattatgacttaatatgatatttttccaggtttttaagccacttcctagacatgtatactatactggatgtgtttttcatactaactgaaactttgaattaaatataacctaaagaaaaataaggctaataacattaataagaatgcagtatagtttggatgtagtgtttcttaaagttctgctgtacaaaaacaattagtagtttggataacagtgttcagaaaggaacatgagtcactacagtgaaaatcgtaatgaaggcattggtgtggttaagaaatcacggggagagagtatgaaatgagaagagaagtgactgtaaggtcaagcctgaactaatctacattacattaggagggtaaataatgaaaatcccacaaaaaataatgaggagaaggtagagagataataagataataggaaaaacagtagaacaggccaggcaccgtggctcatgcctgtaatcctagcattttgggaggccgtggcgagcggatcacctgagatcaggagttcaagaccaacccaaccaacatggagaaaacctgtctctactgaaaaactgcaaaaattagccgggcatggtggtgcatgcctgtagtccccactacccgggaggctgagacaggagaatctctggaacccgggaggcggatgctgcagtgagccaagatcacgccactgcactccagcctgggccatagagtgagactccgtctcagaaaaaaaaaaaaaaaaaaacagtagaatatagtgtcaaggaagccaaggggaaataagggtttccataagaagtgggcatgtagttaaacatggtggactggatgcatgcatttgctacctgtcgcccttctcagatcctacaaaactaaatctatattattaatgagaatgctgaaggagaggaagagcatcaccaagtgagacatttccatatatttctgaaagaatgaggaaggattgagttaaagtattaaagaagtggagaaaactaaaacacagaataaagtgtaaggggtctaaagaaagggttgaggaccatatgcccaatggaagcttgaggacattctgaaatcaaagttagcactaagaagggatgtaagaaatgggattcaataaaggggattgaagacataacacactgaacaactatttcaataaaatgttgaacaccttttccttctctatcgctatatgcaaaaagtccaaagactcatctcttaataatatgaatgagctttccgtggaaagatgaagttttaaatgtcaacagtggcactctagtgcaaaactcttattctagcattcgtatgccagcagcctgagagccagctccctgtcctcacaccaaagcagagcctggtcatccacacaccccattcagtcatgacccccacacacctcagtagagaaccaattcttcagacacagcatcaggggaactcacaccaacttgcaaaattttcgatatatacgtagagagacatatagatagatatagttatatatacatatacacacacacatatatgcaattctaagttaatagttactgttgaaaattcttgtgcttatagagtgattacaaaattcatactaagataatatgaaaaaacttgaaacataaaattactctaaggaagacgtagattagaatggaattatttttattcaaaaactgtttttattataccttaagttttagagtacacgtgcacaacatgcaggttagttacatatgtatacatgtgccatgttggtgtgctgcacccattaactcgtcgtttaacattaggtatatctcctaatgctatccctccccctccccccaccccacaacaagccccggtgtgagatgtaccccgtcctgtgtccatgtgttctcattgttcaattcccacctatgagtgagaagatgcagtgtttggttttttgtccttgcgatagtttgctgagaatgatggtttccagcttcattcatgtccctacaaaggacatgaactcatccttttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttggttatatacccagtaatgggatggctgggtcaaatggtatttctagttctagatccctgaggaatcgccacactgacttccacaatggttgaagtagtttacattcccaccaacagtgtaaaagtgttcctatttctccacatcatctgcagcacctgttgtttcctgactttttaatgatcgccattctaactggtgtgagatgatatctcattgtggttttgatttgcatttctctgatggccagtgatgatgagcattttttcatgtgttttttggctgtataaatgtcttcttttgagaagtgtctgttcatatccttcgcccactttttgatggggttgtttgtttatttcttgtaaatttgtttgagttcattgtagattctggatattagccctttgtcagatgagtagattgcaaaaattttctcccattctgtaggttgcctgttcaatctgatggtagtttcttttgctgtgcaggagctctttagtttaattagatcccatttgtcaattttggcttttgttgccattgcttttggtgttttagacatgaagtccttgcccatgcctgtgtcctgaatggtattgcctaggttttcttctagggtttttatggttttaggtctaacatgtaagtctttgctccatcttgaattattttttgtataaggtgtaaggaggggatccagtttcagctttctacatatggctagccagttttcccagcaccatttattaaatagggaatcctttccccatttctttttttgtcaggtttgtcaaagatcagatgattatagatatgcagcattatttctgagggctctgttctgttctgttggtctatatctctgttttgatactagtaccatgctgttttggttactgtaaccttgtggtatagtttgaggtcaggtagtgtgatgcctccagctttgttcttttggcttaggattgacttggcgatgcgggctcttttttggttccatatgaactttaaagtagttttttccaattctgtgaagaaagtaattagtagcttgatggggatggcattgaatctataaattaccttgggcaatatggccattttcacaatattgattcttcctacccatgagcatggaatgttcttccatttgtttgtatcctcttttgtttcattgagcagtggtttgtagttctccttgaagaggtccttcacatcccttgtaagttggattcctaagtattttattctctttgaagcaattgtgaatgggagttcactcatgatttggctctctgtttgtctgttattggtgtataagaatgcttctgatttttgcacactgattttgtatgccgagactttgctgaagttgcttatcagcttaaggagattttggggtgagacaatggggttttctagatatacaatcatgtcatctgcaaacagggacaatttgacaattcctcttttcctaattgaataccctttatttccttctcctgcctgattgccctggccagaacttccaacactatgttgaataggagtggtgagagagggcatccctgtcttgtgcccgttttcaaagggaatgcttccagtttttgcccattcagtatggtattggctgtgggtttgtcatagatagcttttattttgagatacgtcccatcaatacctaatttattgagagtttttagcatgaagattgttgaattttgtcaaaggcctttttctgcatctattgtgataatcatgtggtttttgccgttggttctgtttatatgctggattacatttattgatttgcgtatattgaaccagccttgcatcccagggatgaagcccacttgatagtggtggataagctttttgatgtgctgccggattcagtttgccagtattttattgaggatttttgcatcaatgttcatcagggattttggtctaaaattctcttttttttgttgtgtctctgccaggctttggtatcaggatgatgctggcctcataaaatgagttagggaggattccctctttttctattgattggaatagtttcagaaggcatggtaccagctccttcttgtacctctggtagaattcagctgtgaatccatctggtcctggacttttttttggttggtaagctattaattattgcctcaatttcagagcctgttattggtctattcagagattcaacttcttcctggtttagtcttgggagggtgtatgtgttgaggaatttatccatttcttctagattttctagtttatttgcgtagagatgtttacagtattctctgatggtagtttgtatttctgtgggatcggtggtgatatcccctttatcattttttattgcgtctatttgattcttctctgttttcttctttattagtcttgctagcggtctattaattttgttgatcttttcaaaaaaccagctcctggattcattgattttttgaacggttttttgtgtctttatttcctttaattctgctctgatcttagttatttcttgccttctgctagcttttgaatgtgtttgctcttgcttttctagttcttttaattgtgatgttagggtgccaattttagatgtttcctgctttctcttttggtcatttagtgctataaatttccctatacacactgctttgaatatgtcccagagattctggtatttgtgtctttgttctcgttggtttcaaagaacgtctttatttctgccttcatttcgttatgtacccagtagtcattcaggagcaggttgttcagtttccatgtagttgagcggttttgagtgaatttcttaatcctgagttctagtttgattgcactgtagtctgagagacagtttgttataatttctgttcttttgcatttgctgaggagtgctttacttccaactatgtggtcagttttggaacaggtgtggtgtggtgctgagaagaatgtatattttgttgatttggggtggagagttctgtagatgtctattaggtctgcttggtgcagagctgagttcaattcctggatatccttgttaactttctgtctcgttgatctgtctaatgttgacagtggggtgttaaagtctcccactattgtgtgggagtctaagtctctttctaggtctctaaggacttgctattcaaaaactttcacatcactatttgatctctcttcaaaaaatatgattgaaaagtacgttcataagaaggacactttcctgaatgttttcctaagtagatggcacatattaaacacttgttctgaaaataaaaatagaatatatattgcaccacggtcagctgaaattcctgctgggttttagaaacctctcaatgcagagataggcattacaatgaatgtttctgcaaatgtggcaaatgcctctgtaggggtttgaatataaaaattatctttaatctgctgtgaccatagagctggctaaaaaaaatcatttcaagaacattgtgtttttacacttctctgaaaaaatgtagacctttctaaaaataataagggacatatgcaaaggcagtatttttcctttcaagtagaaattgaattttacttaataactctctcttataaaatgtattatcttagctttggttcccctaaagcaaagctgggaacaaaaattgcttgtaggtagtttatttcaaatttatccccagagagcaggattaagagatgtgatggcattgataggtgaagccagaggagagatgcattacagagatgaccgcttctacaggcatcttgagcttgagcccacaggaccagagccttacaaaatgcactcagaatggtcaccttggagggtgtattgatggactttcatctcccattcccagagtgtaattctcttagcacttaactctcttgttctttgaggttgccctcaagttgcagctttgtgaaactggttgcacctacatgaacctggttgcagtagcatttgtaggagtaaaacatctggtcaagatatgttgaactagcacacaagaagtatctgaaacatagatggtagtgagcgtagatcattttcacagccctagcacacatttcttagagaaagtgactccttctaatacttacataaattcaaatatcctaatgttgaacaaaaaaagttgactttctgttatttattcagtttatatgttgcttccattttgcatttggtgacatatatatgaatatgtatctgtggtagggaggggctttagaggggcttgtggactagtgagaaagattattactgtacaaaatgctgtgatagattgatagatatatgttactttggtaacccctaatagaaacatccaacccagatgatacataagagaatgcttcctggaagaggtgatatctgagtttagttttgaagtaatttggtattaggtgactaaataaagagaggatatttgactatccatcaagtacaagtatagaatacacagactataataaaattgcacttcagtccagattaactaaaatgcaaggctatacgaaggaacagaatgtcataccatgaaatgctttgttgaccatattaccaaagcagtggtgaaggtttggaagatttgaagtgcgtagaaacacaatcattttcccttactgacatggtgaaaaattattctcatgcattcacaaatgtgtattgtctgcctattatgtatcaggtattttgttaggtacaggggatacaatggagggtgaagcaaacgtaactatccttgtgtagcttccaatccaatatgaggtaggatattcccataaaaactgacacagattctgtctgtaaccgcgcactctgggatttgcctgtccttgttcagcatcctgatgaggccaagctcactattattgcactaaaaacaagaccaactccaaaaggatttatgagtaatacagatgtttattaatgtcttggagggtaatgtatgaggcgcttgcgttccacaaaacagcagaatttattgaacactccccattaaccacatctaatttttccgagccgtaattcctcaacagctataatttcttcctcaaacacctgtgcctctccctgtaacagtgttgcttccagtctcccttcagggtcttactacctctgtcttacttggcaattttgtaccttcatttttccactcatttgagttcccagcacagttgttaattactttctaaaaacttatttttatttaatctacacttatgttttctgcatgggaagcactgttttaaaaatggtacaagtattaaagtaaaaatgatggaaaataaatgccaacaaatattaactaaaaagaagttgaggttgctatattaatatcctgtattaagcaaagatatagcaaagctgtacacatcttcgcaaaattcaccatgtacacaaccaggcttctcacctttctttcagtccatgtgggatctttccctacaagatctcactacttcctaaggcaacattttcccatccgtctctggagttagatagtgtagtagagagatttcaattagtaacttaagaaagtgagtggaaatagattgagaatgcgtgttgaaagattactgtttattaggaaattcatcagttgtcacagtgggggaaaaatgtagaaaggctacacatgtagataatctactatttggtggtggggagtctatgattttcatttttaattaatgaactacaggcaaactaatcagctgagaatgtatgtgtagataacatgtttattttaaggaaagaattgtgtcaacatggaaattctgaccatgattacctaattacattaggtaatttgtctgagacaaagcacagagagaatggatctcatgttgtcctctgtgatccctgagatttggtttggtactcaacaatggaatgtagcaaagccactgttatttcctgattagtctgtttatcataaaggaatatggtaattggaatagctttgggtacttttttttttttttttttttttttttttttgtatttcccttctaagtgctgctcctcgggtactgaatattctatcctaaatccaggagactttttctttctctaatcttggttcagaattttcaattatggatagttctaaggggactgggaaagttttgacaggaacactcctattgggatacatttatctctgctaaggaagctgaataatataaaaagtttgtatcaaactctgcaggaatatagaaaatttggcttttgttaatcttttatttatttttctatgtgtctctctggaaagcttataatcttgatataaaaatttaaattaaaacatcaaaaaaattttggacgatttttgaataagatgaatacttcatttgctcacatgtccttggcaatcagtcattccatacaatccaatttcttcctaagcatacttaaaaaacaacttgaatttctgtctataaagagaattttttatcagataaaacagtgtgcagcattttatgaactctctcaatttgtcttgaaaccttgggagaattacttaatacgtggtaacaaataacaagatgaatttgctaaatatatatctaacttagtctttttcttgatttcctatatgattgcctgtcattgtaattcagaaataaatttctgaaagacataaacttttgataactggcattgtaactatgaacacatctttcttcatgaaagaaaggaatgtgaactttgagttgacttttgcagtggtggcaaagatatattcacttacgtttatctaactttttttaatattcagatttcttgagaaactacttgacactcaattctgctgctgctatgcctcttcttccatttaataatctctaattgggcatggggcctcaccatacaactcacagaattttctctaaactagtcaggttacttttaatcaaaggtgtcagcattgtctcagccttcattattctgaccgctctgtagtccatgtacaaagctgcaaatattttcttttcatctttcctggcagtttgttctcccaaactctttcatttgtacctttcactgtctcttctcaatctacccccaaatcagtcattccatgtacttatccatttatatgtctgtccacccagtgtgtcttatttgcacttggcctttgttccatgaagaatttaaggaggcttatcttcttaaatgtaggtgttctttcaaaactccactcctcacccccatgatatttttaaatatttttttctttagtgaatacttctatctctgttttgaatttagaatatcccacaaactaacttctgcagctgacatttgtgctattaattacattacctttctcctagtcatcaaacataaacatttctgggtcaattagactcctaatctcatgatcacttatgccataggttctgcaagcactgtggattctacatctgcaatgtcattcttagccattcctttcttcccacttctaattccaacactcctttacctgacacccatatcagtggctttgaactccttctttctgtagctcacttaagatgaatagtattcctatccaaaacacactgtcaaaaacattgccatattctagattgtagcaaagaagtgaggccataagtataatatcataaaactaattgtaacgccacttattgaatgcaaattcacaagagtgacatgattacacaaatttaaactacaatctatttgcctaatttggtttaaaatacattggtcacaaacttgagtttaatttattatctacttaatcttagacaaccgactttacctgtttatgtctcaataatgaacatggggataatattggtacttatctgatagggttcctgtgaggatgaaatacatgaatacatccaaagcacttagaaaagtgcctgttatttaacaaactttagtaaaggttagctattaacacagtacttatcctataattcccacagcattttacttgtgcatgtgttgcgggggaggtgcgggggtattgcagtcagaaactacttttctagatgattggtaatattgtagtttttgtcattgctgttgttgtttattgtaaaaacgtaaactcccctgtcaagaattgagattttaatagagataaaggggatggatgggcggtaacattgggaggagctttatagtccattacttgccttcaatagtttttcactccaagccttcctcacagttttctgactccataatttttctttctgttctgtcttcatgaagtaccctcttaactcctagctctgtctccaagaatgcaaatgatttgccaaagatcatgaaattagttacttacaataaactggaataaagcctaccatataataagcatagtttagattttattctaaaagcttttccttatgcttgtccatattgaaattcatctgccactttcataataccacccacacagccttatgatatctccatgcaaatcgtatttaccagcttgacatttcactcactacccagtagagctcagtattacctgagatgttgagaattttattcaccctttctcatgttaagatactttacaagaccgggcatggtggttcacgcctgtaatcccagcactttgggaggccagggcaggtggatcatgaggtcaggagatcgtgaccatcctggccaacacggtgaaaccccatctctactaaaaatacaaaaattagctgggcgtggtggtgcgcgcctgtagtcacaactactggggaggctgaggcaggaaaatcgcttgaacccgagaggcggaggttgcagtgagctgagatcgtgccactgcactccagcctggtgacagagtgacactccgtcacacacattaaaaacaaaaaacaaacaaacaaaaaactctacaaaataatcaacaaatgccagccctaactcgatctctaaagactatgtcattttgccaacacatagcttcccgtatctaaggtatttcgctacccatgagaaaacattattctcccacagattgaaattatataaatcgaaattatggtcaaagaataatgttttgttatggctaaagtttataactcactaaagactaagataatcattagcattatttagcaataaacatttttaaattataatatttaattttaaaaaaatttatcaaaagattttaaaagtctgcataaattatatctagcaggccagcactcaataatgtgatccccaaacatttgtatcaggataattgacaatgcttaagaaaaaaaaacaaaaaaaacgggtgggagcggtggctcacgcctgtaatcccagcactttgggaggctgaggcaggtggatcatgaggtcaggagattgagaccatcctggctaacacggtgaaaacttatctctattaaaaaaaaaaaaaaaaaaaaaaaaaattagccgggcgtggtggcgggtgcctgtagtcccagctactcaggaggctgaggcaggagaatggcgtgaacccgggaggcggagcttgccgtgagccgagattgcgccactgcactccagcctgggcgacagggcgagactctgtttcaaaaaataagtaaataaataaataaaaataaaaaaatgtaaaaatattgggtcatacttcagatctgcccagagtttctggggcagtcctagaaagcagccttttttcactccagaattgtgtaaggtgaataaatcagcaagaagcactttgtttggaaatacaaggcgtgtccctgcgcctcaaccttaccaggatacaagagcagccctctcccagctgaaagtactaggaatagttaaatccacatgctctctctttctaaagttgagaagcacttccatttccactgagttgtcaggtcttcccagaaccacacccagctagcagactatgcaatgtctcttagagtgttcagtgaccttgaaaagcagagtccttcagaaaatttccgaagagaatgaaatcttgaacctactctttccctgggaggcctgaggagaaccagggttttcaaatgcaccatctggacatacctagagagggccatcttgtttgtggtatttcctcagagagaggattggaagaggattggaagaacgagaccagttatgatctgtatacaaattatcctcaccccatatatcttaggaatctgcattttccacagtactcccagatatttcacatatattcagtatattttaattgtgtgtacagtaaaatgtactgagtgtttccgtacatttccatggtgagaactaatcattacttgcgacatgtttttttaaaaagatacatatttctttatattttgaaatctcacttttatactagatagggttgcctaaaaaaaggtgaatgaaaggcgataacaaaatcgtgttggagggaatctcactaaaaatacagattcctggttctcccttagatattctgatgcagtcagtctgaagtggagaatgcaggtaattctgacaagcatcactaggaatttttatattcagtcagattatgaaacgtctgacattttatctcaattagtaactgtggctctctggggattttcaggtggtcgcagtatttctgcagttggtcacttgtcatgtatttaattcctagtttttgtgggcctttaaggtaattatagaaatttagattaaaatgtttatttgggaggggtattctcataattgagctgccataggtgatagttgttctttccactttgcttcgacagtctttcttttgttaataagagagcctattttcctatggttttcagttttccttatcatgccttgcattgccattcttaatatgctctacctgatttttctctgaatatccagtaaggtatttaaaaataaccttaaggcttcctgtgaatcattttaaatgatttccttccatttttttctctctgcactaattctcacgttttgtctcagttaatttgtctaaaattgagtaatgtatggtggatattttatttccattatcctgcaaggattctggatttattattttgtgatcatttttattatccagtattaaaaatcacgtacaggatattgaggattctaaaactacttctggaaagtaatttgtaatatttagaagtgtttcttccagagttcactccaatgagatattttgcacatttaccataaaataacaagacatttatttcttaacaaatgtactgagcctcatatattcaaatgagtgttgtgtcttcaaagtagacatactgagaggtaattcagttataccaatataatcctgccattattcaaaatattttaaaactcagtgattcatcttgctattttataacgctcatctttggagctgtagaggagagatagcaagctgcctaagtggaaggcttgataatgattaacattcttcctttgcaccagccactatgctaaaagcatttcatacattctttcatttagtcatcacagcaaaacagcattttgagcttatcttttttttctaggtaaagaacctgtgatttagacaggcagcaagtcctattgctcatgcttgtctgactgcaaagagtacacgcctaatctttatactttattgctcagttaacatcagttaagggacaggcacaaggtcatagttggtgagaggtctcgagctacagatctaactcacggtgattgttttatctactgtatcatcctgcctcccttaggatatcagtgctacattgggatattggattaatttcatcaatattaccagaaatcaaatttaaagggtgtggttagagatgatccttacagaagtaatcagtattagttcctgcccagtttcattggaataaatgtcatgaaggatattcttctcacttctgcaagaaggaaagaatccatcaaatttatgaaactaggaagactatatggagcaacccacataagtaaaattggggttatggtgatctgtcggaatgacagaattcatctatagggaatgtaaggttgcctgctacatagtgtgttaattatctgtcaaattatctatcaagagaatgcagagactaattttcttaataattagtagagtctacttaatattatagcatgcttttttctttaaatgtaggttttccttcacagtgtcagagtgttaaaaatattggttataaaggaaaaaaaatatgctgaatccagaattttaaagaatatttacatcatccacttgtttaataaataaatgaaagccaacataaatattttactgtcatcctaacatcatggtgatcaaataacttgtagtacaaattttacagatgggcaacttgcaaatgattcatatgtataaatagctgcccttccacaagtcggccattgccgcaggcccttctgattttgcctttgtttaaataaaagacatagcctcaagaagcttttagagaattggaaatttagaggcaaaggaggaaaagttttttttttacaaaaaacataagaacagttttggcgctttaaggtttaatgggagtccaccccttgcagcagcatgctctggatgtgagacatggagtcattggagattattttggagcttacgttttaatgactgcctggctcgttttcggacttgcatgaggcctgtagccccttggttttgaccaatttctcccttttggaaagggagcatttacccagtgcctgtacccatattgtgagctctaagcttagaaatggattttaaggtagttttggcaaaatgcggcagacccattgtattagcccattctcacactgctataaagaagtacctgagacagggtaatttataaagaaaagaggtttaattgactcacagatccacgtggctggggatgcctcaaaaaacttacagttatggcagaaggtgaaggaaaagtaaggcatatcttacgtggcagcaggagagagagatcgcgagttgggaaaagccacacctttgaaatatcagatctcatgagaactctaccacccccctgatccaatcacctcccactaggccctaccttcaacatatggggattacaatttgagatgagatttggatggggacacagagccaaaccatatcattctaccgcggcccctcccaaatctcatgtccttccacatttcaaaaccaatcttgctttcttaacccatcatgcttttcccaaagtcttaacttattccagcattactcaaaagtccaatccaaagtctcatctgagacaaggcacgtcctttccacctaggagcccgtgaaataaaaaaacaagttagttacttacaagttacaatgtgggtataggcactgggtaaatgctcccataccaaaagggagaaactggtcataaccaaggggctacaggccccatacaagtccataaaccatccagagagtcattaaatcttaaagctccaaaataatctccattgactccacgtctcacatccagggagtgctgatgcaaggggtggaggcccaaggcctttggcaactctgtccctttgtctctgcaggatacagccctcttggctgctttcacaggctggcattaagtacttgcagcttttctaagcacatggtgcaaactgttggtggatctagcattctggggtctggaggatgatgggcctcatctcaaagctccactgggcagcatcccagtggggactcttgagtggggcctccaaccctacatttcccctttgcattgcccagtagagatgttctatgaggtctccacccctgcgtcagacatctgcttggacttccaggcatttctaagcctcctctgaaatctaggcagaggttcacaaacctcagctgttgtattctgcagacctacaggctcaatgccacgtggaaaccaccaaggcttggggctttcactctctgaagcaatggcttgagctgtatcttagcccgttttagccatggctggagctggaacagctgggatgcagagtgccatgtcccgaggctgcacagtgcaactggccaccaggcatggcctgtgaaactatttttccttcttagccctgttatgggacaggctgctgcaaagacctctaacatgccctggaaacactttccacattgtcttggctattaacatatagctcctacttaagcaaatttctgcagctggcttgaagttcttcccagaaaatgggtttttcttttttatctcatggtcaggctacaaattttccaagcgtttattttctgctttccttttaaacataagcttgaatttcagaccatttctttgtaaactcatatgactggccacttttaaaaacagccaggtcacatcttgaaagctttgctgcatagaaatttcttccaccaggtattctaaataattgctctcaagttcatagttccacagatatctaggtcagaggcaaaataccaccagtctccttgctaaaatatagcatgagttacctttgcaccagttctcaataagttcctcaactctatctgagaaacctcagctttgactttattgtccatatcactatcagcattttggccaaaaccattcatcaagtctccaggaagttttaaactttctcacatcttcctgtcttcttttgagccctccaaactgttccaacatctgcccattactcagttccaaagtcacttccacgttttcaggtgtctttacagcaatatcttactcctggtagcaatttttatattagttcattttcacaccgctatgaagagctacctgagacttggtaatttataaataaaagaggtttaattgactgatggttctgcatggctgagaaggcctcaggaaacttacaatcatggcagaatgcagacagacaagaagcaaggcatgtcttacatggtggcaggggagagagagagtgaaggtggaaatgccacacctttaaaccatcaaatcttgttagaactctcatgagacagcactagggggatggtgctaaaccatgagaaaccaccaccatgatctagttacctctcatgaggccccgccttcaacatatggggattataattcaacataagatttaggtgggggcacagagcaaaaccttatcacacattgtcaaagatctcttgctccccatgacataacaaatacactagtcaggctaaaattccactaaattgttgtttaggtgaataagaattatgttattaaaaataaggttcaacaatgagaatttcagtgcagtaatttcactttactgtattttggttgaattacagtcatgtgctgcatagcaatgtttcagtcagtgatggaccacatatatgacagtggtctcatgacattataatggaactgagaattccagtcgcctagtgactttcagtgtaacctgtgtaggctaggctaatttgtgtgttgtgtctttatttttaacaaaagaattgcaaaagataataaaaattttaaagatagaaaaaagcttatagaataaagatctaaagaaagaaaacatttttacagctgtacaatatgtttgtcttttaagctgtgtcataatgaaagagtcaaaaagttaaaaataagtttataaagtaaaaatgttacagtaaactaaggttcatttattattaaagaacaaaatatatttgtgattaacttaatatatcttaagtgtgccgtgtttataaagtcaacagtaatgtacagtagtgtcctaggcttcacatccgctcaccactcactcactggctcacccagagcaacgtctggtcctgcaagtgctatttgtagtaaatgccctgtacaggtgtaccattgttatttatatcatattttatcataccttttttatgtttaggcacaaaaatacttaccattgtattacaattgtctacagtattcagtagagtaacatgctgtgcaggtttgcagcctaggaacaatagggtataccatatagccgaggtatgaagcaagctatatcatctaggtttttgtaagtgccctctgatgttttaacagcaacgaaattgcctaatgtcgcattaatcctcatcactaagtgacgcatgactgcttattttatgacatttaacattgtactgagacagcttcccaaagaggaaaggaagttggtttatatgggaagagaggtaggatagaattgtgatgatcatcatcagagggctttggcatcatttaaagaaatctatttgtgtttttctataaggtcaggcagagagcttttgaggtaggcttaattaggttgctatcccagttctgccccgctttaactatgtgacccactctctctaaactttagattcttgattcacgtaacactgtttctctctccttttgaaattgatgtaaagattagaataattataagtgtaaagaatctggcatgcacagatttttgtttcatttcgttttcttttttcttttggtgctggggattcaagaatggcatgccctttgactctcgaagaactcatgatctagtagaggagatagacaagttaatgatcctgtcaaaagaagtcatgccacaatgtgtgaagagtaaagaggtatcatatttcagaggtacaaataggacaggaactgaactccacagggcccttagaagcatttgcacagaggagttgacatttgagtacagtgctgatgaaagaaaaagagtttgtgaattgccccaattctgggctggcattgcagacagagggaaaaacatacaaaggcactggggaagaaaagtaaatgaagaagaagtagaacatccccaaaccaaaaaacaaacccaccttcatcttttatgtttttgtgtgaggcaggcttctatgaaggatacatgtatatggaggggaggtagtttactttttcttctcttctttaccataagatccttgctcctatgtcctagtacccaaaataactatgttagtggtatgaactgagttcttcatagtacaagctcatagttcataacttagttgttatgaactaagttgtattttgtgtgttaaatagcaacccaaccactatttacaatattctgtagaaaaatgtctttggatccaaagcactgatatactgcagaatacatggaatacaattcattcattattcatcattgtggagaagagcatggactctgaagccggacttcctgaattcaagtcctggctctggcatttaagagccatgtgactttaggtaacttttcaacttccatgagtcaaaccaattcaaagggttatgaggagtagagttgttatagctaaaggagttacaagggtacctaacacatagtaaaccccatataagtattgggtattattcatcattagtcttgtaacaatgattagtgcataacctgaaaggtaatgctagacctctagctgtcattttaggtattaatttctctctggaacttaagaaagtttttgaaaagatgactttaatgtaagggagaagtggattccagccaacaaaaatcaaattaccagctatttaaaaatccaattaccagctatattttaaaaatcataatacaactagaagcaacaagacttcatagattatatgtgaatgtataatgaaattgcttgcttcctcaaaccttgatgttactaaacttatttaagcctgtgaaaccagcaaatttgttgagctgagataggacaatttgtacctcaagcaaatagatttccaaagacttttcagggttagattcaatatttgtgtaaccggtgtattagcaatgaatacttactgtgggtacagccctgcttctgagatgcttctgaaagcatttgatcgcgcacaaacagaactaggacgatttgcaaaggagggtcccttccactataaatattctgattacttcttttttgaagaagaaaaagtacgtattttgcagtccattaaatagcagttcccagttgctgctgccttttaatatgaatatagtcaataatttatttgatggtaagattctttttgttttttatttcagcttaatacctgataatatgttcagcctaaaaggataataaggaaactgattaatttagtcctcttattatatattgccaagacaaaattgattcttttatgaaagtgaaaacaagtactttgtgatttcttcatcctcattaacaggcttaagatagaatttcattttatcaatgtcaaagagctaaaatacctttaatgattgaagtataaacagaaaagcaatatattaaagggttaatctattttaaaagtaactttttttcatatacacatgaatacaaccatatataatcaaaaattgataattcaatctacctgtattagttagggttttatagagagaaagagccaataggatatatatatatatatatatatatatacacacacacacacatatatgaaagagaattgattagggaaattgattcatgtgatgatggaagctgagaagtcccatggcaaaccatctgcaagctaaagaccctggaatgctcatagtgtggctcgatccaagtccaaaggcctcagaacccaggaagctgatggtgtaactcctggtctgagaccacaggcctgataacccagggggaccactggtgtaagccatggagtccgaaggccaggaggcctggagctctggtgtccaaaggcagtagaggagaagtgtatctcatttccaggaaatagacacatgcctttcctctgttattgttctgtctgagtcccaagccaattgaatggtgcctgcctacactgagggtggatctttcccacctagtccactcagattcacatgctagtttcatctggaaacaccctcacaaacacaccccaaaataatgctttaccacgtttcttggtattgcttaacgtatccagtcaagttgacacaattaaaattaaccatcacactctccaaatgatactgaaatctgaaagttcttatgaggaattggtgaaaatcctagaagttttgtgatgtcttcctggtcctgagtaattataaattctttaatgtatttgaggattggtcatcattctatgccataagtataatcaatgtttaaaactagctcttatcactatgcttgtagcagagtagaattatctatatgcaaataacttaccataatcagagcccatatcagccaaaactaagtgtgagatgaggctctagttaacaataaattatctcattagagaaacaaaattgcagtcatacaactttactaagtagataggaaaagtgtaaatagtaaatgcctaggagtttgtaggatggatccatcgatgtaattatatacagctaaacataattactgtggttatagaaaatattcttgaggaaaaggaatgttatctagccttgttaatggagaatacttgagtgcatatataagctgataacttcagtgaatgactaatgaacttcaaacgaatgactaaagctatttagaagatagtctgaacagagccggggctatggtagtcaagtggaaactaaggttgaagaattagcattggggcaggttttcaaagatttgcatacaaaaataaagagcttgaatttcatcataaggcaacagggaaccactgatgttacaagaaagaaaaataaatgataaaaatgctattttagaaagataaatatgaagtcaaagtatagaatggattggggtaaaaagacagctggcaggaggctgaatacaccatgataaaggcaaaggtagtgaaggttttaattagaattatgtctgtggaaagaaaaaagaagcaacacagagaagaaatactgaaaagaatacaggtattatgaaatcacagtttgctcttgaaacagactcaaacttaaaactaaggaaaatctgttctgatcagaaaagatccaagacaggtcaaatttatttattttttatgtatttgtgtatttttttgagatggagtctggctctgtcacccaggctggagtgcagtggggcgatcttggctcactgcaagttcatcctcccgggttcacgccattctcctgcctctgcctcccgagtaggtgggactataggtgcctgccaccacgcccagttaatttttttgtatttttagtagatacggggtttcaccgtattagccaggatggtctcgatctcctgacctcatgatccgcccacctcggcctcccaaagtgctgggattgcaggcatgaaaattttaatagagaaatgaagtcacatagtcaatgagagaaacctgtggaccatggagggcccaaagagtaacaggtagccagatagaagttaataaatccatgatcagtcacatcaggtgcaaagaataaacttcatttcttcactgctggaaactacagtgcagtgaaagagatagacaagtaaacaacattaaaatgcaatgagacatgtactaagataatgatttgaactttgtactgtgaaaacaaagaatagagtgaatataattattctaaagatggagagatgaatttgagtatggttttaaaagctgaattatagtttattaaacagagataaggtttaaaaattacagggaaaggcaaaaatatgtggctgtaaagtgtcatggttagtttatggagtggagaaaagtgttgtgtagctaaggtgtgagatttgtgaggagaggtatcagtaagtataggactgacaagagaagtaaaatccaaatttggatgggctcgaatgcaatactaggggattcaaattttgccttaaaacattattgagtagacagagtcctttaattagtattgaaaaggtttgttatttttgttgtttgctgtccctttttgcttgcttacttgctttcagcacaaaaactctagtagtagtaggaggagaacagatgaacagattaaagggttgatctagagccctgaaaggacttttggagaaagacattgattgacaatatgctaccatttcattctgttgagtaatgaaagccaaatagatatgattttggaaaagcagttttattatgatgagtgggtagggttaagaagaatacagttgtacaataagatgtgtttgcatatattggcctgggggttcaaaggataaattaggaaggcatcagaaacaaagaaaaactaaagggaaatttgcagtagagtgggttagataggagcattcagatttgatgatgatggttttgaccagtaagataatttaaataactgtatcataaggcagaacatgattggtatcataagaaataaacaattatgggcagctgggcatagtggcgacacctgttaccccagcactttgggaggctgaggcaggcagatcacttgaggtcaggagtttgagaccagcccggccaacatgatgaaaccccatttctactaaaaatacacacaaaaaattttttagctgggcatggtggtacatgcctgtagtcccagctacttggaagtctgagtcgagagaatcgcttgaaccaaggaggtggaggctgcagtgagccaagattgtgccacagcactcccacctgggtgtcagctagactccatcacaaaaaaagagagaaagaaaagaatgggaaagagagaaagggaagggagaagaggaagggagaaaagaaaatgagaaaaggaaaaggaaaggaaaggaagaaaagaaagaaaagaaaaaagaaaagaaagagaaaccacgatggggaatctgcagtaaggcacaagatttcttgcgggaggaattagagaaggttgttttctgttgtggtgatggtgatgatttttttgtttttgtttttgttttcattttggtggggttttgaggggtgggggttggcttctggtttttaatgaaggccctatttttgtgttccttttaaatgtttttataagatacaatttgaagtgaaacataaactgaattttagtatgcatatgatcttattgagatatttttagacaaggaccaatagcatgtatacaggctcataatacatttagaatacagcatatttggaaaatagcaagcactcctattacatggaatgttgcatgcataaatgggaagaatttgaggcaaaatatggaaagataacttaggactagaacattggagctgatgcagaatatttcatgaccgctttgtcagacttgcaacaggggcgccccgtttactcggcccactgtgctcaaccccttacagaagggagcatgtgagtaagtgagtgtggaatccttccagccactgctccaggtgctggcaggagcgagctccatttactatcctgcggcagtgcccaggtgagggtgcctgcaacggtgaagctcaagaaggggtgttacaatgacttcttcgctccactacccatagagtgcagtgtattatcagcttacttagccccttgcctcatcacatgggatggcttccctctgctggcaagggcaaagggtcagtgtgatggccatttttgggtccctgtactcggtggttcctgagctcttgtccagcatccaagaagaataaggtcacacagacacttgaaggatggcaaaagtggataattttatttagcaatggaaatggttctcagcagacaggggagcaggagaggggacaggacaggcaggcagtctccccacaaagtccagctggatcttccctgaagtcaagttgtctctgctctgaagtccagctgtctctctgaagtcaagtcacctctctatcctctactgactgtgtctggggtctttataggcacaggatgatgggtagggtgggctataggtagttttggaaaaggcaacattcagttggtaagaaggcgtttttcagaaagaaccaattgggaaagagagggcagacaggaatagaagttttcactttgggccatgggtttcaggcttttcagcttgaaggtggagtttcaccagggacctatccctgtctgcctcctgcctctatcaaagccttcaagtggaagactaaaacatttagacattagtgagtaaagcattcatgacatccttttttagccattgtaatcatccgtcttttaataacccctcatcttcctggcacggtcttcctcatttattttattcagtcaatgtcttggtgataaccatatatacatcaatgatccatccaatattatgacttctcagtttctttacctccaagcttcccatgaacttgtactccatcccatcttagccaccctttcctgtggtaatagcctgaatcttgtgattatcaattattctaccttcatcacaatctcaatttcaagtaagccattttctgctgaaagcctcttttccattcaaataattatgtttactacttccacttaaacaatcatttggccccttcagacctctcattccttttatcagttcaccacttcactgtccatcataccctcacatcctcaagtgccttccctttctaggtgagattacatagtcacttattgtaaactttctcctctgtcagctctcaactctctatcccatcaatctcttgatcatgtaatactcacttggcaaacctcttacctcaacctcagcctatgccccattcatttcatgattatatccatatagctgagtatagatagaaaaaaatacataattttgaacaccgattttgccttaactttatattcttatttacctttcagtgacaaatataaggtcttccctatgtctttatctgtatgactgctacaccactaattacaaataataaactgttcttgacagttttgtgccctagactccatctcttcttacctacatcaagaagttgtcatctgcaattatttaccctctcttgcaaacatcacatttccctccatcctgaatcattctcatcagtaaacatgctagaatatttattatactgaaattaaccattttatgatttcatagctccctccaacttccatcctttttttctctgctctccttgatagcaagacttcgtccaagagttgtttaaacccatctcaaatttctattttatgttttcttatacctaatcctatgaagctttaataaccaccattattgcaaatgtcaccaaggatcttcacattgccaaagctaatgggatagatgaaagggaatccaaaataaagtaatggcaattagaataaaaataagggaatgaaaaagagagatgtaataggaatcaaattgacagaacttgataattgactgattgcggagaaatggagagaacatcagcttattcattcacaaaatgtgttttattttttaaaatatcccaataatttaaaacaaaatatagattttttcataattccagattagaaaattattttaagtatcccacaaaacaaaaaagaacacaaacattgaaatacaaaaaatgaaatattccctagctcctatgccacctgtcacccacatatatagttgataacaagtagattcactaattgtcatcaaatattcttgaccattaactttgtaccagggactgtgtgaggatccaaagggaacaaaatgatgtggttcctgtcctggtttagtttacagctaaaagtgaaaacagatatggaacaaatgggtagaaatgccattagattgaataattgattgagtctgattggttttaccaaaaaaagaaaagaaaaataatgaacaatgctatttctctttatatatatacacacacagtattcatatatacataatatatgcacatatatattttatatatatttctttctccatatgtgtatatatttacattatatatacttgcattatgtatttatgaatatatatatatatatatacacatacacacacacacatacatatatgcacagagagagaggaaagagattaacttggtgagagaagtggggtggtagagaggaaagactttactgaaaaagtaatatttaaagtagaacttaattgactacaaaattgggaatgggtaaataaattcttccttgcaaacaatatgaatgtttcctggggagcagaataaaatattgaggaaaagtggcttcagacttaataaagtcctagcatttgaactccttgccttttatttaatagctcactgatttggagggggttacataatttttaaaatagttttctattatttaaaatagggactatcgtatctaccttactgtgttttgtaagttttaaatgacagtttacttatatacatttcacaaagcaccaggcttgtagcagatgttcagttaatgtttattcccatccactttacatctagagtctttaatgcacaaaaatccctgtgatgaagctatgataatcagcattccccctctgaaaacatttctcctttgaaccatatcatacacagaggctttgaaatccacaagagtttgtaaaatgaaatatgttgtgaattgtctacagagcaaatcaggagctgccacatcttgtatctcaaatatgagtggtaacagcaggaatgctggcattctccacaagaagactacagtgagaaaacaatctgtgcagattaaagtgtgaaaataaactattaacaatggtttaaaacaactcatttgtcacgttttttgcccagagttatgcaaccaggcagctgatcaactgtgctggcagaactaattcctccaggatattttaggtccctttatttcttggtaattactgtgtagattggtagccagctatgagtaagaaactctttggagggaacattccttctgaagaatgataaaactttacaaataaaaagtaatgtgagtgagtgttcttgatagttgcaaggaagaggagctcactcaagtgaacctaagtaaggaactttctattttcaggagaaacatgacatgataagagaaatggtatagagaaatccaagattaaggtctgtaatacagcttgattttgtggggactaagacaggaagggaccgagtccaaatcgttctaagaatgttagcagcaggagttcatgactattctctttatgaattccccaccagtgtggctgagctattacatgtagcttttccactcttcaattgtcttagccttatcctccactttgaaaatattctccctaccttccagatggggtgtgtgtgtgtttgtgtgtgtgtgtgtgtgtgtgtgtgtaaaaacaacttcctcataacttaggtttgccttaagtcaccttaatattatttgtgcctcactgcctcctttcagttttttgtttgtttgtttgtttttgcagaaaggactgtggataaggtgatttatgattaatttgtctaatacattgagtaaagtccaccatatctgtgagacatatttctttgttttatcatggaaaacttaatctgctagacttaaatgttagagtgaactgtatagaaatcacaatttctagttaaatcacaattgaaaagagccaactctgattggggtgcaagagtcccatagaagtattcagagatcttcaaataatttaattgctgaatatttaattgttgaattgtgtcatttggaattgctatatttttattttgatttaatttcctttttagtcagtagagccattcttccatcattactgggcccactttgctttcaaagaagtgttattggctgttggaagcagaatcctaatttgttgaatatttgatttgtcattctaaaccatattcacacacgtcttggtggcaggtcataaaaatcaaagtaccaactttttttttctttttctaattattcaaaaggctccaattcttacacaaatagatagacacatacacacacacttcaccaagtcaaattaaccttaaattgtaaaaaaccacccaaaagcattttaaattatgaacttattgtaaaatatttgtttctgattacatgcatgtaattacagagaattttctatcattttatgcgtggaaatttatgaaaataataaacatctacttttctttaaaaaaaacttcatctcacttaaagtaaatatttaaccctttgttataaaattttaaaagtttgctctatctttttttgtgtgtgagagaactgagtctcattccactgccaaggctggagtacagtggcacgatctgggctcactgcaacctccgcctcctgggttcaagcaattctcctgcctcagcctcccgagtagctgggactacaggtgcatgccaccatgcacagctacttttttgtatttttagtagagacggggtttcaccgtgttagccaagatggtctcagtctcctgacctcatgatatgcccgcctcagcctcccaaagtcctggggttacaggcgtgagccactgcacctggtctctaacatatttcttaatgccagagaaaactttcatgtttggtaaatatatatagttgctttcttcaggccttacatttctaagatctatttctaagttattgatgcacatggaaggagccctcaaatgatggtggaaagacatgaatatatttctctaaatcatagtggcaagaacaggataagaaaataagtcttaaaatttagtaatcagaagaaagtgattatagtgtaagccagccccttgatcaatttattcctgatgcttggaaagggaaaataaatttattggcttcccttatttttagaatgtatttattggctattttccaaaaaaaaatatttttagaataaatttattggcttcccttatttttagaatatatatatatacacacacacacacacacacacacacacatacatactagtgatgaaaaacattttctcctaatgataaaactctctaggttttttcaatcatcctacataaataatactcataatggtgcatttatttgttggtaacataagccatttatgtcagaacattcttcagtcctttatttacatagcaatcactcaccttaagaaactatgattcaggatgatatacactttttgaggtgagaaaaaactttgtacttctcagtggttctttaaggaattgaaaataaggcatctggacatgtttctaaatgattagaatttccaaatactataacatatttatttgaatacagttacctacaaagatatatgttgataaataatatataatctaacgtactactagatttctaaaccctcaagaacatcagctctctcattatgtatgagacaactggaacccagagaaattctgattgcttcagtgttgcaacagagctagggctggaggagggaattgtgtcacttaactatgcatcacaggtagatatttaatatgccctgaaaggataagtacaatgacatatctcacacatagcacaatatcttttgccctgtctagtgttatgaatgtgacagaatccagataggttatgagctagaacctgatattgtgtcaccattggttatgcttggcacaatgacgtaacagtcaaaactcttctggttacaggccaggcgtggtggctcacgcctgtaatcccagcactttgggaggccaaggcaggtggatcacaaggccaggagatcgagaccatcctgactaacacggtgaaaccccgtctctactaaaagtacaaaaaattagccaggcgtggtggtgggtccctgtagttccagctactcgggaggctgaggcaggagaatggcctgaacccgggaggcagagcttgcagtgagccgagattgcaccactgcactccagcctgggcaacagagtgagactctgtctcaaaacaaacaaacaaacaaacaaacaaaagacaaaaaaataactcttctggttgcaactgagaaacccaacttgaaataaccaaaatagggaattcatttaatttcatgagagaatggcaagatgctaaatcccagatagagctgacatgcaaccaacactgttttttcatctctcctctatctgtattgacttaattctgtcttaattggctgcctttcaatagcaaactacttccctccatgtagtggaagctccagtgactgtcagacatgcaggtttgtttgtttgtttgtttgtttccactcaaatactcaagcaagtattgagactcagacttcctggtctctgattgaaaagtttcaacctcagctgcccattcatgaatcactgtgaacaggacaaaggggtaatcaaactggccaaggttgggtcaggtgtccataccaagttaataaccacagccaggaagataaaacctattcaggaatacagtggctcctattcaactcacatcgtcattgaatatagaagaaacatgtctcaaacgaagcaatgaaaaaatagttgctattttttagaagacaagaaacagatatgaagtatggttggcaaagatgttgaaggcaaaaatgacaatacccattatttagacatacgaaaatgatcagctaaacctttccaactcattagtccagccaaattctcaaggtttactggacaggagttcttaactccagcaatgattattactaaaagtgtcagacagaatggccatttgaaatatgcaacaacaggtatttcatagacattggcctatcagaacaagaccttcagccaatgaggaaaaacactcagctctgctgggagtaccagcacatacaggttgaatataatttgccttaatgttagggcaagttgccactgaatactgtatgtttgacagcatgactctctgcatgccgtttttcagacattttagtcagttatactctaatcctcagaaggacaagtcacatgagaaaaatcagagtaaagaaaggtccattcttgaatttttttaatgttcataaaatctgctaaggaaactatcaaaatatgaagttcatagccctaccttcaaaaaatattcatcatcaggcttagagttgaactctgttgcctgaaattttaataagttgtccaggtttttctggtgttttggctctctgttctgtaaggtgcttggagaaacactgctctaaattacgtgccacttagggaaaagtatcctagctcttcaaaagtaattggaataaataagaaaatcaacaaccataaagacaaagaaggagagtaatgtgctttcagctggaaggcttctgtttatgagaaattagggtaatttaaggtcatcttctaatggcacgtaattctaaactagggcagccacataagccaggatagacaggtctggggaaagaaacggagacacacattgagtgtttcttgagctatatattcagctccatactaggggcaatcaaaagatcaaagagctaccttgactgaagagacaagcctgatattttgatctttgactgtgtgtcttatgggactgtctcccttccctttcagcatcaaactctgcctaacaaaaggaatttgaagctaaactgcacaagatttgagatactaaaacttgcaactgaaataaaccatgtagccaagtcagacagtcagtgattaatgtagtacatatagtatgcctggactattatactctgtgattgaagtttctcaacacagtgatctcaagaaaatagctctgcacataaggtccgaaaatccctaattttgcaacacttttatcagcaactttcagtaggaccttgggccagttacttgacctctttgactctcagttacctcatttctaaaagaagaagggtaaattatatcagctaaggcagtgggtggttcccaaccattttggcaccagggatcaacttcatggaggacaattttttcacagacacagagggatggtttcaggatgaaacttttccacctcagaccatcaggctttagattctcataaggattatgcagcctagctcccttgcatgcacagttcacaacagggtgcaaactcctgtgagaatctaatgctgccactgatctgacaagaggtggaagtcaggcagtaatgctcacttaccggcctctcacttcctgctgtgcagcctggttcctaacaggccacagaccactgcaggtctgtggcctggaggggtggggaaccctgagctaggctcaactttagctgtaacacaataatcccatgaaatgtaaagcaaaacgtaaccactgaatattatcatttgttaaatggcaagatgtctaaaaagctttctaatatgtccttatatcatcactcttagtgtgatgagaaaattttaaaaaccagttataatttcttgcagtatagcccaaattaggtaaaataatttgaagcctcttattcaactctttttgttttatttttaatatatagttcagatattagcaacctcttggggccagaagtgaggcttaagaatgcctttggccataatggaaattatttgaggaactccagaaggctgtatctgggcaaaattaccccccaaatactatcagaagtacccatcctttgggtcatttttaacgacaatggcaacaaaagaatgtcttctttgcaatttataaatgtaatctggaagagaagagagactatatggatctgatctgactcatatcagtcaatagtgtcattaactctttggtattattcacaggcagatgtagattctgaagagcctaaaatgtcgtacaaccttggtaccttacttaataaaaagaatactaaagaattaatataaaagtgggttctacaaatagtattatacttagaaagagaaaaaaatcaaaatgaattaccgtagctttggaggttgaagtccctttctcctaagatctctttagacaatttactagaaataattatatagaaatattttccaaatttgaccttccactccaacaccctatgacactgagtaaatgccagcactcacagggactcatgcatataagaggcttaggtttaataagcatcatgataaatcaggtgttattgtgtcatcagattaacaggtagaaaagtaacaacaataccaaatcaattttaagaataggcagggaaatcggaaattaagtttgaggactgcttcacaagagcattcataggtagcttctaaacaggatgcctggagtcttcctatggggcttacaagtaagagagcattaaagataaacttcacatcattagaaacattcggctgagtttataggtatcaccagcagaccacatcctgctattcaagtagctagtagagacaccatggggaaaaatgctgacatgaagaggaagtaaaagaaaggaacctggcaggtatagtatggaggggcatggggaaatatttaagaagaagcagatgaagcaaacattattgataaagagagaagaagtcgttaaacatttgtttttggtgacataatagtgctaaccactcagttcacttgctatttatcaggctcttgatgtgcagcaaattttagactggaaagtaattgagggagttagccttttagagtaggacattatattggtgataattcccttctatgtcctcagtaaactgattagaaaaatgaaacccagagttttctgatctgtcagagatggtacagactagacattcagtgaagccaggtctagaagccaaatctttgtgataaaaactttagtgacatttttttctcctttgccaaaaaattaaaaaaaaaaacaataaataccacaaagagcaaagataacctttctgtcttatgtgagattaaacattttccatctaaacttatccatatgctttcttcaaaacttatttcaaaacctacataacaaataaatagataaatattaaacacataaaatggttttctcgccaaaggtagccctttttttccctttgcatgtccagtgtatatgaccttcatatcttaaagaatttatcttactctatttggatttcttcttctttcctctcattccacatacatatgcaaaataattgtacagagaactacatatgcacaaagatgcatccatgctcatatggccacaaacatagacacccccaaacacatgcacagtctcctcagagaagcatctgtgccaaatcatggctgttttctatgtggtattttacacatagggggcttctaaaaattaattttaggagaaaatttgctccaaggctatctgatggcactagcaccaaaatccaccaggcctcagctattgcattgttttctaataggtgaaagacctatccagtctcactgcttcatctaccacctctaaatgactgtaggtgttctcccctgtctagaactcatcctgagcgtcattctctcatttttactgtgtggtcagatactttcttctgaatatcttgtaggtacttcaaactcattacctccaaattgaagctcatcagcatttctactttaaccgtgtccttttttcttttactgacattgccaaattccccaagctgcaaattatagtgttattattgacactgcccatgcccttattcctgtacctcattgtctgccgagttttgccaattcagttattaattggtttttcccatctagtgccttttgtctgtttttattactattattacagctcaggtctttatcttgtattactgaagtaatgtcattgatttatttgtctctgctccagtttcactatatacatctcagcataatgcagcttccctattcaaaaccactgtagctccaaaacagattaaagtctaaatgttttactctgataatcaatgctctctatttttcagattccatctgttttttcattccatccatatatttccagatttatctaatatcacttcccttcacatatccagatgtcagaaaaattgatattcctatttctggtcacttcccatctctttatcatttttttatagctccatttactctctcctatcttttttccacttatccaaaccctcattattcttatgatctcctcaaatatgcatgtattagtctgttttcacactgataaagaatacttgagactgggtaacttataaagaaaacagacttaattgactcacagtttcacatggctgggaaggcctcaggaaacttacaatcatggcagaaggtgaaagggaggcaaggtacatcttacatggcagcaggagagagagagggagcatggaaaactgccactttaaaagtctcagatttcatgagaactccctcactatcatgaggacagcatgggggaaactgcccccatgattcagtcatcttccaccaggtccctcctttggcatgtggggattaccatttcagatgagattttggtggggacacagagccaaaccatatcattctaccccgacccctcccaaatctcacattctttgcacatttcaaaactaatcataccttgactcattttagcattaatccaaaactccaagtccagtttatcatttttgattgcgtctatttgattcttctctctttttttctttattagtcttgctagcggtctatcaattttgttgatcctttcaaaaaaccagctcctggattcattaactttttgaagggtttttttggtctctatttccttcagtcctgctctgattttagttatatcttgccttctgctagcttttgaatgtgtttgctcttgcttttctagttattttaattgtgatgttagggtgtcaattttggatcaactaccatcagagaatactacaaacacctctatgcaaataaactagaaaatctagaagaaatggataaattcctcgacacatacactctcccaagactaaaccaggaagaagttgaatctctgaatagaccaacaacaggagctgcaattgtggcaataatcaatagcttgccaaccaaaaagagcccaggacgagatggattcacagccgaattctaccagaggtacaaggaggaactggtaccatttcttctgaaattattccaatcaatagaaaaagagggaatcctccctaactcactttatgaggccagcatcatcctgagaccaaagccgggcagagacacaaccaacaaagacaattttagaccaatatccttgatgaacattgatgcaaaaatcctcaataaaatactggcaaaccgaatccagcagcacatcaaaaagcttatccaccatgatcaagtgggcttcatccctgggatgcaaggctgattcaatatacgcatatcaataaatgtaatccagcatataaacagaaccaaagacaaaaaccacatgattatctcaatagatacagaaaaggcctttgacaaaattcaacaatcttcatgctaaaaactctcaataaattagggattgatgggacgtatctcaaaatgataagagctatctatgacaaacccacagccaatatcatactgaatgggcaaaaactggaagcattcccattgaaaacgggcacaagacagggatgccctctctcaccactcctattcaacagagtgttggaagttctgggcagggcaatcaggcaggagaagggaataaagggtcttcaattaggaaaagaggaagtcaaattgtccctgtttgcagacgacatgattgcacatccagaaaaccccatcatctcagcccaaaacctcctcaagctgataagcaacttcagcaaagtctcaggatacaaaatcaatgtacaaaaatcacaagcattcttctacaccaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccttgctcatgggtaggaagaatcaatatcgtgaaaatggccatactgcccaaggtaatttacagattcaatgccatccccatcaagctaccaatgactttcttcacagaattggaaaaaactactttgaagttcatatggaaccaaaaaagagcccgcatcaccaagtcaatcctaagccaaaagaacaaagctggaggcatcacgctacctgacttcaaaatatactacaaggctacagtaaccaaaatagcctggtactggtaccaaaacagagatatagaccaatggaacagaacagagccctcagaaataatgccgcatatctacagctatctgatctttgacaaacctgacaaaaacaagcaatggggaaaggattccctatttaataaatggtgctgggaaaactggctagccatatgtagaaagctgaaactggatcccttccttacaccttatacaaaaattaattcaagatggaataaatacttaaacgttagacctaaaaccataaaaaccctagaagaaaacctaggcaataccattcaggacacaggcatgggcaaggacttcatgtctaaaacaccaaaagcaatggcaacaaaagccaaaattgacaaatgggatctaattaaactaaagagcttctgcacagcaaaagaaactaccatcagagtgaacaggcaaccaataaaatgggagaaaattttcacaacctactcatctgacaaagggctaatatccagaatctacaatgaactccaacaaatttacaagaaaaaaacaaagaaccccatcaaaaagtgggcgaaggacatgaacagacacttctcaaaagaagacatttatgcagccaaaggacacatgcaaaaatgctcatcatcactggccatcagagaaatgcaaatcaaaaccacaatgagataccatctcacaccagttagaatggcgatcattaaaaagtcaggaaacaacaggtgctggagaggatgtggagaaacaggaacacttttacactcttagtgggactgtaaactagttcaaccattgtggaagtcagtgtggcgattcctcagggatccagaactagaaataccatttgacccagccatcccattactgggtatatacccaaaggactataaatcatgctgctgtaaagacacatgcacacgtatgtttattgcagcactattcacaatagcaaagacttggaaccaacccaaatgtccaacaatgatagactggattaagaaaatgtggcacatatacaccatggaatactacgcagccataaaaaatgatgagttcatgtcctttgtagggacatggatgaaattggaaatcatcattctcagtaaactgtcgcaaggccaaaaaaccaaacactgcatgttctcactcatagataggaactgaacaatgagaacacatggacacaggaaggggaacatcacactctggggactgttgtggggtgtggggagcggggagggataacattaggagatatacctaatgctaaatgatgagttaatgggtgcagcacaccagcatggcacatgtgtacatatgtaactaacctgcacattgtgcacatgtatcctaaaacttaaagtataataataataaaaataaataaataaataaataaaaagtccaagtccaaagtctcatttgagacaagaatagtcctttccacctatgagcctgtaaaataaaaaacaagttagttacttccaagatacaggcattgggtaaatgttcccattccaaatgggagaaattggccaaaacaaagaggccacaggccacatgcacatacaaaacccagcaaggcagttattaaatcttaaagcaccaaaatagtctccttgactccatgtctcacatgtagggcatgatgatagaaggcatacgctcccaaggacttgggcagctctgcccctgtggttctgcagggcacagcacctctggctctttcatgggctgccgttgagtgcctatggcttttctgggtgctcagtgcaagctgtggatccaccattctggggtctggaggatggtggccatattcttacagctccagtaaacaataccccagtggggacactgtgtggaggctccaaccccgccattcccctctgcattgccctagtagaggttctccattagggatctttccctgcagcaaacttctgcctggacatctaggtgtttccatacacccttgaaatctaggaagaggttgccaaacctgaactcttgccttctgcacatatgtaggcccaacaccacatggaatttgccaaggcttggggcttgcacctctgaagcaatggcctgagctgtatgttgaccccttttagccatggctggagttggagcagctagaacacgagacaccatgtctcgaggctgcacggagaagtggggccccaggctggccatggaaccatttttccctcctaggcgtccaggcctgtgatgagaggggctgctatgaagatctctgaaattccatggagacatttttcccattgtcttcactattaacactcagctcctcgttacttatgcaaatttctgcagccgggtttaatttctcaacagaaaatggggtttttcttttctaccacatgaaaaggactcagaaaacttacaattatgatggaaggagaaggagaagcaaggcatgtcttacgtggtggcagaagagacgagagagaacagggaaactgccacttttaaaaccatgaaattttgtgagaactctcttactatcacgagaacagcatgggggaatctacctccatgatccagtcacctcctaccacgtgcctctcgacatacgcagattacaatttgagatgtgattttagtggggacacagagccaaaccatattggtgcataatacttaatacctcattcatggcaatgatcacttcttatctttcattacagtaatttgatagatagcttttctcccatacttgagtgtacagtatgttgtttctctctttaagaatatagttgctgagtgcttgagagcacaactgattaatcttttgttactcccacaatatttggcaaaatgccgtgcatattatagatattcaataaatatttgactttataaatgaatatttatttggcaataagaaaattttgataacttttcttatttaaaatgggaaatagtcatagtttttttagaacaattagtaactgtactactaatgttgattaacaatttcaataattattagtttaaatgataatgaacatgcatgtaatctagtcctcaggggaagactaggatttcatcaaaatgatagagcctaagtgtactacttatttcaatacatcgaaaaatttaacagtcatcaaacagacattaacaaccaaaccacagtgattttcaatgtaacatctccaggattaagaaacaaattgtaacattcatttgatgcttaaagactattctttctttctaaggtgtgatgggagaatatgagccgaaaattgaggtccattttcctttcacggttacagctgctaaaggaacaactgttaagatggaatgctttgcacttggcaagtaagtacatgttcttccataattaaacacaattttttattaaaatgtgacatatcttatttttggatcacttattttgctaggtgtcatttccccagttgttccatggtggctatttattttctaaaagaaggtcaaatggcaattgatgaagtaatcagttacagttatcttctagtcatttctatggacaacagtttctataattttgctattttaacataaaaaaacttctttaatgaataaaaagctttacatctttacctatgtatcttaaaatttaagtgtcatctttaaatttcattcagtccttatgtaaataaagaagatagaaaggcaaagtactatctgctcctcatgtataggatgtagattcttataagacataataagacagcagataaaaatcatgaggataatagttacatagtgatcctgtgtattaccttagtatctcctgaaatcataacttaatagcaccagctgtcaatatgtacaacatgtaatcatttcccaaatgagagaaagaatttatgtcacatgctaatgcctgccatatttaatgattatatttctgagggtttacagcccaggatatatagtcacttgtcaatgatgtttacagtataggtattgagatcagaggcagaagtggaattttgattatatttgattattgtattatgatttattttaaacagagtgttgttttctttttttttaggatgctaagacttcagggttctttctagacactataatttgcataaatgtatctctgtcagagttactaattacttaacttcagttgcagagagcaaactcccacaatataactataaagtactcggagataaagccagatacacaagtgtgattattaaagtaggtttagcctttgggtaaggaaaatattagtaaatatgacaaaaaatcagctagctaaggtagatttaaggaacgaacatagtaaacaccgtgttttaatatcaagaatgattaaaataagacatatatgcaattctactttaagtagaaacaacatcataatagactataagcaaaatgaattgttatgtgacccatcttttaagcaaaagatagccagaagtagaaataaatttcaaaatgtaaaatgtatctaggaggtatttgggcagatatctgaggaagcctcctaaacctaaagatgttagttaagcgcataagattgaataatagttaaaagtctggtttgtcaccatttgctgttctgtgtcaaataggtctgaaaatgtcccaagtaagaagctcaatactgacaaatgcaaaaataatatattctggcttgaagacaagggttttagtgtatcctgtagttaaataattcttcagtgccagaatttatactaaggccacaaacaaagggaggtcatattgtaaaacaaattagaaaactagacttataggaaaaaaccaatataaatatttccccaggcaagcttatttaataagttagatgtggttgcctttggaagccttgaaatatgtttagtaaattgaggcttacagtctctttcattctaggtaagacccaacagtcaaatcactaaatcacttatgttcttttaatatgttattttcttcaacctttctactccttctttgctacccaactctcaaaagtaaatacataaaagggagtgtaaagaagactgcttcactcaagaaggtctctgtttatcacttggtgtcctttctaagaaatgtcacaattatggaaaaaagaaacatcttatgaagatgtctaccctctacctaaagaccaatctgccacccttatgaaaataaacaagatcaaagaaataacatcttgacatgtgttcatccttttacagcacattgtcttgtggtgtggatcaccatttcatcccaacataatcacagcaattgcaaattaattcctgagcatccgcgtggctcccacagctcacttgagctgcttcttacttcagcaagcacatggtgctcttgtgggcctttgtctgttgcaaaaacttcagtatctgtcactggatatcgtcaggatcttaccactcaggctgttttccccctcactgtgtcctaaccaaacattccttgtagagtgttataaccaaattctggaatggagcatgtcaaactttttttttgtcttgtggcctttgcacttgctgtttcttacactgggatctctctccccctgttctttccatgggggctctcattcatcctctggcctcaatttcaatatcactcctgaaataggctatctatgaatgtacatgttatctaactcacacccattattctctgtctgtatactttttaatcccttttttacagtccttaacacaattttaaatttcccacatacgtgtttctccacttaaaacatttatctgtgtcaggatcccagatgtaatcaggatccaactcagacatttcaatagaatttagtaaagtgatgagctgaagatctgtgagcaggctaagaagaacaagaaaaaccaagacatgtataaactcctgatagcaatgactcattgtcatgtgtaatcctgaaggagcaagtgggaggagatggtgtttccagaaccagggaaaactggagatatgaagtgggccagggatcaaccaatgggagctgtaatgactgttgctgtgaagagacacagcctttatataagaacacagctgaagaaaggattaggaaatttatatcctgacttctttttcctcttgccttctcatctcctctggtggctctcatggctgaagtcaaacagaagccactctacaagcctgcggatgcaattgtcagttcacaaggcaaggcagagggtctgcagggaacaagaaggtgacaggcaagggaggaaaacagaatagccagcactttccccactcttaggctttaatccccaagaaggcaggaatcattactgtattcttcatttacttattcctagtgcctaccacagcacctggcacatagcattcaggaaataggaatgaatgaacttaaaaatattccatctacttaatccaatcaactctttattattaacagttaatcaaaaataaataagttatttatgccttatcctgtcccccccacaaatacatcatgtatactctgcacctgtatctcctgctctcccgtattctcttatttatatccaaaattacatgctatacttgcctctaccttttcctacctattcttgcctcactctatcatttatctttgttaacttagacctaccattctccaactctcttttttatttttgtggtaagaacacttatcatgacatctaccttcttaatgagcttttaagtgcacaatacaatattgctgactataggtactaggttggcaacagcaaatctctagaacttatttaatttgtataactgaaactttatttttattttattctcaaagcatattttcatgtccaagttgtacttactgtttaacatgacaaccccaaaaaactttcttgatctactgcctcttaagaaggatttgtttgttgccttttttgaggctaaggataagagagatttatcatatctatagaagctagggcaaaggatggagtgaaaaatatttatatatcacaaagtgtaatattttatataataatggtttgagggacaaacaaagaagatcataagtacaaaatcttgctattttcaactttacctgttcccagccttagcggagtaattcacatttcctaccataaatcactattttttatcatgttattcattgaaccaaatatgttcctagatatacagtcattccttggagatatttgaggttcagttccagatgccacaataaagcaaatttcacaatgaagaaagtcacatgaattttttggttttccagagcacacagaagttatgtttacattatattgtatgttattaagtaggcagtagcatttacatgcctggcttacatacatacaacaatttacacacgttgatttaaaaatattttactgctaaaaattgctcatgctgatataagtcttcagcaaattatcatctttttgctgatgactgatgctattgactgataagggtggtggctgctaaaggttggggtggctgtggcaatttattaaaagaagacaacaataaggtttgtcacattgattgactctgtagcttatgatgctgttagatagcattttacccacagtagaacttctttcaaaattggagtcaatcctctctaactctgccaccactttgtcaaccaagtagatgtaatggtccagatcctttgttgtcatttcaacaatgtccacagcatcttttccaggactacactaactcaagaaacccctttctttgctcatccataagaagcaactcttcattcaacttttatcgtgagattgcagcaattcagtcacatcttcctgttccacttctagttcttgttatcttgctgttttcatcacatctgcatttactttccccactaaagttttgaacccctccaagttatccatgagggttagaaccacttcttccaaattcctattaatattttgaccttccatgaatcacagctgttcttaatggtatatagaatggcgaatcctctctagaaggtttacaatttactttgctcagatctatcagtggaataattacctatggaatctctacccttataaaatgtattttgtaattcattcttaagtcattggatttgaaatttgaaaattactccttgatccatgggctacaaaattgattttgtgttagcaggcatgaaaataacattaatattgctcatctacatcagaactcttgggtaatgagatgcattgtcaatggacagtagtatttctcttcgctaatgagatgcattgtcaatggacagtattattttgaaaggagtctttttttctgagctgtaggtctcaacagtgggcttaaaatatttagtaaaccatgctgtaaacatgcagtgtcaccaggctttgttgttccatttcaagaacacagagtagatttaacataattcttaagggccctatgattttcaaattggtaaatgagcattggcttcagattcaacgtcaccagctgcattagcccctaacaagaaagttagcctgtcctttgaagttttgaaaccagacactgacttgtttttagctatgaaagtcctaggttgcatcttctttcaaaataaggctgttttgtctacattgaaaatctgttgtttagtgtagccatttccatcaattatcttagatagattttctgaataactagctgaagttttcacatcagcacttgctacttcaccttccactttaatgttataaagatagcttctttccttaaaccttataaaccagcctctgctaggttcaaacttttctcttgcagcttcctcacctctgtcagccttcatagaattgaagacatttagggcctttctgtgagttaggttttggcttcagggaatgttgtggctggtttgatctacccagaccattaaaactttctttctatcagcaataagcctgttttgctttcttatcatttgtgttttcactggggtagcaattttaatttccttcaaaaactttttttttttcattcacaagtcggctaactgagcacaggcctagctttcagtctgtcttggtttttgacttgccttcctcactaagcttaatttctagcctttgatttaaactgacagatgtgctgctcttcctttcacttgaacacttagaaaccattgtagggttattaattggcttaattttaatattattgtgtctcagggaataagaaatcctgaagagagggagagagatgagggagtggccagttgatggaacagtcagaacacatacatttattattttagtttgctgtcttctatgggcatagttcatggagcttcaaaacagttacaataataacattgaaagatgactaatcacagatcattataacagacataataaaaaattgagatgctccaagaatttccaaaatgggacacagtgataataagtgaaagcaggctattagaaaaattgtgccagtagatttgcttgacatagcattgccacagaccttcaatttgtgaaaaacacagtgtctgcaaaacacaataaagtgaagtgcaataaaataatgtgtgccagtaccttctgtcttaagaaaaaataattcacttattaattcagaggtgtcaaaatataagagttgggctttgtgtagctcatttcataaatatagtagactaaagtacctcaaagaacctagaaccaaatgcaggtctgcaagctctgaaagccaactatgttctagggactgtcatatcttccaggatttccatagtctctgttctcaaagaaattgcattatatcttcaaatattttgctgaatgtaatattacaccttgagtccattcttaatcattatgtaaacatacactatggaccttgaccaagctgtcctctaatagccaacctttatctccacagaaattcactattcgcctttttggttccaagtttaaactaagacttaacaacctaacagcaaattttcttcttttgaactctctttggcccttgacatgatctaatgaatcttcgataagccaaattaggaaatttctttgatttttaaagaatcatacattcaaaccgtgttagaatactggttcattgtgatttctcttggaaagtacagttacctttttatgatctgtccttaatggtgttcagtttttgttacttagagcgtgcatattagtgcagctataatgcacagataatttttccatatataagcttatatctttcccatattctttaagaaaaaagaaaacaaataattgtaggttatcaaattttactatattttgatatcacccaaatttaccaacctgcctcatttgaagttaggtaaaaagtctactaaaaagccataagctgcaagctttctcctaaagaaacctctacttaaatctgaatttagcgaaaattcagatgttttctctacaggctgctggagcagaactcaacaagagtgtactagtttactcctagaaatagctcttaaaatagaattgcacaaggttgagtacagaacttttaaagtgaccgtgacatgctatatcatgctatactgtctgtaaaggtatttccccagaaaaatgggaagtgtttcaagagaacccatagggaaacaaaggtatgtaaaggcttgggtaacacagcaaagtgtaaaaaaaaaaatggagggggattaattagttggaaagaaaagactggtttagacatatggaaggttattatcaagagattgctcacaagctgttctccagtttcaacaagggagggagtgaaattccaacagtatgggattaaactagaagaattagattgggtgtaatgtagaagttcatgaaaaaatgagttgttacagggaaactgggttatcaggagaggcagtggaagctctttgcctgaactgctgtaagaatataataatgcccatttgtcttctaatggtttagatgtaatgttccctgaaaggagagaaatgatctgggtcaggattggaaacgaaaatttaaatattttcttttgctggctgcccatccacacattctcaggctgaatattaagagtagaaggatagaatcaggcagacttaattaactgccttttggcagtgacattattacataacatttcaaaccggttggtggcatatccaggaagtagaaatgatgagtgttgacttttcttgctcagcattcaatctagggaccttaatggaaatggggttattgtggatatttccaaggtcggcttttaaacatcaggtacaatactcttgaaagggattgagagataaaggggtcaagggacaatgcaagcaaggaatcccttaggaccctaataaatatttcatttcagtggttctttctaaatgcagtatataattaaacattggtgatgttttcaactgggtgtgctcagtgtttaagtccagcccatacaagttgttaactaagtaacacagggtaaaaatgagaactttatggaaagtcagtaactacagaaagcagctaccatctctagaggtaaggggggaaaaaaagaattagaattaataaaaattagaacctcagatgtacccctaggaccaagaattctgaggaatggacgaagtgggacacaatgaagcctctcctgaaagtgttgggaaaaaacttgaactgtattttattgctgctaagggaaggattccctgctgaggtgccattcaggggctatcgagctgacaggaagcccctgggaagcccacaggaaataaacaacgatggtgttccttctggcttcttcagccttgcaatctccctacagtgccccctcctggcagtgtagaaatgtggttttcagaacccttgccccagtaccacaaagcctagtagaggatggagctgagaggtggtcatttaaacagtagcaccaattccacttgacattttcaaacccatctcttaatcaactgcaccccttactatacctcagccatcctggctttgccacatctgtggctctgtgacacagtttcctctgtctaaaatatctatcctgccccacaatcctattcagtaaggcttacgtcaaatgcccctcctccattaatcctccctgcttttcttgagctccagtctcttacctttcagtgtgaccacctacatttcactatttagcctgccccactggaacagctatagatatctgtcttctttagtgtgctgaattttgggatccctagagcattattagatgcagcaggtgctgaatatgtacactgaatgaattcaggtatgagaaatgtgattgatctttcataacaggaggtgtgttactgcctttggtttggccagacagatgtctccagatgctttcacatgttttggccttgaaaattcttaccacatttacattagctatagttttctggcaagtttcatttcaccgtgtgaccttttacagaccctagaaagagcactagatatgtcaactagcctccaacagaaacagaagtaaaatctggtcactgatgcttaaatgacccaatacacaagggcaaacagggttactctgtaataaaaaagccaaacgctacaaaacaacatcagtttatccataatgacaggcctgccagctaatagtgttacaggcagattttctctttttttctctctttttaaaaaattttacatgtttcttatcttgctcttgcagccattaacacacaatcagatctgctctgctcaaaaggccttgaacctgttactgtaataattatgtgaatgacctttgcaaactcatctgaaatcttgtggtgaggtgggagggaagaacacattcaatttcctgccctttttagttcctgcttatctctctttcagataccatttacaaatagtcttttgttacactccatcaaatgcctattagggaaccagggtattaagtatttttttctctttttatatgtttactgtaaataaaaagccactagttatcaattcataaaattatttttgctgtagtttatgttttcctttcctcaccccttagctaagctgtctcaaatggctgctcttgtgtcccattgtaactgtgagaatgacaaatattcctctgagacttcctacagtgtgcaactggcaaacgttcctggaagaacctgctctttagttacagattgatgatttattaatactgtttatttggagctgccagtcactaagggctgtaggaattaaaaatgaattggagttatgtggtatttgtctatcaaactaaaatcaaattacttaatcattaggttgacagaagatctggggataggagtcagtctctgggtgttggaatcaataaacatttaggcctcacaggaaagtggtgcattacagaatcaagaaaattgccatcatgaactattgcttgctttagtatggttgagatgaaggacacatcctcatttcagatggtacccagaggtgatggatcctaaaagaaccttaaggattgcatgacctaacaaacgtgaatttgtaaatggaaaactgagacttctcaaggaatggctagacgtgtggatgtaccgctcaggctaatgttttgatgcaacttcctgtgatgttcttgacgtgttcaacattctttcatagggcaaactttgaaggaaatatttaatttacttataggcttttacactgagaggtgttatgtgttttcagggaaacaggaccaatttattattcacatttagagtcaaagttaactggcatcatatttccagcttttccacggctgccctagaactagttaacctgcctcaggagagaaactgtatacatgtgcaaggccaaacagctaatgtgtgtggcctatagaggcagaactagataccctgatgctaattaatagtattctcagtttacagtttttcagttgctaagagtaatttttactttgtcacagcaaacattatattctgaatgccctgaagcatctcagtgagtgagaattaggaatcttaataggcaagacaagttaacaagaacatgaagcaaaagataatccccaaattgtaagatttttacttggattagtttagacttatccaacagctttcttttaagttaatctcccaggaatttccatggaaaagtttcttcctctgggatgatcgtaagatcagcaactatctggatgctgagattcaaaaacaggatgtaaagaattactttattaaaagaatgaagttatgccttttgcagcaacatgtacataactgaaagccattatcctgagtgaaacaactcagaaacaaagagaaataccacatgttctcacttacaaatgggagccaaataatgtgtacacatgggcatatgctgtggagtaatagtcaatggagactcagaagtgtgggagggtgggaaacgggtgacagatgagaaattacttaatgggtataaggtacattagtcagttaatgattacactaaaagcccagacttcaccactacacaatatagccatgtaaccaaactgcacttgtaccccataaacttatacaaataataaaaaagacttagtatatccatcagaagtttctaactttattgtatcccatacccctacaagaatcaccaggtacataatcttgacacttgaataggacatcagtggaacaaaaaaggacaattttaaccaaaaagttgtcaacaatctgagtatatgtaaaactaaacttctaccttgtcctggatggtttccatatcacactcagattccaacaacatctctgacatgttatctcactggattacaaacaggaatgaatttaggcaaattatgtatcccatttgacctgtttccttattttgaactctcacagtcttggatttctaaaagtgttatatcatcatcatccacaaattcccactgagtattctactagaaattgaaatgtttccctaacagttatctcttctaatggtgatttaacaactatattgctacttttaaagccgatttatctaacaataaacttgcttgaatatctttgtttgagatctcattctatctcatatgttttatgacaatactcaatttttaaatctatcatagtacatgtattcttaaaagtagtatgtgtcttactgaatcactgtactttgaactaagcatgctcgtcatgtgtctaatatagtcatatttgtattagttaagctaagagaacaacaaacttctccactagagaaagatcaatttagaacttcaagaaggttttcatatgcagttcttagaatgatttcatggtaacttggaaattaggtaccaagtgtcagtaatgtgcatgccattagaatttcatgcattcaaaaattttgtatttattatttcaataactttgaaaatttgaatatgtgatgatctagtgtgaattactaatgttatatataccacatttgatgcagccctctgcataacagcagtatctctaactcacctcaaaccattggcatcattatcgacctctgccaaatcttccatcccaatctgccagacatttaaaacctctcaagtcccccctctccattttattctatttttcacaaacatagttcaaatctattattattggacaaatttggctctcttacctctgctgcaaataagactagagatgttgttgtcccagctactcaggaggctgaggcaagagaatcgcttgaacctgggaggcggaggttgcagtaagccgagattgcgccactgcactccagcctgtctaaagagtgagactccgtctcaaaaaaaaataataataaattaaaaattaaaaatacatagatttttattgatgcttcattagctttgggaatttctccaagtgctgctttcataggccctgctccattcactttatctgtttggttgtctattgttccccggaccttattcctggtttccaaatcactcctatctcatatactctgatgttattttggactttttatttgattgttgactccaactgcacctcttaatttagcctatttgatgttcttcaataccttggtccacagcatgtgggatcaggctgggtttctagaactccaaaccaagcacaactctccacactcacccatcatcagcctacataaggagtttttattatcactacgggtgaccatttaggcgttttccaaaggtataaaattttaaatatctttgactctttcttcctttttatcatcatctgtttgattaccataaatgtctcttaaattgattaccactgacttggtgcataatgaacatttgttaactgaattaagtcatttatcaatgtaataggtatatatatgtactcaaggggaagcacgaataaaccaatatattaaaaaacgtataagcctgagactaaacatgtctaggcatttagattgtaaaaataaaagctcagtccgtcttagtctctatctcaaattatggcatcatcctagtagggtgttatgcagtaatatctgtgctggtatgcccaaatttcagaaacaatttttctacttgggttctagcatgttgagttgccttaccaaagtcactctaatgaaaaacaaactgtgataacttgctaataaccatcactggtggcccattcatgtaagaaatgccctcagtggaaacaggactaattaaaaatctggtggcctataagcacagagtaagagcaaagtgcacacacttccctgtggtctgtaactaacaaggtactgcaaattcatggattgcagttcttttctcaaaatattcttgtatatttagcacacatcagcaagattacaagcatctcttctctgggtggtggtacggaaaaactaattttattgttgtgattgttattattctgtactttttcaagacacttaattttaaaaaacaatacaaatattttacatgataaaattttttagtattagtttcatgaccctatattaaaatttccaaaagcataggctttttttaaaattaattacataaggtgttgatgatttcctttagattattcaataggaatcctatccttgttaggcacatacttatagtttctaatctagaattataattatatgatgtcagaaatatttctacaaatacttaattccattcattctagttcattcttgttcttcccaattcagaatttattctgacatgtacgtgatacatcatatttatttgtttttagtatcccttgccagagagttgtaatatgagaaaactttctcttatgtctctgatgcttttaacaggcagaacacagaagaccatatatacaatttatttatgttctcaccaaataagtaatcagagacaaaagtctatgtttacctttggaatatccctctcagtgcatcatacaacttgaaaacaaatgccatagatacgggagaagggagggtgaaattacagggaaaggctgttatctgaattacatttttcaaaaacatctcctatgcccatatcatacaagtaacataagttttatctatctctgtaataattttattgtaaagcaatttgctgtaaagttaaaatattgcaacttcatattctttacttttattttgtaaatatactatttaaatatgcaattaaataaatgattatacatgtgcaatgtataatcagtgtggttctgaattgtcttatagctcattcttcgttgccttagattattcatgaatcttcattatatctaggcattttctactttatatgacagtgaaataaaggttttcattattttttgatttggtgctttttacatccattgtcccaggctgtttgcttgatttttgatggtagagccgtatgtacatggtggcatttgctacaattagatttaatatatttcttgcataagtgaaacatgtaagcatgtttatgtatgcacatgtgtgtgtgtgagtggttaaatccacagaaagactattgagaatgaatatgccgagacataaactcaacatctaccaccctgttttttctttgttttttaatttacaatgtaatgtagcagcacctaccttgtgtgaccggtcactggttttgttggtagttaaatggtgcagaacaggttccatgtcaaagctttataaggatgatttttggtctgaaaaacataattctcattaatagccaatagattttaaaaagatagtcgatgagaacatatgtctgctgctgctttatggtaccaaagctaaatgataagtacttttgatcatttttattcccacttttcttttctttgggaggttgaatcaatctacattacaactttgagaatgttttatttatggcctttttctcaaagaaaggtacattatgaaatcaggtcacttgttttatatatccctacagagaaatgcagccttcacaacatttccaaaagaagaacacacatcagtatttcccgtacagacacacagaggaagaatatcttcaagcctccacttcatgtcattccattacatttagccacattctgttgagagaaagcatagatttagtagacccaatgcatactttttttgcattttaatatctctgaaatccagatgtatattgcactcaatgttgtgttgtagtttaattggcagtgttttctttcttagagatagtggtgtgtcttaaagtagtggtgtgtcttacagtcaaagactgtatcttgaatgtgataaactagagtaagatagactaaaattggcatatataaacactaacttagggatcaattaaattagaacctgagtgatgacatgtacttcctccatctatgtgcagtttaatatttaaaatctgagttaataaacaaaagatctctcatagtactggaaagattttagaataaatgattgttgactacatattttcattttataaaatcatcaagagttattgtagcgtcaacagtgtttgttactccaaccatgccatctatgggatttcacacacaaacactttttggaaagaagggttgaaatacaaaggaagctagtccaggagaatccctctgcctgcactgcctgcattatctttagtctgtgggttttattgactatgtgttacaaataaaagaaaatagaatagacaaagactgaaagagattgtgcatcaggtggttagaccatttggttattgtttgacttttgtttgggggggtaaaatgggtataatagaaataacaaatattctaatacattttccgtgacttaaatgtgtagagaaaacacaatatattaagtcaaaagtacaattaagtaaattaactgtactgctaaagtatttcttcaggcatctttttaaaagctttattgccatataattggaacacaataaaatgtttaaactgtagaatttaacacattttaacatacgtatttttaccatgaaaccatcgcacaatccacataataagcatatccagtacctacctattaacatttctacatgtacacttataatctcttcctccttcccatccacgcatcctcaaccccaggaaactgatcctgtatgttttgtcactatagactacgttaccttttctagtcatgcataactgaaatcatacaatatctactcttttgaccgagagtgggagagtttgccttttttcatttagaattattatcttaagattcatacaagttgttgaatgtgtcaatagatcattcctttatattgcacagtagtgttccattttatggctctaccaccatgcgtgcatctgtgcacctgttgatagacatttggattccatgtttcagctattaccataaatcttccatgaacatttgtttagaagtctttatatgcacataagcattgaaagtttttcttagataaatacttatgagtggaatggctaaacgatatggtaggagtatgtgtagctattgaaaatattgctaaacaatttttcaaagtagttgtactattttgcattattattagcagcagtgttggagagtccaagtacctccacgtctttgccaaaacttggttaatctgtaattatgccatttaatatgcatgtagtggtgtcacattttatgttggattccccagtgactaatgatattgactgtgttatgtgcttatttgataactgcatatttctttagttaatagcttgccaatatttttgcctgagatgttgatatttttattattaaattttgcgtgagagttgtttaaaattctggaaacaagtcctttatcatatatgtgattcgcaaatattttctcccactctgggactgtctttttattgccttactagtgtgtctcaaaaggtacaagttttaaattttgatgaagtccaaattttcaattttttgtggggattgagattttagtgccatagctaagatatatttgcctaaaccaagggcaaaaggttttctcctacattttctcctaaaagttttatagttttatgttttccatttaagtctctgctgtattttgaattaatttttgtatgatacaggtatggatcaaagttcattattttcaatgaatatcaaacttggtcatcaccattctactctccacttatatgagtttgacatttttaaattccacatataaatgagatcatgcaatattcgcgtttctatgtctggcttatttcgcttagcagaatgtcctccaggttcatccatgttgttacaaatgacaggatttccttctttttcaagggtgaataatattccattatgtatatatatcacctacttttatctgtttatttgttgatggactcttaagctgattgcgtatcttggctgttataaatatatgctgccaaaacaggaatgcagatatctttaaaatgctgatttcaattcttttggatatatactcagaagtagaattgttggatcatatagtggttttatttttagtttttgagaaatctttataatcttttccatgaaggctataccaatttacatgtccaccaccaatttataagggttccgttttctccacgtcctcgccaatacttgttatcttttgtctttttgtaaaagtcattctaagacatgtgaggtgataccacattgtggtttcatatacctgttgaccatttgtacctctttttttgagaactgtctattcaatccttggctcattttctcatgaagttatttgttttattgctactaagtttcttatatgttttggatattaaatctttatcatatatatgatttgcaaatattttctcccatctcataggttgtccttttcactctgttgattgtttgttttatcaggcagaagctttttggtttgatttgatctcatttgttcatatttgctttgttccctgtgattttagagtcatattcaaaaatctttacaaggaacaatcaagaagctttttcctctgttttctttcagcagttttacagttttaggtcttacatttaagtctttaatccattgaaaggtgatatttgtatatggggtgagacaaaggccctattttattcacctgcaagtgaatatctagtatttcctacaccatttattaaagactgtcctttcctcatggtgtgttgttagcacctttgtcaaataacagttaactgtagatgtgtcaactcgttttttgattctcaattctcttccatatgcctatatgtctgtttctgtgccagtaccatgctgttttgattgttataactttgtggtagattctgagatcaggaagtataatgcacccagtttgttctttttgctcaagcttgcattggctattgaagatcttttatggtttcatatgaattatctctgtttgcagatgacataatcttatatgcagaaaacattaaagagtccaacaaaaagctattagaaccaataaacaaattcagtaaatcgcagaatacaaaatcaacagacaaaaatgaatggtgtttctgtacactaacaacaaagtatctgaagaaattaaaaataaatccatttacaatagcatcaaaaagataaaatacttagcaataaatataaccatggaggttaaaggtttgtacactgaaaactataaaatattgatgagagaaattgaagaagaaaaaaataaatagaaagataccctctgttcatggattgaaagaattaatattgttaaaatgtccgtactgcccaaagcaatttacgaattcaatgcagtccctatcaaaattccagttctatgatttctaatttattttatgaatttttttaaaatttagttatttatgagtatgttatttagcttccaaatattttagcatttctctgtctttctgttattaatttccattttaattacattatggtcaaataacacactttttgtgatttaaactctttaaatgtattgagacttgtcttatgacaaagaatttgttgtattttggtaaatgacttatgtgcacatgggaatttacatactgctgttagtgagtggactagtctacaaatgtcaaatagcttaagttggttgaatgtgttgctcaaatcttctatatctttattgatttctgtctagttcttctgtaagttatacagaaaagagttgaaattttctaatatatttgtagatctgtctgattctccttgcatttctatcacttttgccccatatattttgaatctctattatatagtgtacatactttaggatgtttatgcttctcgataaattgtctcctttaccactataaaatattcctgtttatacatgataatattttttgctctaaaatcaactttgtctgatattaatacagatacttcagctttctctttgagggacagaactaataggatgtatgtatatatgaaagagtgtttattaagcagaaatcactcacatgatcacaaggtgaagtcccacagtaggccatctgcaagttgaggaacaaggaaaccagtccaagtcccaaagcagcaaatgtagggaagctgacagtgcagcctttagtgtgtggccaaaggcccaagagcccctggcaaaccactcgtgtaggaacaagagttaaaaagccaaagaacttggagtctgatgtttgagggcaggaagcaaccagcacaggagaaagatgaaggttggaggactcagcaagacagctttttcttctaccttcttctccctgctttttccagcctcactggcagctgattggatggtgcccaccacattgtgggtaggtcttcctgagggtgggtcttcctctcccagtccactgactcaaatgttaatctcttctggcaacacccagaaacacccagatacacccagaaacaatactttgcattcttccatttaatcaagttgacacttaatattaaccatcacagcattatttgcaaggtgtattatttaacctgctattacttttaaaccgttttgagttttcatatttaaaatagatttcttttaggcagtatgtagttgggtcttactttttaaaccaacataacagtatcttcctcttaaagtagttattgacatggtgtgtttaaatctagcatcctgctatttgctttctatctgtcccctatgttctttgtacattctattctttattctaccttcttttgtgttaatggtgtattttattctattttatctctttagttagatagtattacttctccacatattataaagcccatagtacaatgatactatttgtttgactttaaacagctggttaatctttcaaagagatataaataatgagaacattaatttatatttgtccatgtagttaccattttcaatgctttcaaattctttgtttagataactggtttaatctggcgttattttctttcggcctgttcctccaacataattgtaggtaggcctaataattatgaattatttcaacttttgtatgcctaaggaatgtctttatttcacttttgtttttaaaacatattatcactgattaaagaattacagaccaatatcttcttccttcagtacttcagatatgtttctctactattttctaacttgtataatttttgacaagaattcagctgttactcttatatctgttcctgagtatataatgtggttttttttctctgactgctttcaagattatctctttataataagttttatggaattttattatagtgtacctaatttagttttcttcatgtttcttgtgcttgtggtacattgagcttctgggagccaaaatttttgaccattgttttttcaaggaagtttttctattctcctgctccttttaatttggaagctacaattacacatataatagtctgtttgaaattacccactgttcaacgatgctgtgatcatttttcatcgcttttcttttgtctttgtatgtttcaccttttgatagattctattgctgtatcctcaaatttactaattttctttcgcaatatttgatcttctgttaatcacctccagtgtgttttatcagacagtgaaattttgattttttcaggatttttttaaaaagaactttattgtttagagcagttttaggctgaccgcaaaagtgagcaaaagtgcagacatttcctatatcctgtctgcccctacacattctcagtctcctctgttatcatcatctaccaggatggtacattttttacaactgagacacctacagtgacatattattatcacacacagaccataatttgcattagagttttcttttagtgttctaaattctatggatttgaataaatgtataacaacatatatctaccattacagtatcatacagagtagtttcaaaatccctacaaatcttctgggttccatctacccatctctctgttatccctaacctctggcaaccactgatttttacactgtctccagttttacctcttccagaatatcatatgactgaaaccataaaatatgttgccttttcaggttggcctttttaaatttagtaatgcacacttaagttttctccatgtcttttcatggcttgatagctaattttttttttaatacttcatgttgttccactgtctggatataccacagttcatttatctattcagctactaaaggactcttagctgcttccaaattttggtacttatgaataaagctgctgtaaatatccatgtgcatggttttgtgtcgatataagttttcaactccttttgttatataccaaggagggtgatacagctaggctttttatccccacccaaatctcatcttgaattgtaatccctgtaattcctataaactccacatgtcaagggagagaccaggtggaggtaactgaatcatgaaggcagtttccttcatgctgttctcatgatagtgagtgagttctcatgagatctgatggttttgtaagggtcgctttcccctttgctaggcacttctctttcctgccaccttgtgaaaaaggtgccttgcttccctttcaccttcccccatgattgtaagtttcctgaggcctccccagccatgtggaactatgagtcaattaaacctctttcctttataaattacccagtctcaggcagttcttcatagctgtatgagaactaatacaacaaattggtactgggagtggggcactgctataatgatacccaaaaatgtggaagcaactttggaactgggtaacaggcagaggttggaacagtttggagggctcaggagaagacagggagatgtgggaaagttttgaacttcccagagacttattgaatggctttgacgaaaatgctgatagtgatatggacgatgaagtccaggctgaggtggtctcagatggagatgaggaacttgttggtgactggaataaaggtgatgcttgcaaatgctttagcaaagagactagtggcattttgtccctgccctagagatctgtggaactttgaacctgagagagatgttttagagtgtctggcagaagaaatttctaagcagcacaatgttcaagaggtgacttgggtgctctgaaaaacattcagttttatgccttcacaaatagatggtttggaattggaacttatgtttaaaagggaaacagaacctaaaagtttggaaaatttgcagcctgacaatgcgatagaaaagaaagacccattttctgaggggaaattcaagcaggctgcaaaaacttttatagctaatgggaagccaaatgttaatcaccaagacaatggggaaaatgtctccagggcatgtcagaggtcttcactgcaacccttcccatctaaggcctggaggccttggaggaggaaaatggttttgtgggctgggcccagagccatgctgctttgtgctgtcttaggacttggtgccctgcatcccagctgtggctgaaagaggccaaaatacagctcagatcattgtttcagagggtgcaaaccccaagccttggtggcttacacatggttttgggcctgcaggtacacagaagtgaagaattgaggtttgggaatctctgcctagatttcagaggatttatgaaaatgcctagatgtccaggcagaggtgtgctgcagggcttgagctttcatggagaacctatgctggtgcagtgcagaagggaactgttgggttggagacaccccctgcagagtccccactggggcactgcctactgtagctgtgagaagcggttcactgtcctctagaccccagaatgatagatccactgacagcttccaccatgagcctggaaaagctgcagacactcaatgccagcccatgaaaacaactgggagggggactgtaccctgccaagccacaggggtgaagctgcccaacaccatgggaacccaccttttgcttcagcatgacctggaagtgagatacagagtcaaaggagatcatttcagagctttaagatttgactgcctcactggattttggacttgtatggtgcctgtagccccattgtttcagccaatttctcccatttgaaatggatttgtttacccaatgcctgtatccccattatatttaggaagtaactaacttgcttttgattttacaggctcatttgtagaagggacttgtcgtgtctcagatgagactttggacttggacttttgggttaatggtagaattaattaagaatttgggggactgttgtgaaggcatgactgcttttgaaatgtgaaagggatatgagatttgtttggggctaggggaagaatgatatgtttagggtttgtgtccccacccaaatctcctctttaattgtaatccccttaatccccatgtgtcaagggagagacctggtgaaggtaactgaatcattgaggaccatttccttcatgccgttctcatgatagtgagtaagttcttatgagatctgagggttttataaggggctcttcccactttgctccacacttcttcttcctgacgcctggtgaagaagatgccttgcttcttcttcactttccaccaagatagtaagtttcctgaaacctccccagctttgagtcaattaaaccactttcctttataaattgcctagtctcaggaagttctttatagcactgtgagaatggactaatacagacagcaattactagattgtatggttatagtatgtttacttttgtaagaaactggcaaactgatttccaaaatgactgtactattttgcattttcaccagcaatgaatgagagttcttcttgttctattccttgccagcatttggtgttgtccatgttctgaattttgacataaaggctgtgtagtagtgtttcattgttattttaatttgcatgtcactcataatctgtcatttggggcatgttttcatatgcctatctgccatttgtgtatattctttactgaggtctctttaaggtttttggcccatttttttagtcagattgttttcttattgtttagttttaagagtcccttttatattttggatagtagtcttttatcagatgtctttgcaaatattttcacttagtttgtggcttgtctttttattctcttgacagtgtcttttacgaagcataaaattttaattttaatgaagtccaacatatcaatttgttttttcatggattatgcctttgatagtgtatctaaaatgtcattatcaaaaccaagatcatcttgattttgttcccagacattgaagtttttatctctaaaattctgatttggatttaaaaaaaaaatctcttccatagttgtacttaacatgttaagtattttctctaggttttgaacacatgaaatgtagttataataactgttttaatgttcttgtttactaactccatcatatgtgtcatttttatgttttggtcaattgtttgttttcttcctcattatgagttacattttcctgattctttgcatacctgaaaatttgtattagatgtcagaaatttgaattttaccttgttggaaattgagcatttttgtattcttgatctttgttctgagatatggttaaattactcagaaacattttattctttcagttcctatatttatgctttttcagataggaactgagcagcatttagtattggcttaatttttccccactgttaaggttaagacctttcttagtactcgaacaaatgcctccctaattatgatattttccacatggatgttaggttaggaactattcctggcctgtataaattctgagcactggtccttctaatcctttcagtgtgtcctttcctattttaaaatagtttttccatatggatgcactagtcattactgaattgaatactcatgagggatgtcctgtagatctctaacactctttctctgcacagctgtcctctctcgtttactgtgaattctagttgctttagtttctccagactcccagatctgtcttttcaactcagaaagacagctgagctttgcctaagtctcccttgctatgctgtagagtgaaaactttgtccagggagcaagcttgggcagttgtatgatttggcatgttaatttaacatacttcaaggattactgtcctttatatgctgatgcctaatattttgcgactattctttcatgtattttgtgtagtatttagctaatttttctcatttttatttactcagtaaaaagtgaatgaaagatagaagttgacccaaacctgctctaaatgtctttatctaaccaagagaatagaaataaagttacctgcatttggaatattgcatattttacctgtccttatttgaataaattatgggaaaaaaaacagcaactgaaaggtaatagagtgattctttgacagaatcctttctcagaaagagtttaaaacagaaacagtaaaaagctacagtaaagtactaatttaacctaccattccttaaaaaaaaaatctgctggataaaattcacaaggactataactcttctgtagttgaataggttacatttttcagtgccaagtgacaagagaaaaataaaggtttaaagtacctaatttcaaatatcagttcaattatctgccacctctatgacaccaaataaattatcctctctgaactgcattttcaaaattaggaaagtaggaataacaattcctacatcatagagttactattagatttctccaagagactcaatacatgaagacctgtcattcatatgttaatttattatttcaccctagttttctagagtatttggggagcattgtttactttatgaagcatttgcctatcctctaacattctccttctttctgaaacgccatccaagacacagtccatttctcaagctttccttaatccaagtatgcttgcattctataaacctctctctgctgcccttcagcttttcatggtgtcaactgaaaatagatggtagaaaattcactctttggctttctgcttacaatatatattgtcatgtgccctagtaatccaaagaaactctgaacccacaaaaatgtttctatagatatgaaatattgggaataatttgttagttctatctttcccaaacattgtttcaggtcaaacctttctttttttcctgtgagtttaaagagtattttctaaagctgattttacttactaggtctagggtgacattttactctggctgctgttaatacttaaaatattttgtactatttctttagcatcagatttggcattcctaactaagaaaatgcccggaggccacaaaatttaaaaacttaaagaccaagagccaaatacgttagaagatagagagagagagagagaataaatattgctctaccattagtttttctgccttaacggctgttggaaaaacatacatgtgattcagatatagaaaaaaaaaaatgacaaaacaaaacaacttgaatcatgtctaagaaagtctggttttagttataatatcaactgaaatattctctgcctaaaacaggccatagtgactttaaatcactaaataagacgatttaaaaacatgctaattggccgggcgcggtggctcacgcctgtaatcccagcactttgggaggctgaggcgggtggatcatgaggtcaggagatcgagaccatcctggctaagacggtgaaaccccatctctactaaaaatacaaaaaaattagccgggcgaggtggcaggcgcctgtagtcccagctactcgggaggctgaggcaggagaatggcgtgaacccaggaggtggagcttgcagtgagccgagatggcgccactgaactccagcctgggcaacagcgagactccatctcaaaaaaaaagaaaaaacatgctaatagaatgcagatattaatataattcaagataaattatactgaaaggtaaatttgagtctgctattccttcataattgagactgactgtggagtattctaccccttacatgaaatgattaatggactattcgtacccctagcttttgtaatgattttttaagttaaaaaatcttttaataattaagtttaattttaaacagttaaagattgggaatgaatctttacagccctctcattctatctttacaccaaaataatgaccaatactgtctgttaaattttttaacctatgcttctgtcatctatttaaaaatgtagagtattaaggctagttcttgtgctttacttgaatggaaattcattaaaaacactgtgctccacaaatataaactgaataaatgtcagcattcataaactgttctgtgctctactttgaactgtagtgtggtttctttttaaccatttaccaaatagtaaagaacatggctgtaggtcaggcatggcttacacctgtaatcccagcactttgggtgactgcagtaggagaatcacttgaggcctggcgttcaagaccatcctgggcaatatagaaagaccccatctctaaaaagaaaaaaaaaaattaaagactagctatagtggaatgcatctgtagttccagctacccaggaggctgaggcatggaggattgtctgagcccagcagtttgaggctgcagtgagctattattcagtcactgcagcctgggcagcagagcaagaccttgtctatattaaataaataaatgcagtgactgtagtagacagcagaagtctctgtcttaaaaataggtgaaagccatgtcccctaattagaatagtatatcattaacatggcatttttaccacctgaccccgttaagctgtgccatagatatgcacaatccattgtgaaccaatgtcacaagtgtgccatgtattgtgtatgcctcattgtccgcttgtctctatttgactttggtgtataccctgtagaacaaaagggctgatgtacatgaatgtgtacattgaatatgtacaagaataatgacttcatagagaaatattttctctctttctagctagaagtttacttaatgtctttttcagtttacttacttataaaacacaaaagataaagcatacttcttaggcttctgtgaaaattaaatgatatatcagataaaatcctgtaaccatgttaaagctcaatgttaaagctcaattaatcatacctatatagtgatagaatctaagaatcagggatggatctagagctggaagaccacatttcccaaatacaattttttcgtgaattaaggtctaaatagatattaaataactgccataagtctcccataatgtcatagggctgggtctagaatgtccatcttagtaccattgctcccctacactttccactgcacagtctataggtgctagctttacttaaaactctagcagctgctagcatcaaatattatgtgtgtctaacttcttaacagaagaatggagattttactttctcctggtacttgatagaattcatagggtcaaccatgagcacatgaacttctatatcacacgaaactattgctacggaataaaagatgaaatgctcctgattattgtaaatacaaagttgcatgtgggattgtgtaaagacaatgccaggttggactgccagaatgagccaacagcgcatgatgtgcttccccctgcagagagcctatgagtggacgtgcagtcagggaggtttcacatcaccaagattcctgtcccagaaaagcagatgttcatacatctgggaatggaatgcgacccttgtggagagcctataaacggatgcatgaggggcgcctgtccatacagataagatagggctataaatgccctcatcttgccacagctcttctaggcctctttagggttaaggtatactcccttctgagaatttctggtctaaccagttgtctagcttcacgtcctgtttctatggattttttgtaaccagcttttgctgcaactgttactgctgattaatatcttgctaatcataggttatggaaagactgtttctgttttaaggctctgttagaaattactgatgcacatgttatattgtaaattcttatctctgtatactgtacttctacatacaggtgttatgtgaaagaattacttcatccccatatgaccatctcacctcatgatcaaatgatcctaaatccctcactaacctacccctgccctcactaaacttaataacaaatgctggtatatccagtgcattggtggcaccacgggaccagaaggtggtgacccccctggacccagctttcactgtcttgtgtgtgtctattatttctcaacctgccgatccacataggaacaaggagagagccctgttgcattgtgggctgctggccagatcccacaataaaagttctaatgcacctaaccatatactctattcaacttgaaacaatgtttcaggaacccaggggctgcaggtgagagatataactttacttttatatatttggcccatgaagattctgagaaggcagtcattctgagagtatcactatgacagtatcattagatgcagcaaattaggttatctgagtgttctagtgctttttttgctgtagtatttagttatattaatgtggattttgttctattacattaaagaattatagtttatttcactatggaatatttaaatattattatcaatttcaatcctattcttcaatcctagccaaaacaggaggtgattcaaaaaagacagttataaatttaaaaagccttgaaatgttctagagacaaaaagtggtatcttcttacatatatttgtgaatgtaattagcaaaaaataatgatatatatatatataaaataaaagtttgaggagtattaagaaagtactaactgtcaatgttttctggccagaattttataccagtgcaccaaaacataattcttgtatgactttgttatgactttgttatgcaatcgttgatgatatttatttgcctcataatgtcgtttttaaacactcaatctgttttcttattgctgcccacatttgggggaaagaaattcacaagtaactttgccaaaaaggaattttgtaatgttattcctacatagtctttgagtataaaaataggtataatcagtataaaagaatgtcatttttccagtctaatctacaaataagaatttttaatgaatgaagattttggtagatttccagcttcagttccattattttaatagaagaatacaattcttaaaattttacctagttttttgttttaataaaatgtctattaatttgcaacattataaaagactatatacttttataaaactctgtgctgatgaaaacaagttgaaaattaaatagggaggtaatatggtcacaaactttgtggtatttctgtaagaaagactctttttctatgtaatttttaatttaacatctccacttttgacagaatatagacagtttttaaagtaataaaatgtaatgagcccagacgtgcagactacagtgttccaaactataaacgtcaaattagggagaagcacgggaaactaatcagcttttctggcagaacctggaaaactacaataagaggtgagagtgaggcaggaaataaaacagagtaaaataagggagattgtttaaaaacattttattgttcagaggtacatccatatgtagaattacattgcgtctgaactaataaactcaattataaaggtttctggccttgacttttcatctttacaagtatctcactgttatttgtgacccctttcagtctgcacccatgtctatgtattcttaatccatgatgtctaatttctcccttttcactaggacccctgtcttcacctcttacccttcatgaactacagtacatggtccatcgcttattctctccaacatctttaactctcttgctacaatgctcttttattacattcactctttaaatcctcactaaatatttcattgtctatatgcctctactcaaggtgcttagcactactgaagaaagcacacaatgctacagaatggtctcactataattgtattttccctagccttacttaggccctcagtgctgcacaccagtcttctctgtcttcattgtggctaattgcgacactcaccttcacctcctgctcccacaggcaaggtcagatgctactttccagagataattgaaagtctcggacaaaagattgtttcacttgctaacttcagatctataaacttcccaccctccatacacatccttctttcctcaactcatttttagaagaaaaaaaaagacatttctatctctaatgcaaatccaccttcattctgtatcttacttcctgctttttagagactgtactctcttactgttaaccattcaagtaattccagccactcctctctactggctctttctcatttgcatctgtacatcacatttctcaaatctcagcagagctcactctcaagtttttaacttctgtatacctcatgtgtaagctggatgaaatggtaattcctgcttcatagacttgttataaaaattaattccatggattataaataccaaacactttaaaagggggtctggcccatggtagaagtccaattaatactctccattgttattatctaactgtgtaagccacaaaccaagaaactaaagttgctatctcctttttcatcattgatattctatccagtatcaagtcttgttagttctatatcttaaatatcttaaacatctacttagtacaaccccattaatttaactagaccagagtaatcatttacatgatttcttcctcagccttttacttcgtattcctacctctaaccttgcttattttcagtgcattattcttgctgcatacagagtgtcctaaaccaaagtcttacaaactgtgcaccatggactggtcacctgttttcacgaaacaggtttaactggagcacagccatgtccatttacttgtgtattattggtggttgctttcactctacaatggcagccttaggtacttgcaatagagactatctggtccacaagcttatatgtttagtgtgtctttctttaagaaaaagtttgatgacccctgtcataaactcaaatatgaacatcattcacctgcttaaaacacttcaacgttttcagtaactttcaggatatgtccaggttgatttttgtagtacttcatacttacccttgtcttcctcttcagcctcatcactaaatagtgctagtgaagcaacaaccatacaaaacttctttctgtatctttttttttaaattttattattatactttaagttttagggtacatgtgcgcaacgtgcaggtttgttacatatggatccatgtgccatgttggtgtgctgcacccattaactcgtcatttagcatgaggtatacctcctaatgctatccctccccactcctcccaccccacaacagtccccgatgtgtgatgttccccttcctgtgtccatgtgttccattgttcaattcccacctatgagtgagaacatgtgtgtttgggtttttgtccttgtgatagtttactgagaatgatgatttccaatttcatccatgtccctacaaaggacatgaactcatcatttttttatggctgcatagtattccatgatgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctggatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgttttttggctgcataaatgtcttcttttgagaagtgtctgttcatatcctttgcccactttttgatggggttgtttttttcttgtaaatttgtttgagttcattgtagattctggatattagccctttgtcaggtgagtaggttgcaaaaattttctcccattctgtagtttgcctgttcactctgatggtagtttcttttgctgtgcagaagctctttagtttaattagatcccatatgtcaattttggcttttggtgccgttgcttttggtgtttgagacgtgaagtccttgcccatgcctatgtcatgaatggtattgcctaggttttcttctagggtttttatggtttcagctctaacatttaagtctttaatccatcttgaattattttttgtataaggtgtaaggaagggatccagtttcagctttctacatatggctagccagtttttccagcaccatttattaaatagggaatcctttccccattgcttgtttttgtcaggtttgtcaaagatcagatagctgtagatatgcggcattatttctgagggctctgttctgttccattggtctatatctctgttttggtaccagtaccaggctattttggttactgtagctttgtagtatattttgaagtcaggtagcgtgatgcctccagctttgttcttttggcttaggattgacttggcgatgcgggctcttttttggttccatatgaacttcaaagtagttttttccaattctgtgaagaaagtcattggtagcttgatggggatggcattgaatctgtaaattaccttgggcagtatggccattttcatgatattgattcttcctacccatgagcaaggaatgttcttccatttgtttgtatcctcttttatttcattgagcagtggtttgtcattctccttgaagaggtccttcacatcccttgtaagttggattcctaggtattttattctctttgaagcaattgtgaatgggagttcactcatgatttggctctctgtttgtctgttattggtgtagaagaatgcttgtgatttttgtacattgattttgtatcctgagactttgctgaagttgcttatcagcttgaggaggttttgggctgagatgatggggttttctggatgtgcattcatgtcgtctgcaaacagggacaatttgacttcctcttttcctaattgaagaccctttattcccttctcctgcctgattgccctgcccagaacttccaacactatgttgaataggagtggtgagagagggcatccctgtcttgtgcccgttttcaaagggaatgcttccagtttttgcccattcactatgatattggctgtgggtttgtcatggatagcttttattattttgagatacgttccatcaatacctaatttattaagagtttttagcatgaaggttgttgaattttgtcaaaggccttttctgcatctattgagataatcatgtggtttttgtctttggttctgtttatatgctggattacatttattgatttgtgtatattgaaccagccttgcatcccagggatgaagcccacttgatcttggtggataagctttttgatgtgctgctggatttggtttgccagtattttattgaggatttttgcatcaatgttcatcaaggatattggtctaaaattctcttttttggttgtgtctctgcccgggtttggtatcaggatgatgctggcctcataaaatgagttagggaggattccctctttttctattgattggaatagtttcagaaggaatggtaccagctcctccttgtacctctggtagaattcggctgtgaatccatctggtcctggactctttttgcttggtaaactattgattattgccacaatttcagctcctgttgttggtctattcagagattcaacttcttcctggtttagtcttgggaggatgtatgtgttgaggaatttatccatttcttctagattttctagtttatttgtgtagaggtgtttatagtattctctgatggtagtttgtatatctgtgggatcggtggtgatatcccctttatcattttttattgcatcaatttgattcttctctctttttttctttattagtcttgctggcggtctatcaattttgttgatcttttcaaaaaaccagctcctggattcattgattttttgaagggtttttgtgtctctatttccttcagttctgctctgatcttagttatatcttgccttctgctagcttttgaatgtgtttgctcttgcttttctagttcttttaattgtgatgttagggtgtcaattttagatctttcctgctttcttttgtgggcatttagtgctataaatttccctctacacactactttgaatgtgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagtttcttaatcctgagttctagtttgattgcactatggtctgagagacagtttgttatgatttctgttcttttacatttgctgaggagtgctttacttccaactatgtggtcaattttggaataggtgtggtgtggtgttgaaaagaatgtatattctgttgatttggggtggagagttctgtaaatgtctgttaggtctgcttggtgcagagctgagttcaattgctgggtatccttgttaactttctgtcttgttgatctgtctaatgttgacagtgaggtgttaaaatctcccattattattgtgtgggagtctaagtctctttgtaggtcactaaggacttgctttatgaatctgggtgctcctgtattgggtgcatatatatttaggatagttagctcttcttgtttaattgatccctttaccattatgtaatggccttctttgtctcttttgatctttgttggtttaaagtctgttttatcagagactaggattgcaacccctgcctttttttgttttccatttgcttgatacatcttcctctatccctttattttgagcctgtgtatgtgtctgcacgtgaggtgggtttcctgaatacagcacactgatgggtcttgactctttatccaatttgccagtctgtgtcttttaattggagcatttagcccatttacatttaaggttaatattgttatgtgtgaatttgatcctgtcattatggtgttagctggttattttgctcattagttgatgcagtttcttcctagccttgatggtctttacaacttggcatgtttttgcagtggctggttccggttgttcctttccatgtttagtgcttccttcagtagctcttttagggcaggcctggtagtgacaaaatctctccacatttgcttgtctgtaaagtattttatttctcctttacttatgaagcttaatttggctggatatgaaattctaggttgaaaattcttttctttaagaatgttgaatattggcccccactctcttctggcttgtagagtttctgcccagagatcagctgtttgtctgatgggcttccctttgagggtaacccgacctttctctctggttgcccttaacattttttccttcatttcaactttggtgaatctgacaaatatgtgtcttggagttgctcttctcgaggagtatctttatggcattctctgtatttcctgaatttgaatgttggcctgccttgctagattggggaagttctcctgggtagtatcctgcagagtgttttccaccttggttccattctccccgtcactttcaggtacactaatcagacatagatttggtcttttcacatagtcccatatttcttggaggctttgtttgtttctttttgttcttttttctctaaacttgtcttcttgcttcatttcattcattttgtcttccatcactgataccctttcttccagttgatggcattggctactgaggcttctgcattcgtcacgtagctctcatgccttggttttcagctccatcaggtcctttaaggacttctctgcattggttatcctggttatccattcatctaactttttttcaaagctttcaacttctttgccattggttcgaatttcctcctgtagctcggagtagtttgattgtctgaagccgtcttctctcaactcgtcaaagtcattctccatccagctttgttctgttgctggtgaggagctgcattcctttggaggaggagaggcactctgatttttagagtttctggtttttctgctctttttttttcccatctttgtggttttatctacctttggtctttgatgatggtgacgtacagatgggtttttggtgtggatgtcctttctgtttgttagttttccttctaacagacaggaccttcagctgcaggtctgttggagtttgctagaggtccactccagaccctgtttgcctgggtatcagcagtgatggctgcagaacagcagatattggagaactgcagatgctgctgcctgatcgttcctctggaagttttgtctcagaagagtacctggccgtatgaggtgtcagtccgcccctacttgggggtgcctcccagttaggctactcgggggtcatggacccacttgaggaggcattcttcccattctcagatctcaagctgcgtgctgggagaagcactgctctcttcaaagctgtcagagaagtacatttaagtctgcagaggttactgctgtctttttgtttgtctgtgccctgcccccagaggtggagcctacagaggcaggcaggcctccttgagctgtggtgggctccacccagttggagcttcctggccgctttgtttacctaatcaaacaactaactcatcaatggtgggcgcccctcccccagcctcactgccgccttgcagtttgatcttggactgctgtgctagcaatgagcgagactctgtgggcgtaggaccctcctagccaagtgcgggatataatctcctggtgtgccatttttttaagcccattggaaaagcgcagttttagggtgggagtgatccaattttccaggtgccgtctgtcacccctttctttgactaggaaagggaattccctgaccccttgtgcttcccgagtgaggtgattcctcgccctgctttggctcatgcacggtgcactgcacccactgtcctgcacctactctctggcactccccagtgagatgaacccggtacctcagttggaaatgcagaaatcacccatcttctgcgtcactcacactaggagctgtagactggagctgttcctattcggccatcttggctcctcccttttcagtatcttaaatacactctttttctctcacagctccaggagttagcatagactactgactcttcctagaatattttttatctctcttccttgtctaaataactcctaccaattatgcaagtctgaacaaaaacatttcctgactcttgccacactagattggctgtgcctatgtccatacttcctctaaatcatgtccaatattctttaagtcattacttaagtcattctatgaattccacctctatcactctccccattgtcaactccaggtctacgacaaagtctagaacatagtaagtaccttatatataattgctgagtgaacaaatgaatatacatggcgttatttcagaaatttctcttggctactttcaaacttactcttgttccttggcaaggctgctttggcatgtgattctcctgggtcctccccattttgctggatacaaggattttctctggtttggaagataagaaacacctaggcaaaaatgatatgtgagaaaggaaggcagccaattgcctatagttgggacataggctgacctcagcatttattgctttcagtgctaaataacttatttttaatgaaagaaaagattataattgttttaaaaaacaatggtaaaaacataaaggccatatcagatcataatgtcacagagactgtcaagcttctttacctaaattagattctttgcctaagataattaaaagtgatgctatatattctgaaccacatgaagtcctaagcagaactaataccaggggaaggccctgagttaatacataatcacacgttctgagtcaagaatcagaaaggagagagatctaaagcttatattcaagttagatgcagttaatttattatccctgaaggccaattattctaatcatttggagactgcgacaatgtggtcccctgcctcaagggagagattcatatactctcctctcaagaagggcccaagctttgcactcactgcccctgaaggtttccagactttttcaaagaaaaattttgccttcaaaagtttttgtgtattatgtagatagtagcaatcacccacattagtggtttagttttgttctctctcttttttttttttgagatacagaatcataaaaggaaaaaaaaagcctttgtctcaatagcttttcttatgatagctttttatgtgctttcttagagaaaagttataaaacttggttctttcagcttctatcaaagatatacaatgtttccttttttttgtgcaagtcacaaaggagccataactgtatatattttcacatcagatgtaaaattcatatctcacttgtgacttatgcaaggaaaataggaagctccattagacagacctacaatttgtctgtgaatagtgatttgcagttggggagtactttcttttgaaatcattaaatcttcacagctaagtattccttctgccttgacagattctacacattacctcatcatatgtataaaaatgatctttaaaaaatacctttaatgacttcaacaatggccaaagttcatccaacactttccatactttcaagaactacatttggaggcactttttatcctgtcactttgatggtgcataacaaaaagcttgtgtcagaatttcagtgtggcttcacatagtcttctcctgttattaagagatatttttgagccaaatgaatagcatcatcctcggtatgatattagctttaaaaaacctcctatatcttcaagttgcattgcttattgtagatgaaaatcaaatgtgtagttgaacagatataatttcaacagaactaaaataggagaaaaacagaactgtgctcttcctttccatcaaaactgacatctccattcattcttctagtgtagctaaaatcagtcctttgtttgtgcttgtgagcaataactctactctcaggttattattatagagaaatttgttttggataataccataattttaagcaaattaaaatcttactatgctctcaaatattttttaaatcttaaacacttacaaaaagaaaatgaatgaatcattcttgatttcaaatcagccatttgaaaacagcaaaattatttcattttccctaagttgttatgtactatataaatgcatatggcatattcataatgtcagtaaaaccttggcactgccagcaggctcaagaacactatttcatttaacaatagcttatgtttggaagtctttccaaacaagtttatagccactctatcaatttttacaaataattttatattccaaagctccaaataacttggaggcaaaaaatttaggagacttaaggacataggaaaggaaaatttaaataaacagcattaaactttcataatttgaagatatttttgtttttgaagggaaaacctgcactttccataaacttgcagttgctttcttatgcccatcctgcatgctttagcataccaaactatgtaaagttccactcatttgccttgctatctcatactgttctgtgtgttcatgtacatggattttcctgccaggaacattttttgcctcctgcaaaaattgccttcatccttcaagctcacctcacatgtcatcttttctgggctacattccctcaccttcctgtctaacataaatagtcttcttgactatgttctcttaatactgtctccttctgtatttggatcatttgattcagtttgttgtatttctaattaggtcataaattccttgagttattacagcattcactttgttttttatttttatataaattcaaggggtacaagtgcagttttgttacatgtatatattgtgtagtggtgaagtgtgtttagtgtaaccatcacctgaataatgtacattgtgcccgttaagtaatttcttatccctcacctttctcaccccctcccaccctcccactcttcccagtctctggtgtctattattccacagtgtatatatacacacacacacacacacgtatagacttacatgtacatgtgtatgtacacacatatatattacatatcatgtatatatatatatacgtgatatgtatatataacattttctttaatttccagtcagtcattaatggatactcaggttgattccatatctttgttattgtcaacagtcccgtgataaacatatgagtgcaggtatatttttaatatagtaatttattttcctgtaggtagatacccagcaatgaaattgctgaattgaatggtagttctttctatgtttagttatttgagaaaactccaaactgttttcgatagagaatgtgctaatttacatttctaccaactgtgtataagcattcccttttctctgcaactttgctaacatcttttttttttctttttaatagccattttgactatagtaagataatatacaattgtggttttaatttgcattgatctgatgcctagtgatgctgactaatctttcatatgcttttggccatttttgtgtctttttttttgaaaaatgtctatgcatattcttcactcactttttgttattttggaattttttgttgtttttgacttacttaagttcattgtatattctggatatcagccctctgtcagatgcatagtttgcaaatattttatcccatttttcaggttgtctgttcacgctgttgattatttcatttcgttgatcttcatttttaatacaggtccagagacctgtattatactatactgagaactcagaaaagttatactgaggagttaataaacatagtgagactgctcaccctgacaattgactacataatctctcgcattactgaaatcctcagggtttttgtttttgttttcttactattaggtctccttttttctcaggccatcaaaatgcagttttctctcctactgcaagaagtcttttaacatgccacctgtaatctcacatcgtgtatctacttacccctaacccaaagccttgtcttccatattacttttttttttctattcattctcgattcctttctctaggtgattgtacaagaagatgtaaagaaattaagactttattccagccaagtaaataaagtagcttaaaatggttaggcagaagccaggaagtcaatggatataccacagaaaattaagacattaagaatttaggtaaatggacaatagtaattttaactttagtcaccatggtttaaggttgtgtgtttctaggtaaataattaggggccaactataattacgcattgtgggctccaaaacacaaactaaggtagaaatgatccaaagattagagatagaagaaaaaaagggccaagtcagtaattttgtcttttaccatggagaaaatataaaaatctagatttaagaaagtaataacaagaagtagttatcctcatatgaaagaattaagttttcttttcagtgggacttgtctaatgctttaactatttttgcataaacaactggcaaaaatataaggctgacaaaaagaagtcattttctctccaaaatgagactggaaaccagtggtcggtgggaaaacacatactgactacctaaattcttttagatgtacatttattattaaaaaaaaaaaaaagagttctgctagaaatctactagagatgccatcacacaaacaaatggtaattataaagtctgatgatgacaaaatgaattttaaaagaaatttaaatgttaaaataagatttattcgcccaccaaaattgataattgaaaaaggatgacagttatctctgagaacacctgagcaatgaagaaagacatcaaacactttttttcctgttattaacatcttttattttattttattattattatactttaagttagggtacatgtgcacaatgtgcaggttagttacatatgtatacatgggccatgctggtgtgctgcacccattaactcactcataggtgggaattgaacaatgagaacacatggacacaggaaggggaacatcacactctggggactgttgtggagttgggggaggggggagggatagctttaggagatatacctaatgctaaatgatgagttaatgggtgcatcaaacacttttggtctatactgttttgatgtaatatctgattaatagaaaaaacaattatgaatccagcaaccaactggagaactaaaacagtaccaagagtaacaataattttgaagctcactgcatgatattctccaatcccatctgcctgtattctctcaagaggaaaccaacagcctgaaatatgtgttcataatctttgtgatttaagacaattatgttatgatgcatagatatatattttaacatacattctttatttttcttctttttttaacattgctaagattgcattatgacatatgtagttatttgtgatttgctttttttcttcaatctttgtttttaagatttctccatagtgttcaaggtaattgtaatttatttattttatctaataaataatcatctaatgtgtatacatataaaacatatgtattcattattctattatcagactttggattgttaccagattaatttttcccctattaaaacaattttggactgccactaataagcatggcagggtagtttgtaccatattaggcctcaattgtagactatgaaaaaaaatgaataaaatatatggaacagttgttgtcatatattggataacaggcattgcaggaatgtgatccctcagagaataaaaaacagtgaagttaaccattatcctagtgtttttccaggaatttttttttatcagaaactgacccagataggagaaatccaagatgatcacaagtttcatagagctgaaaggacagagagggagatcagtgaagctgaggtgactgaaatttatagggcaagtaacaggaatagaggagttacacaaagaacaacttccagacatctgcattaggatctcattgaatatatgaacaaataccaagctatgagtgtacagggcggaaaaactaagaaaaactagtagagaaggaacaaaaaaaacagaaaacctgaaaaccaacaaagagccagatattgaactgggttgggaaatcttcaaactccagttaaccacataaaacctctttgaacaccatggttcactcagtagagagtgaaaaaaagaccaggtcacaggggtagggttaatctagttctaaaataaagactatttttaactcaccctaaaaaagattacaaacaagttttacaaggattaaactaaaccacaaataaattagctgcatgccagaaaaaaatttgccaatgattaaaggacaaaaacaaaattcagagacctgataatgtgaagcctctaataaaaattggtagaaatgtgaagaaactacaacaaaaagaatatatggactataaacaggagataaatcagtcaataaaacattcccagaaatatcagaaatgttggaataaacaaagtattttgtggcagctcttaatatgtttagtcattgtgatggttaattttagatgtcaacttgattgaaatcagggatacccagatagcttataaagcataatttttgggtttctctgtgacagtgtttctagaagagattgtcacttgaatcagtagattgagtaaggaagatttaccctcatcagtgtgagaggacattatctaatccattgaggacacagatagaatttttataaagaaaaaagaggcctgaggcggtggttcacgctgtaatcccagcaatttgggaggccgaggcgggcagatcaccaagtcaggagatggagaccatcctggctaacacgatgaaactctgtctctactaaaaatacaaaaaattagcccagcgtggtggcgggcacctgtagtcccagctactgggggtgctgaggcaggagaatggcatgaatcccgagggcggagcttgcagtgagtcgagatcgcgccactgtactccagcctgggtgacagagcgagactccatctctcaaaaaaaataaaaagaaggttgaatttgcactcttttctggagctgggacatccgtcttctcctaccatcagacattagaactaaagtttcttgggcctttagacttgagggcttacatcagtggcccccaatttctcaaactttcaacttcaaataaagttacatcctcagatcccccaggttcttctttggactcagactggattacatcaaaagctttcctggttcttcagtttgaagacagcatgttgtgggacttctcaacctctataattgtgtgagccaattcccataataaatacatatatgtataaatctatctcttgttgattctgtttccctggagaactctaatacagtcatttaaaggaaaacatcaatataatcaagagagaaatagaagttatctttatgaaagttttagaataaaaaaagtgaaaaaatgtactagattggatttacagtggattagacactgcagaagaaaagatcaatgaatttgaacatagagcattacaaactgtaaaatatactagataaagagaagtaaaatggaattataggtattgctttatggaacaattagctacataacgtatatcaaggtttagtctcagaagatagggatagaacaaaaatattttgaagagtataaaaatatattatctgtattgttgtaaaacttaaccctacagatctccaacgctcaatgaaatataaacagggtaaaaacaaagaaaaatgtgggaagatacaacataaactaattgatgaaaaacaaaaataaaaggagaatcttaaatagttcacttggagttatgtatccagtgaaaatattcttcaaaaaattaaatacatttattcttttaaaaataaagacatttttagctaaaataatttgctgcaggagaaaacaccacaagaaatgttaaggaaaattatttagattgcaggaaatgtaatactgttttaaaactccacaaaaaaagagcaagaaatgtttttttaaaatatatgtgtacatataaagtatatttgctgtttttaatttctaaaattttctatttccacttgttttgtaaagaaaaaatataataatgtgttagagggtttgtaaagtatgtagaaataatgtgtatgaaaagaatggcacaaagggtaggaaggagaaccggtaagcataatattgtcagattcatatcgcaaactttaaaataatcaaacacatagcacaaaaaacaaaaggctgtattaaataaactagtataagactaaaatgaaatactaaaaactaataaaaataagacaagaggaaaaaagatatgaaaactgatgggatagacagaaaatgtatattataatgctagacttaaacccaaccacaggtaattatattaaatgtaaattcacaaactaaaccaaagaaaaacattgtcagactaggttgaaaacaccaaaagcaacggcaacaaaagccagaattgacaaatgggatctaattaaactaaagagcttctgcacagcaaaagaaactaccatcagattgaacaggcaacctacaaaatgggagaaaattttcacaacctactcacctgacaaagggctaatatccagaatctacaatgaactccaacaaatttacaagaaaaatacaaacaaccccatcaaaaagtgggcaaaggacatgaacagacacttctcaaaagaagacatttatgcagccaaaaaacacatgaaaaaatgctcaccatcactggccgtcagagaaatgcaaatcaaaaccacaatgagataccatctcacaccagttagaatggcaatcattaaaaagtcaggaaacaacaggtgctggagaggatgtggagaaacaggaacacttttacactcttagtgggactgtaaactagttcaaccattgtggaagtcagtgtggcgattcctcagggatctagaactagaaataccatttgacccagccatcccattactggctatatacccaaaggactataaatcatgctgctataaagacacatgcacacgtatgtttattgtggcactattcacaatagcaaagaattggaaccaacccaaatgtccaacagtgatagactggattaagaaaatgtggcacatatacaccatggaatacagtgcagccataaaaaatgatgagttcatgtcctttgtagggacatggatgaaattggaaatcatcattctcaataaactatcacaagaacaaaaaaccaaacaccgcatattctcactcataggtgggaattgaacaatgagaacacatggacacaggaaggggaacatcacactctggggactgttgtggggtggggagaggggggagggatagctttaggagatatacctaatgctaaatgacgagttaatgggtgcagcacaccagcatggcacatgtgtacatatgtaactaacctgcacattgtgcacttgtaccctaaaacttaaagtataataataataaaataaaaaaaagaaatgagaaaaaaaagaccttataatatactatctgcaagaaagcaactttaaaaatgattttttatatatgaagatatatatgttaaaagcagaaagattaaaaacgtgtaccatgcaaatactcatcataggaatgttgaagagagtatcttaatatcaaagtataatgtagcacagagtgttgcctaagataaggatgaacattttatgataataaaaagattaacttttcaagaagacattcaaatccaaaatgtatatgcacctagtaacagagctttacaatgtatgaagcaaaagttgacagtacttaacaggaaattgatattttactataatagttggagattttaacactcttctctagtaatttatcaattacaagaacagcaggacagaaaatcagtaaataaccttattctccagtaatttatcaattataagaagaacaagaagacagaaaatcagtaaagtacagaagacatgaacacagctattaaccaacttgacctaattgatatttaaagaactctaccaaccaacagcagaatacacttatctgcacatggaatattcaccaagataaattatgtgttgggccgtaaaacaagtcttacccctaaaaaagactaaaaacgaagagcgtatgctctctaattgcaacaaaattaaattatgtatcaataacaaaagaatactttaaaaatcaccaaatatttagaaattcaaaacacacatctaaataacaaaatgatcaagaggaaatcacaaaagaaagtagaaaatatttttaactgaataataatgaaaacacaacatgtgtgtgatatagttaaagcaatacttaatggtaaatttttgtcatttaaaagggaaaattcaaaatttaatgatctaaacttctaccttaaacaaatggaaaatgaaattaatttaagatgaaagatagtagaagaaaagaaagattaagtagtagatatcagttaaattaaaaatggacagataataaggaaaaagtaaaactcaaatctcatttttagaaaatattaataaaactgatacacatcaaaaacaagagataaaatttaaccaatatcaatcatgaaagaggaaacatcactacgtctctatcctaaaacatttaaagtacaggaaggcaatgttaactgacaacatttaattttacaactaggtcaaataaaaaagctccttaaaataaataattcttataactggcacaagtagaaacagaaaatatgaatttttccatatctatcagtgaaattaaatttgtaattaaaaacccttatactataaaaaattgagtcccagttagtttcgttgatgaattctatcaaacatgtaaagaagaaattatataacgtggccaaccaacttggatttatctcaggaatgtacagtgttttaactattaaaaagcaatttatataattagtcacatgaatgggataaaagaaaataatcttacatcatcttagtaaatacagaaaatgcatataacaaaatccattatacacgatgaaactgtcaaatatgtaggattagagggaaactttctcatctaggaaaaatacacctacaaaaagtcaatattcagcatcgtaatggtaagagactaaaatatttcccctttccttttatcaccacctctgttccacacttaacgggagacctggacagtatagtcaggcattaaaaataataattatggctttgagatggaaaaggaaggaataaacctgcctctgattggaggtggcataaatgtgtatgtgtattttcaagaatctacaacaaaaaccctaaaattaatatttagggataaactaaacaaaatacgcagaagacctgtacactgagaatttgcataacatttatgagagaaataaaagaataccaaaataaggagatataccgtgttcatggaatacaagactcaatagtgttcagaagtcaattctctcacagttgatatatgtattaaatattatccagtcaaaatcctagcctgcttctacttttgtgaaatttagcaagctacttctgaaacttacatgaaattcaaagcatatgaaatagccaaaggtagaaaaagaaacaaacttagaagacttgcactacttaatttaaagatttactcaatatttattctaaaagtaatgataatcaagaaaatgagacattggcataaagataggcttatagattaatgcaacagaagaaagctcagaaatttacctgccttctaaagtccatcaaaaaaatgccactttattcaatagggaaagggtaatattttgaataagtagtgctgaaacaaatggatatcactgttaaataagttgatcctttaaccatatcctgtaccataaacagcaaataaacttaaattggatcatagccctaaatgtaaatctctgtattctgtatagatttctacatacctaaatgtaaatctatgtattttctatgtattctacaaatacatagaacaatatctcactttttactttctggagtcagaaaatacttcttaagacagaaaacgaaaaaccactaagaaaacaataagattaaaagaacttcatcaaaattaaaacctgcttttgtcaaaagacaatggtaagaaaataaaaaggcaagctcagattggaagaaaatatgtgcaatatatatttgataaagaacttgtatccagtatgaactaataattcttacatttaatgctgggaaggaaaaaatgcaacataaaaaatgaaccaaagatttgagtatgcgaatggctaataaaaacatccaaagtagctccaagttgttagtcatcaggcaatataaattgaaaccacactttagtatcactacagtactacaaaaatgactaaaattaaatgattgacaataccaagtattttcaaagatgtagaacaactggaaatttcctacactgttggtagacatgttaaattatacaggtacaatggaaaaatagtctggtaagtacttatacagttgaacatttacttaccgtacattctagaatttctatgctttttacttaccccaaagaattaaaaatgtgtgttcacaaatacttgtataaagttttattcataatagcctaaaactgaaaaccaaatgtccaacagtcagcaggcgtctggataaacaaactgtagcatatccatatatcgatatactcctcggcgattaaaaggaattaactaccgatgtgcacaacaacttaaatgaatcttataaatcttacacagagagacagaagacatactcaaaatactacgtagtgtattattcaatttacataaaagtataaaactggtgaaagtgttcctaaattatggacatcagctcattgattgcctgggacatgggtgaaataattgggaagagatatgaggaagaacttggggtttataaaaaatgttctatatcctaattttcctgattgttctcatggtaaaggcaagggtccaagagtgagagcagcacaaaagaattaaagctacaatatagtggccaaagcaaatcataaggcaagccatactcaaagcatgggttaagagactccattttctaatggtaagatgtgcaaagttacccagtgaaggatgtgaatacaggcagtgatggagaattaagaacagtttttcaattaatctgctatactgaccaaggtcccacattttgcattctttctattttcatttattctcccaacaacctaaccagtattttcctgagctcatgtctttcttctaataattcgatgaatgtagctagtaataatcacacatttttaacgttctgtcttgtaactccttttctaggtttagaagcgtttcagattacctttctaagctctcaaggatgacagttttaccaaatgttttccgctgcatagcatgacacttcatctcctcattctccagtatgcattcgtttccatcttcatcctcactgtcatggaaattccaaatatttactgtgttgttctgtcagttacccgttttcatttttatgtattaagttctatattagtaagataatgctagaaggcataaaaaagaaaccctagaaagtctggagcttagcaaggtatacatttatatctcattcatgtaacatctgacagaatgttattagttagcattggtgaggtaacaattttgtacttttctctacacagtcgtttagaaactcagtcctgctattttcaacttgttacttacaaatttattctgggtattgatatcaaactgcccaacaaaagagtagagagtcatagatttttaaaaacaattcttctatacttgattgccagaaatcatcatagccgtagcctaaaaaaaaaaaaaaaaaaaaaaaggcaaatgtatgtccaggagaccaaaaaaacaaaaaggattttggaaagagatgaggtttccagcctttgctatatacctcatttgtttgtaaaattatactcgtcttttctactattttatgattttgtcattaatttcagtatttatttctaaagtcagaagctcatcgatatcttaaccatcttcctccccaaaatgaaagaacttcaggacacattagcttatgacttcttttttttcattacatgctctttttgatcagtattttagtactgtccctttttatacacacacattatttttattgctgttgctattactattatttgtgttttttcttaccacttcttgcatcttaaactttctttctggagtcattattctccttcttgaagtgtatatcctttagtaatggtttattggtgaaaaacttgttcaatatttgtagatttgatatctttatctcctttttcactcctaaagaaaaatttacaggatacaaaattattagtttataggtgcttttactctcttttccgctatattgaacataattgttccaacatcttttcctgcttccattgctgctgttgaaaagccagtagacatgctaatcattgttattttgtaaattatctgtctccctctctggctacttttaatatatgtcataggtgttctgtggctttagtcatgctttgtatatattgtatttcctgtgcttatggattcatgtccttcattttaggaaaattgtatgctgaatacttttcagatattacatagtcttctctctctctctcttgctctcactctctcttaactctatctctatatctattatcttagattggacttacaccctctagctttatactacatgtctactaactgatgcccatatttatgtattttctgtctcccttcctctcagtgcctcattctgtatatgaagctgtaatctatctatcacttttggaaatattctcttcaactatgtctaatttgatgtataacccagccattgagctttacgtttatgtgattatatttttgtctttaaatgtctattttatttttaatctgaatatttacttttattgtcatatcttccttgatcatttttaacccatgactatttttactccaagttttattgctgtgaacgttcaatatgaagttatgtgctgttctgtattttgtgattctgggataactgaataagaacaatttaataaattggagcaacaaaatcaaaaagtaaaattccactatcaaaatacgcagattaccaaatatagcttttaagtcaaaaattaaatctaaccatttgccatttagaggaaattagattaaaacaaagtgacataccatgaaaaaaaaaagctaaaaataataggataaatagacaatgagcgtgaggttaatggagtgtttcttaaaaggataacttaaagcaaaaattagaaagagggccattgtatttggtaaaggataattacaactctaaaaataataataacttttatgaacaggtattttcagagagaaaattcatcaaaacacaaaataaaacttatataagaagatactggtagtaatgatagtagtgggaaattaacacacctatctcagtctgacagatcagtgaagatgaaaataaagaggacatagagtagtagttttctggggagtgaggggaggagtgagcagactccaggaccctttttcctgcttcaagcagaatactttgcatctattgatatgggttattttagtgtacaaggattccataggaggtaaactgttctgaaattattaaaaacatgaaagcaatatctgaatgacaactaacaaaagctatataaaaactaatttttaaacttttatcataaataaaatatacttttttcccaataacatggaacttgtaccaaaaattaattctgtatgcaaagattctcagcaggttcctgaaagtagaaagtgtatatcactctgtgtatcaatacgtatcatatgtggccatacgtttgatgtcagcataaaagatagtcatatgattttattattaatcatgaataataattatactgatcattcagctcaaaaagttaaagtataataggaattatatataaagtataaatatatacattatatataaagtataagtatatacattataaagtataaatatataaatatatataaagtataagaggaattagtaaatttaaaaacagaaactcatgaattacaacaaaaaagtaataaaaacttaaaatgcttattttagagaccaataaaatagacaaacttctgtcatagtcaatcatttaaaacttattatatctatcatttattgggtgcttacaatatgccatgtattttactaagtaatttataataatttatctcacttaatcttcaaaatagtattttgacaatcattcattcacttatttcataagcatttattaacaatataccaaacatatgaggcactggggacatactgctttaacaaaattccactgccctaaagatatttgcattttggaggaataaacaaatatcttcattttacagatgagaaacaaaatttagagaacttaggcaaatttcccgaggtcaccatagcatctttgtgcccaaatcatattagaacccaggtttctctgaaggtccgtgctcctaaccaatatgtagtgttatttctgtgggggaaaatacagaaaacatatattcataccatataaattataaagaatatgcaaggagcatcattatattattgtaaactagggttttttgcctgctactttgtgccaggctgtttaaatctttcaagattcacaactactctctgacataagtcgtaatatttccaccatacgttacaattgagaaacctaaagaaatgaaatgttaagttacttgtagttgcagagctacctctatacccagtcagtctggctgcagaacctacacttaactactagaatatgtaaccagctgtgattaagactgttttaaactaaacaattacaatttatataacttgctgctaaaacattgaaattatagataaaatagttggttttctagtgaaatgtgaattgccaaagttggcataagcagaaatttaaacaatacaatcaaggaaaacacagtcaaaaaactaactccactgacggtggcagacccaggtaactttgtgagaatcctatcagtatatgaaggcaaatataatttccctacaatttaagttgatacagaatacagaaaataggaatattctggcttgtttaccaagcagtcactcaccattatgctactgcatctgtcaaagttatccataaacaaaccatgaactcaccaacgaataagctcacaaacaaccttaataagctacagacaatctcacctctgaatatatgcaaaaattctaggatctattaaaagaataatatgtcagactcatataaaggatattccaaaatgcaaggttcatcctttctggacattgaatacatgcacctacaccaacaagcaaaaattgccaactccttcatccagcaacttcaattttatgttttattcctaaggaataaagcagaaaggtattcgaagatacgtaaggatgtttatcataatgtcacttataatggagaacattgctatcactccttaggaaaaaataataggaaaacatcttacacttaacggttataatctatggtagactgttacaagagacataagtaagatacacaaagcattttgttatttaaaagaaaaaattctagctggctacacaaattaggactttgctgaagaggaggcatttaggacaggtctcagaggatgagtagcattttagcagatatgattggaaacacagacggatgtgtttctgggtcaggagatccagaaagaagtagtgagaaatcaaactgaaaaagtcgactgggtccaaagcatgaagtgtattaaatataaatagtactaaataaatcagtggaacagaattgagaagcctgaagcagattcacatatgtgggaacaaattatatgacaaaagcaacattttaaatattgtgggacacggagttttacttatttaatgatgctgaaataatcacttacattccctatgtcacatcaataaacaaatatagtccagttgggtgagagatccaaacattttaaaatgatacaaaatgctaccaaatacttcagaaaatacggacaaacttaggtttatagataattttctaaacacacaaaaaatcggaagtcaggaaggaaactatagacgtgttttcttctcgccaaaaatgattataaaattgtattacaggcaccatcataaactaacaatacactggggaagaatagttctatggccctaaaacacaaagaactctaagaaattaacacaaataagcgaataaagcaagcaaaataataaaaaaaacataagcaaacatttcacagaaatgcaaatgcaaatggccaataaaatcatgaaaagatgttcaacctccttagggttcaggaaaatattaagcaataaaataccattttttgccctataaatactaacaaagcttcaagcagattgatcaaatgcgatgctggcaaagatatagggaaacagtatcacatattaccaataggtagggaaactgcttgtatattattgaaaaacaatttggcagtacttattaaaatggaaaatgtgcatgtcctttgatccatcagtcctgcttttgtgaatgactgctacagaaaatagaatagtacgtgaaatatgtgcaaggttatttatagcagcattgatttttaatgattaaaaaaagaaaaatgccgggcatgctggctcatgcctgtaatcccagcactttgggaggcctaggcgggcagatcacttgaagtcaggagttcgaaaacagccttgccgacatgatgaaacaccatctctactaaaaacgcaaaaatgagccgggcatggtggcagcacacctgtaatcccagctacttgggaaactgaggcaggagaattgcttccgagaggtgcaggttgcagtgagctgagatcgtgccactgcactcgagccttggcgaaagagcaagactctgtcccaaaaaatattaaaaaaaaaaaaaaaagaaaaacctccgctgctttcaatgtttacctaaaagggggcagttgattaagctggtacatctatacaatgaaataatttgcaactattaagcagaataagtcaggctaattattgaatatgatcattaaataataaaatagcaaatatacaaaatttatatttaaaaaataacaaaacagaaatattacatgtgtgaacatatgcttcacggagatgaagtgggagattatgtgtaaactgtatttgctatttggccagaaaataagatttgcagtgttggaggcaggacaagttttaatttacttaattcctaaccctttggtttgactcattgcaataagcacatatatgttagtaattttgccaagttactgttgtcatttacaaaaacataacaattttttttcttttttttttttttttaagatggagtttggcttttgttgcccaggctggagtgcagtggcgcgatctcggctcactgcaacctccgctttccggtttcaagcgattctcctgcctcagcctccagaatagctgggattataggcgcccaccaccatgcctggctaatttttgtattttttagtagagatggggtttcaccatgttgcccaggctggtctcgaactcctgacttaaggtgatctgcccgccttggcctcccaaagtgctgggattacaggtgtgagccactgcacctggctaacaatgtttttaaaaataaatcataattggttacaacttatattgtcttttaattgctttcctgaaatatgaaagaaaaggaaattctttttataatctacttcccagacaacccacgtggaaagtgaaatatatcaaccagcacatggtccttaattgtgattacattttattgcactcagcctattaagtgcttaaattaccagataacagaatctatgttcctaacagtggagagtgtattaacagtatttttgttccctatcgtagccccgttccaacaatcacatggatgaaggttaatggttatattcctagtaaggcacgtctgcggaaatctcaggcggtgctggaaataccgaatgtacagctggatgatgcaggcatttatgagtgcagagctgaaaactcacgtggaaaaaattcctttcgtggacaattacaagtatacagtaagtgttttcagcaaagcatgattgctctagtcccaaaagtcaaactgaaagtggaaattaactttaactaaatattgtttgttaggtacataaaaaccaagtaataatttataatcatacttcattcgtatggtaaggcatcatgtcaaattaccctatacatagaaatgatttaaattataaatgaatggggaattatcggtgtctttgtacagcatacagaacttacgtccttaaaaatgagctatttccctggcaccagcactatactctgacaagttaaaaatcttggaaaacttattaacttattctacaacttggccagaatcagaggttccaatctagtgtccatcaacgagatcctgcccaggtgccattttttgtaaatgatgttggaacaaagtcacacccacttgtttacatatcacctgtcagtttttgcctggcaatggcagaattaaatagagacagagaccagctgacttgcaaagactgaaatatttgcttttgagcatttttcagaataagtttgctgacctgtggcctaaattaatacatctgtatgataaatagcccctacagcctgcaagtgtttatattgtccaaaaatgccagtcaaccaggttgtgtctaagaattaggaaaatctcgttcaaaagtttttacaatctcatctttacttctaaagttcaaagttgtttgtacttttcatatttgatttacagtatatatataatgggtaagttagggtattctcattttctaggtgaggacactaaaaagagaagcaataggctagagcattgaaataagcaaatatagatgctttgaatatatagttatccaaatttcatattggctgtttcctccaggaaaccatgactgtccctgtatctcaagatcagttccaaaagcttaatgccctttacaggaactcctaaagagtattttgaaatattaataactgaattcaaccagtctttcttcatctttaacaactcctttaggaatttagcattctaaccaaattgattatgcattgcacattttatccattcattcattgatacagttaatgtttgttaagtgcctcgtactgctctacatgccagcaatagagccttgaagtaactcatgatccactggactagaggaaaagcaaactccacattagagtggagcattctgtgtgcagtgataaaggcatgtgaagaggactgtgggaatgcagagtctactgcattctactcagaggagtcaggaaaagctttagagaggattggtaacttaagagctaaacaggggagagcatctggaagaaaaggacatagacatttaaatgtttctaagattgaaatattagtagtggtttgattgtttttaggccatgaatatttggatgaaatccacaaagtttataactgttcataattcataaaacaaatcattaagacaacgctctctagccatagggaaaagtttttttctgtaccccagtggagcaaagattaatgttaaaatacacgttcattttattctcacaccaacagtttgaagtattaccatccctctgtacagataaaaatctgatactgaaagacaagtgttgaaccggaactttactactgaaaatcacaaataatgtaaagcatgcctgttactctgaaggctatcagaggaaagtacgaattctctgtgttcgaagaatggcccacacctaaatagaattagattgtatgttctagggactgaggctcctacatagcatgactctacttactcctcccttaaccccagctacttaattcataggtaatgatgactgtttccagaaatgtaaaaaaaaaaattgctttcactccttattactggtgtacattctagtgagaaagtgctacttaaacaatctggggtgtcgttgtcatgcactgtaggccatctgggtaaagacaaacctacccaaagcgtgcatcactttgaatagaaaaaaaaaaaaatctagattgttccttagaaagagaaactgggctggctggctacttggcatatatttgtgacaggtgtggaatatatcttgaaagcatgtgaactctttcttcagcccatgtttagggtagctttctaccaggctccatcaggaggccatacaccttgctttgccctagaaaatcccactttacatctgctgccctatgacaattatgaagagtgtcctatttcacttctaaaagtatcttggtaactaggtgtagtggctcagacctgaaaattccaacactttgggaggccatagcagctgaacctgtctctaaaaaaaaaaaaaaaaaaaaaatacaaaaaattatctgagcatggcgttgcactcctgtggtcccaaatactcagaagcctgaggtgggagaatcacctgaacccagaaagtcaacgctgcggtgaaccattatagtgcctctgtattccagcctgggttagaccctgtcttaaaaaatattacaaataaaaaataaaagtatgtcggttatcatgtattcatccaacttttgtacttttaaaactgtcatgttagacatgagggctttcctccccatcaaactctgtaaagtgtagataggattcagtcatttccacctgactggcagtagatatggatagcatgatgaatggatgtttcactgtctcatggtttatatttagaatattctctcaatagaatgaattactgtaggaagctctgtaattgggattctatctgttagaagtacagactacccattttatccaaacagtcagtattcatgtagtactgaaaacaatggtagcacattgtttttgaaagtacaattgcaagaatacttatgcttagctattagtttcaaaaaatgaaccagggatctaaggcagcatttctagtcccttttcttggtcaaagcattataaaagtgctatatagatagtacacataagtttaagctgcagattttactgtttttaattcagtatctacattgtaaacataaaacaacaaatgatacaacatcaagaagtccatggtagttaaattaaagttaagatacacttacatgtctaatataacataaataggtcttaaaagtaatactcataaaaaagaaataaaacttggaaaaattaaaatactaagttttggaaataatttgaaccttagcataaactgcataaatattctatttggtatgcctttcttgataataggattttcatgggttaagtcatttctttggctatttctgtcccctctagtttctgacgattgatgaaaaagacctggttttaactcatcatataaaattttgtttctatagttctaatgcaagttgaactcttgcttggtaaagttctcaattaaaaggaaaagaaataaatgacaaaatgacaaaagaaatgcagaacaaagtaaggagaaaaggggtaactgaagggggaaagatggaggcaggaaggacaaacatcatttaagcagttttataaggagttctcaaaatgggaaatattttatgtacacaaaaatctcattatataaagatgtgtgatctgtgagtttaaatgtgtatcatgtgcgtcaccaactagtaacttgtcactctataaagacggtcactatgacctctagacagtttatatttactatttcaactagaattgtatcagtattaaaatattcctttatccagaacgcttaaaagttagttgtactgtactaaatatccagtaaaggaatacagtttcattttcagtgtagagtggtattatagatttccttatcttcataaaacctctggacagtatcctcacaaatgttaatcgcttctatcgtctgcaatttgattgtaagctctttcaaaatagtctactttttttttcatccagccctgtgaattctgttcagcacacagtggataatttttattatgattctatactgttataaagatgaatgcttaggtatgcacatcattttataatgtccactatgaaaaatagatgagagtcaggaaagactaaggaactaatgaagggaactaataatcaccaagagcttaccttctagacattactacgaggtgctttacatacattaactcacaataacccttaggtcttaagattcccatttgacagacaagaaactagacctcaaaatattaaggaacttattaccccaggacccattaataacaaatagtagaaccagaatccaactgaaactggcagtgacaccaggattcaaatcctacctccacccccaaggatagcatgctacttctcagtgagacactgagaacctgaactaaggcatgagatgagaatggcatcgagagcagataatttctactttctatatactatagttaacattttattaatgttacagaaaactgtatgatatattaaaatccttgccattagtttttgttcttttttcttttcttcaaaatactgtttatgtacgttaggtctgatctttaaagatgttttagctgttaaagtatattaaatatttactctaggaaatgatataaaattgttgattcctggttaataatttcatacctaaagacagttttcaatcctgttttatggagaaaaaattcttgccttgaattctactgttattatgaaagtgatgccatatgtatattcacagttgctagaaaacacatgggcaatggattggggggaaagtaaccaatatatattatcttctatcatcatggtagctcattgaaataggaattactatctacagcttacagctgagactcattacagttaaataactcattctcagcgacataatagagcaagggcatggtagcactagaatttgaacccatattcatccccaactgtataatctctccaatataacacattacctctcattggcctacagctgagagtcataatactgaaagtgatctatgcggataaaatatgttgactcctcaatacataagagtacagaagcaacaaaagaggccaataacacttagcatttatcagtagagagttacagaatttctaatgacaagagataataagcaagagttttctttatgcacatctgcttagcattttataaaatgtaacccagagactgatctgaagctgaaatgtattacataagtacggtgcatctggtgaggctttaacagctcctgggtttaaagtgccatatgtctcttcagttttccacatcctaaaataggtggcttgacaaaagctagattttaaaaagttattaggtttgttttaaatgtggcccaacctgtgatttttctttcccagacagatgaaagactttccataatgcagaccacgtcttggcatctgctcaccccatgttattattcagaagccaaagccaatgccctttagttacttgcagtcctctgccaaaaaaaaaaaaaaaaagtttaaatgtaaccttttatgtttctgattttatgttaccagtaattttgttgtttttgtaagaatcttgcaagtactgtactgtctttttcagattacagcctaagacaaattatttcaggccttaattcagtttttaatgttttattttaaaaattttaccactgccctttcacataatgttttttgcctcggaccatatagtatagacctagtggtttataaaatatcttgcaatgtaaacaagaaatctgttgtagaagtcaagctgatctagtattgaacataacctacattttccatgtattttgtgaaggatagccattcataaattcccatagccttaatgttaattaatgtttattcaattatgacattaaatttatttttctaatgtagagcttaacttcattgtaacacaatctacaacccaaattccacttgtgtgtgtgtctgtgtgcatgtttgtgtgtgtatgtttatgcgtttgtgtgcttgtgtatgtatttgtttggacttgcttgaaagcttttatatcaagtcaattaacaagcaggctatatatactaactgcatatggcatcttaagcagccaagtgacatcaccaagttatgccatttcaggattttttttttttttgctattatgcaacatagagataaagctacagaagtatagctcttacacataacaacatagtttggtacaaaagattcacacacaaggtacagtgttcaaagcaacaaaatatgaaatgacatctgtcttttatctgccaataattgacatactgatagcattttttcaattttgagggcagtgtaacaggccacttttacttgtagaattcttggtagaatgaatttgaataacattttaatggcctttcacccactagagtttgagcttacagcaaacagatatgatagcacatttatgttcgtatcttcagagtaagcattttacctataatggtatccaaaaaaaaaatctaaagaaaggaaggaaaaaattaattcatatttgtattaatgtcattaatcatatgtttgattcctatgaaaaatttgttttggaatcaggactctaaattttttcttccaatttctaatggattgttttctcagatgtcaaatctgtttttatttaaatattttaactgttctttctttcctagctcttcatttctgtaacttttaaaaatctcttttgaagttattttaaaggctacagtcatggtacatttagagatagatcaataagtctaacaaatacaatcagttattataggtaggacactgtttcgcctaacattaagtttagaatcatctctactcttaatgatctcactgtctagctgagtgtcaaattctaaccaactaaaatattaaataacaatttaagtcagcaacagaagagaggtaacaagctacgacatgaatattttccaaacgaataagaactacaggtgtccagaggaggtgcacatgactcttctttgaggctgtgattaatacctcttacttaatttagaataaacactgaatcgtgagtagaattaaaagagacagaatagaagtagaacactctatgtagagtgaacagtttaaataaaatacagtgtgtgcttgggagataacacaccagtttatctggcttacaggagtcatgcatagtgtaaagtatcctggcagattagtaaagtttacagaaaagccagatgtaaaagtagagtttaatattgtttgtgtatctcatcactcctatcagcattttagcatatatgacacataactacaaagagatgatttccgaaggcaggtacaaaaatcatgatgaatatttgaaactcactatggtaaagatttttgaatgatagcttgcaggcttagaagctgaatcacagaatgtattccaaggtctacaaatcctgactatgctatgccaaagtggggcttctaaagtctagactatattggccagaagaccagtaagctaataaaagcaaaattccctcttagaaacaagtaactaactttgtgaccttgggtaaatttctttaacctctttgagtcaaaatctgattcataaaataggacatgtttgtttgaaggatgaatgttacagggattaattgagaatttggctcagtgtctaggacatggtaatgactagcactagcatttaataaatgtgagttctttcttgctctttctcctccctgctaaactggctttggtttcggacatctgctactccgttatacccactattctgacatgcatgtgtagttttctttattttttatttttcttttttgagacaggttctcactctgtcacccaaagtggaatgcaatagcatgatcacggctcagtgcagcttcaacctcccatgatcaaacagtcctcctgcctcaaccttccaagtggctggaccgataggcatgtgccaccacacctgaataatttttttttttttatttttagtagagacaaggtctcaccatgttgcccgagctgggaactcccaggctaaagtaatccctctgccttggcctctcaaattcctgatatgacaagcatgagcaccgtcccaggtccaacgtgcagttgtttaatacatcttttttcacatgctctcctcttccttggcagtgacattagaccacctctaccgcagcaaaaactcttttagagccgctctgtttctgtattcttaatagcctctaagatcgaacaagaactatgtagcatatatgaaacaacatataaatgaatgaatgatcaaagccctcagtagcacatataaatattttacagtttttgccaaaaatgttgttagaaataataaattcagtgcaatatttttatacgtatttctttgactgttttaaacagaatatttgtaaagaaagagtcagctttattcaacatttttccttaaaaattggccaatagtggaaatgaactttaacttgtatcttaagatttcatataattacaacagtatctcattcttaataaaataaattttcctctgtaacaattttgcacaaataaaaaaattatattgcaagaatgtaaattaagaaaaattttacagtgaaatctggattcacaaatcatttttccaaagtcattcaggtgttatatatatacacagagagatagaaacaagttgagtagatacactgtatatttctacccgtgctaatgctgccccactacattgaaagagcaattgactctagtacctgacttcctattaaactggttcaggtgccttggggataactaaaccacttaaagtccaaaaaaaaaaaaaaaagaagaagaagattttgcatagttaaaatagcattttatattatcaaaatatcttcactgctattttttgggggtacaggaaatagaattttgtgtgtaacgcaatgctgtgcttcttcaaaatacctatggttgaatgaattgcttttaaaaaaatacgttgaatttttccatgtaaattttaaacttggtaaagcgtttgagaaatgaaatcatccttgtttactgcttacatacttacagcctacccacactgggtagaaaaactgaatgatactcagttagacagtgggagccctctccgatgggaatgtaaggctactggaaaacccagacccacgtatcgttggctgaagaatggagtacccctctcacctcaggtactgttgggagttattaacctgttctgctgtaattttagcgagatttcacacaggacaaactaggcttctttagtcttattgaaagccttttcctgtttctgattcgtataataggacatgtttgtgttaaggatgaatgttacggggattaactgagaatttaactcaatgtctgggatatagtagtcatatattttaatatattttgagtgagaaacataacaaatatgtaagcattttaaaattttaattacctcattacattttttggtaatacagtgtttctttaaactgttttcaatcctataaatttttatgaaactatcaatattatcatagatttatttccatttgtagctaacctttagatatcacctaaaattgctcggtatcttcgttgatagacaaagcactgccaactaagagttttttttttaatgatttgcttggcattaagtagacaagacatttggaggtttaacaacatttaaaatttaaatttgtttttgaaatatgctcttgacttgaggttaccttaatttgcacatgctcaattttttgttttttatactatcttatgatactgaagtatattgtctgaccaataattttatctagaatcgagtcacaaggcagttttctatctgtgttagttttttgggaagtgagtgaaaatggcaaactcctgattggatccatatagtaaagggattgttcttatgacctgggctatttttaaccttgatctcatgtgtctacaacctcagtcttttctactatatgaatccttctttccctttgtaaacggaatgcaaataaaagcatcacctgctgattatatttcacaagctcaactagtgtaccaaaaaagacacctcactttaaaaaccaaactgaaagtaaaacttgtcagaataactacaaaaaaattgtaatttctttttcaaccaataaataactataatttacaagtggcatgttataataaaataatgaacagtacatttacattgctaagtggccaaataatgtttaactgtattaattgcaaacttgttttttcttagtctaggagagaatacccataaaatccatgttatttgtttactttctagatctaatttttttaattccattacagagtagggttgagatggttaatggagtattgatgatccacaatgtgaatcaatcagatgctggaatgtatcagtgtttggctgaaaataagtatggagccatttacgctagtgctgagctgaagattctaggtatgcagtttctaagtgaataaattgaaaaaaaaaaccttgcttcttttcatgctctaatttttactatactgaaggtttatgatgtggttgtaaaaatctattttatggcttgaaaagaaatactatgtcttgctgattttttttaactttagtagacaggtttatgttgtgtatagttcgtcccataactttttgttcatatagtttttctaactttagttttaatcttaaaaggtttacacaatacgtctttgctatagcacttaaaaaaatcatataaagaaatacatgttaacttccaaggaagaatgccttgagggtaggagatcagaatatagaattccagcagcctgtccatgctcccatagcaatgcttaataatttcccaggcagttcctatcagtagctgtgtggctcctgcaaagcaagactccaggctaaatcactctctcctcatggggcatcaactaataccttccttacttaacagggaaaggcttcctgatgccaggcactacaatctcatagggttacacccttgataagaatgtaacccaggcactgcatttcttcactatttaaatactacaggaaacaatccatccagtgaaatagactacccagaaaaagcatatatgagccattggaatgaattttacttttcccactttgattttttcctaaactggttcagggatgtttgtaatgtaaagaaagatactcactcattgtctttccaaagcgggcagaagcccaagtgtgttttctattccccatttaaatttaaattctcaaagcataacttaagagaaacaccaaagatctcaggaatcttggagcccaccatttacatatcagctaaatgtaatacatcctaaagtgatttgttgaattatgaatatttgcagttgaaatttctccacattacaacaaatccatccaaaatagttacaggattcttcctttcaatctccttcattctaaacaatcaaatgttaatgaactttcttgtcaactcacagtataatagcactgaattaaaaggctgattcacccttcacctagttagtagccctgaaacatttctcaaacccttatcattcacaagaaatattttcaaaattactttttgtaaattctattcccaggaggcaaaaaaaaaaaaaaaaaaaaagttacttgcaactatctcctcataaatttctttagctttttaactttttttctttgagacaaaatctcactgtcgctcaggctggagtgcagtgatgccatctctgctcactgcaacctccgcctccagggttcaagcgattctcttgcctcagcgtcccaagtagctgagactacaggcacccacagccacacccagctgatttttgcattttcagtagagatggggtttcaccgtgttggccaggcttgtcttgtactcctaacctcaagtgatctgcccacctcagcctcccaaagtgctaggattacagatataagccaccaggcctggctaatttctttggttttaaaaaatctcttaacctatctcaattctatacatatctttttcaatgttgtgacatgcattatgttgctatatgatatattttatatatataatatgaaatacatataatatcagattggtaaaagtaaatgtcacagatactgtggacttgtagacatctttcaggttctcttttagattcaaaagtgttttgatctaaattatagtatacacagtatttatgaatgaatgatcaaacctaagtgaaaaattacaagtaaaattgctaattgaaattcaaataattcaattttaaaaattaatttttaaacaatgtattatataaaacatttaatgttttataatattaaagtaatatacagaataaattaagattcgtagatgggaaatggaagacacaggattgtctttttcgcaggtcacctccatcttaccaaaggaaggtcaaatggactctgtcagttagccttttgctcttttgccaaggtcattcactagtctttcataattgaagttggtaatcataattagaacatgtcattttttgaaatagcctttacctgtagatcccatattgtatgaaatcacctgctaatgtactaaggtacatattaattaataataagtaaaattttgagctactgcctttttcatgtgtagatatactatgattttatgagaaatgcctcccagaagaaaaagttacaagatcttcatgaatcacccattagagattattgtcattgcttctggtagaaactaacatttgcttttttaatagcttcagctcccacttttgcactgaatcaactgaagaaaacaataattgttaccaaagaccaagaagttgtcatagagtgcaaaccccaaggctctccaaaaccaaccatctcttggaagaaaggagacagagcagttagagaaaacaaaaggttagaatctattttataattcaagttcaacattagacttttttgaggttacaggtgacacacacaaactatgcaagaaagagtcttgcagtaccgtgagacgtattttatgaactgattgaaacatggttttgcctatatagtgattttaaaagaacccaaagtttgacttcaaaatggtcagtcttctttgactccatggggttttagcataagttggatatttcactaggttttgaagaaagtactctttaattaaactaattatttttgtttgtttttcatcttgcttctgcatttaggaggtctacaaatcatctgtgataatttttaagcattgtgttttaatttgattttaatacaaatgataaaaacatatgtgaatcttctggataatcatgacagaatactttcatgtgatatttatgccaatgcttgtctttttatccaggtcatatttaggcaaaatagtataggattatttttagtgccataggcaaatgagaagtgagcagaggaatatttaatatgtaaacatttgtctttggcaactaaagccaaaggatatcacaggagtacaaatggagaaaaaatcatgagggaatcaaatcatcacatggcaatctatttgtaccaaattcaaatgttccatgtcctactattattgatatattggtattacaaatggtgattcaactttgacaaaatagtatcctctattatgtcaaaataatattgtactgtattagattttgtttaattgatctagaagtataaggagtttatgacttgttttatgtttgtcccaatctacataaaatataattaaaataatttaagtctgcattagcggttcacttgaataatttcttaagtaacagtgaaacattttgaaaaatttttaaaaatagagtatttttgttttccatcaaatctgagggacactgatttaaatagtctatttcagattaaacaatttttggaattactggcttcagcttagacccaaagatctatgcttcttggaaagggtgatcacctgggattgggatgggtcgtcgttggcactcttacaccaaaagacctatcataagggtcaaggctgtcattcaaaacaaaagacaggctaacaagagaaaaacataacacatttatttaatcaaagttttgtgtgacacaggggccttcagaaatgaagacccaaagacttagagaaaactctttttatgcttaggttcagtgaagaatagagagccgtgtagaaatatgattggacaaaaagtatgtgatctaatggttatagactgagaggggaaatccaccaaggcctatgtgttcagattcttcttggccattttgtgtggtattcctttcctccaggtgtaggacaaatcacctgtcacatgagacaattcaagggagaagggagaaggtcaatctttctaggttttatagtttgctttgacgaagggaagttatagtttctatgatctgccttgggggagagaattctggtttctatcattctcttcagtagagaaagaggagtttgaaacggacagatgggagaagatcaaaaatatcctgcttccaaggtcctttcagtcttcttcaggtcaaggtactctgtgccatattctggggtatcatgttctgagccccaacatcgtacaacttgttttaaaaagaatttctcattcttaggttggggggcgggtagcaaatgacaaattgtgagatcattgttgcctatgacagaattgatcagatagtgattgaatattagtggatttttgctcacaacactatgatttttaaaaaactgcacaaacctaattaaagtagaagaaaattgttttgttgcatagtaagaacaaataatttacactgctaggttattttttctggacgtattaaaaagcttacagtgtcattaaaatatatatgccttatctacgcaaaacattctatctgaaatgcatgactttgttttatgtttctgggtggcatgtgagttttgtcctatttatttcagttcacaataagaatgttcttcatcaactgttgaaaaatgacacatggtgagtttaaaaaattagggtggaacctcttttaccaaagcaaaagtattgagagaagtaacaggattatgagtattctattacaacaacataagcttactaaattttttatttttcagatgttgaaaaatacagtttgtgaatttttcaactttcttgtttctcttcctttctttactgctaacccttggggttagtgagaaagatacattgacctgaaactcagatcactcaattttttctagatgtcaatacttccagtcaaagtgttgtttaggaagaaggctaaaatgtaatttttttttttaatttattcaagtaaaagcaaggctcagccacatttccttagcattctgcctaccttgatctacatgttttaggtcaataaactggctttattgaataacaaagcccagacatatattgcatttttattcttaatattgacaggcacacttacaaaataccatttttattattgaatgacttgttaccatatctggcagccctaggttttaagaagaaaaatgtagttcactacaaaaaataataacacttaatattaaataagaggctaagatttcaacagcaataggcagaattccataatataagaagacacatagttgaaaaattgtacattctaaaattatgactagaaacttaacaatgtcaaatgcctatattttacattctttaaaagaagtctcagttacaatgacaacttattttcttgaggaaattttagattgcttttctgttataatgcacaccaaccatttgattacagctctaaatataaatttaaatggaaacagaggtgttagaaaactgttaagacttcaaaaagtttgtgtcattttttaatttataacttacattgggtgtggagattcaaatcatggcttattttattggaatataaatataaatatcactcatatgatctacatcaaatatgtgccccactcatccaacctacaacaattgagacaaaaatgttgaatgagttagtgttgtccttcaataaaaattttgttgttttgggttcattccaaagaactattgaaacagcaaatggcagtttctgtataagaaataaataataatattatattggggaaaaggaattaacataatagtatattatgaaagagacattcaggccaggtacagttctcatgcctataatcccagcactttggggggccaagatgcgaggatcacttgagcccaggagtttgagaccagcctgtgcaacacagcaagactcctatctctacaaaaaataaaaaagaagaaaaaacaacttaaataaatagtcaggcatggtggtgtacgcctatagtcccagctactcaagaggctgaggtgggaggatgggttgagcctgggtggtttagctgagccataatcataccactgagctccagcctggatgacagagcaaaaccctgtctcaaaaatataataaaataagatcaaaaagaaatatttaaaaaaacaaaatacgtcaattgctttcatagcataaaattatgtccagagcaatggcataaaaatgtaatatatagtcttaattgcaggaaaatataatctaatcatctgaaaatatgtcagaaaatctcaaaggtaaatttaatttagcattacttaaatttaactctaaattgtaaataaaatgattgaaaatgatagaacaactgaaggttatagttcgtcatttgtcaacagagtgccaaataaccatttggctcatttttttctaccacgttttgagtaaatctgccaggtttagttttctttgttttcttgaaggtcagtgtcttcaaaacacagtattttttatgtgtatatattttgctaaggaaatttagaaatcattattctaaagttgaaaatttgataactagaaaataatatgacttttagaaaaaaatatgattaacaaattagctgcctgcttatatattaccaaacatttcattcatttggccctaaatgatacaactaaaatatacaagaaaatggattacatcagagctaagatttgtttacatttgtttgttatttatatcacagaatgatcaatatgaactcccttcagatagtaaatcacattattactaataatgatgatgactgcttatgagttcgtagcgtttatgatttgcaaagcactttaacgttgttggtaaaagtataaaccagtgtatgaaaagaggacttacttgctctgcttatcctgcagattatgaggtttcagtaagttacctaatttattatcttactaaattaaaagagtaagctgattgggttgtgagaattaaatgaaattttacatgtaaaatatattgcctagtgtatgacatctactcagtactcagtgaatgttatgtataatgataatgatactgatgacgatgatgatggtggtggtggtggtaatggtgatagtgataatgatggtatctgtatcaagccattttcctactcctataaagtactgcccaagactgggtaatttataaaggaaagaggtttgattgactcacagttcagcatggctggggaggcctcaggaaacgtacaatcatggcgtaaggcaaagcaggtgcaaggaaccttcttcacaaggaggcaggaaggagaagtgccaaggaaagggggaagagtgccttataaaaccatcagatctatgagaactcattccctatcacgagaacagcgtgcggaataccactcccgtgattcagttacctctacctgatctctcccttgacatatagggattatggggattataattcaagatgagatttgggtggggacacaaagcctaaccgtattaatataatttgtacctttgaatcttagaatactggcatccatttctgttatcagtagtctggaaatgcttaccattctcctttctttctccagtcattaaggaaaagaatacctaagatttgtttccaaggactaaaggagtcttttacatcttttatgtcataaatttgttattcatcaatctatgtccgcaaatcactattctttgttcatcagagccccaaacctgtcgtcatttattcctggcattgaaaatctcatctcccttacctatttctagctcaatgtctttggaataggttcctgtcctagccgaccaaatatttacttgttccattaacattttataggccatgtgcaaatagacaaatagacatggggagttaatggaaatagaaatgaagtattttaaagactttttttttcactgtttttctttaagggctctccaggttttccccccatcactttcacttttgaagattactggcacacagtcacttaggttcctgtatcaatcatttcccttttcatactgaaactaataaactccagaagtactagtaagtaaaatattccacagggattttctcctctagcagaccttcattcagaatgttctgctcatcaaactcatattggattttcactccagctcattatttccattacttggccattaacttttgttaaaatataatcatccagaagcactccagcagtgcacaaatattaagtcttcattattacatgttcaatttcctgtactttttgtggacaaagacaatcttagctaaaatgaagaatacatagtttttgataaaggtatagtttattttgtttcctttccataagtgcatatataaactgttgttgaacctcatagaatgtcatatatgtttaaaattattcacaattattgaaatttcaacatattttaagcactagtttttatgcccaggcagagtaaggtaacagttatgaagataatggactataattcaaactggtgcttaagaaatcctgcatacaaaaaaaataaaattatcctatggaggtgcagtattatagaataatttttcttttatgggactgtaatctaagcaaagacttgtccaaaatctgacataatggccccctgctcactaaaggagcttcagaaaggcaaaattttcaacttatttaacacgcatagaaaattgcactagaaatacccattatttgacttctagtgggaattcatgttgtgtttattaggcaacaatgatgaagctcacatactgactcagagacatatgggaaaatctgttcttaacaaaagccctaaaggacactgttgctgagaagaaagcaaggtcttcttattttatctatggaagaagaattcatgggtataattagggccctgtttttgtccctttgtttccacctacatgctgggtttgctaatgaacaagctgttttgttgtttcctctgtgacagtgtcttttacatattaagaacgtaaaacaatataaactttaagtatctgggttttccttagtgtgtaagaaattgtataatgaaagaaaattagcattcataaatcaagaatgtacaatttgaatttatatgtgaattaatatctatgttttcaaaagaaataaaatgattaaatggcattgtttacctaaaggaagaaaggtttatatctgaatttataagatttagtaactataaactgcttactatataagatgccttagtactcagggatggtttcttgctgtttcctatccatgaacttaaggggatgagaaggaaatggccttacattcattatgatgagattaagatactgacttcctgatttcagtgaaagctaactgcacaagactctgcctgagtcaccttcttcatcttttccttagaatgctaattttttattagaaaaaattttaaaatataaagcattagcattttattatattttattagaaaaatataaaaggaaagaaaacacagtcatagcagcattggaaattaagaatatatagcattggaaattaagaattgttgacttctgggaggaatcaccgtttcatatagaaatgagctaaattaagaatttatcaatgagttgttgaaagctagacctctgaaactttaatgaagtcaattaagaaaccagcagaggaaaaattttactcacttctactttatgtccatatctactaaattcagaaattgcatcttactacagaagctggcttgaacctccctcccacctgcaaggtggtaagatgctatgtccgtattccaccccatctgaactaatccaacactttttggacattatgaatccagcaatggggtgagagaggacataaatcttaggatttcaagtgattagcaaataaagcataatgtcaacaaatggtgatactgaggaaaaattgaaattcatggattctggaaattatgtaattccgtgtactacttctagcaaaagaaggactatataccgtttctaatttttcaggagtaaatttacctctagatacgactaaggactagaaaatggaaattgacaaacatctcacctcagtccagttgagcttcattatagccttagtagaccttgagcgtttgactacagctgtgtacctaactgaccttgagattaatatttggggaacagattctggagcactgagagaaaaaagagacaaataaaactgaaaatattgccaattggcaaaaataggcctatagacataggagtacaagagagtttaaagcacaaacacacattaagcatgacagttaactgatagtcataaatttggtaacaagatgtcaagcaaatataaaaagaatcatcatcatgcttaagtacaatacaaaaaaattgtgtgtgtatgggtgtgtgtacaaataagttaataaatatcaggagttgcaaagcaaaaagctgaaagcattctaaatcatggtggcaacgcaagtaaatatagtcatagtccatataggaaaaattaaagatttacaaaaaacagatatattgtagaagcattgtaggtttgcttttattgagatagggtctcacaatgtcacccaagctggagtgcagtggcacatacacagctcactgcaacctcgaccttccagggtcaagcatttgtcccacctcagcctctcgagtagctgggaccacaagagcacactgtcaccaccatgcctggaaaatttttttaatttgttttggtagagatggggtctcaccatgttgcccaagcttgtcttgaattcatgggcttaagcactcctcccagcttgacctcccaaattgctaagattatacgtgtgagccactctgcccagcccactgtgggcttttttaattacatttttgatgagtacttaaggacaatgataaaataatggtatattatcagtggaagaaatcattgaacacggtagaaatttcatttgaagagaaaatgtctgcatggacacaaatacattaaaaatactggaaataaatgcagctaattgttcacaggttatctctgagaagaggattatagataattttcaacgccactttatgcatttctcttttgcatcactgtgaggaaatacctgaggcatggtaatttataaagaaaaagaggtttaattggctcacagttctacaggccatacaggaagtgggatgccagcatctccttcaagtgaggacctcaggaaactaacaagcaaagtagaaggtgaagcagaagcaggcacctcacatggccagagtgggagcaaaagagataagaaggctgggtgcagtggttcacaccggtaatcccagcattttgggaggctgaggcaggcggatcacctgaggtcaggagttcgagaccagcctggataacatggtgaaacactgtttctactaaaaatacaaaaaattagctgggcgtggtggtgcattcctgtaatcccagctactcgggaggatgaggcaggagaatcacttgaacccaggaggcagaggttgcagtaagctgatattgtaccactgtactccagcttgggcaatgagagcaaaactctgtctcaaaaaaaaaaaaaaagagagatgggaagaggtcccagagtattttaaacaaccacatatttagtgaactgagcaagaactcacttatcatcaggggatgatgctataccattcacaagggatctgcatctgtgatctaatcacttcctaccaggccccatctccaacactgggaatctgatttcaacatagggtttggaggggacaaacatgtaaaccgtactatccatatttctaagcttggtctctttaagagaattaataacccaaaataatgcaaatttattgaataacagtgtactcacactctgccaaatagttgaatgagaatgggaaaaaaattctcacattttcaaataattccattttcaacagtatgtttacatagtataacgatgatcacaaatatctaaattaatggcatccacttaaacacagaagatcagaagataaacacttcaggaactctcaaaatatcagttcctaatattttccaaatttagggtgatggaaaacctaaacactcctctttaaagtccttcaaatattttctttttcttgaccactccaccagtttgtttctagatttcacttttttcttaattgttgaatataataaaataagtctcaactcccaacgagagataacactgagaaactcagttaatttaagctgtaaatgacaacagaacaagtctggtttgttgtactatgagcacctccagtttttgactttacatgttacatctctagctaattaccagtttaggaaacagtttatgaattctacttctaaccatggttcatttaccccagttactataaattgcttcacaagttgcctggttgtgctctccacataagcacaacttgaacaagccattaattgctcacaggtttttcttttccaaaagccccccagactacaactttcagcttaatttgtccttaatacaaacagcatctaaaatacttgggaattcaagcatctaagtatatgctcctaactgattcgactacctccccaagtgactcttcagtgaatataaaatggtgaggagagaagattctgaggctgcttagaaaaaaagcattgtacggtcgagatttttagcatcctctgagaattacatagtcacttcttttcagattttgcataaatcacgatgtaatttaactttggttaatttataatgagaattagaggtttggttacaaattaaagcatagtacaatgataaccttgactacaaatggaaagaaactgtacatcatttccatgaaatataacatatacagatgttatcatttgcatgcttacatctctgtgttccaatgacagtgtggtttctgaaaaaaaaagaggtaggtaggtaggtaagtagggagatagattgatagttaataaaatacctatacattttaagatgattactatgttattagttaatagctggagttttcaagataccaatatgattttgttcctctttctttccagttgcaaatggtagctctacttctccttttccttaatggagagagaaaacctttctttctctaccctctgaaggttcagtaactgagtctatgaaatataaaccgacagtagacagattaataagacaaaatgcatacaaattgattgtgtgcacaggggcatcacagaaagaaaagtgagtacccagtaacccaatgaagtttagaagcttatatatccttttcatagaagagaggggtggtgggatataggccacttaagggggagtaaataattttggggagagaatgaataggcccaaagagcacgtggtaaccagtgagaaattctgtctgggtgtggcgctaacttccggtctttttttctgggatatgtgtcaatttctcacaatgatgagtttcctggggaggagatccaggatgaattgaattttttctggagtatctggtatcaaaacaataagaaaaattcagagaaaacctctgcctgctgctgctggtccccaggtgccttcaatttaaagtaatcagcacaacaaaacttcatattttgggataacattcccaaaactccttcaccctcatgcagcagacacatggtctatgaacagttatattcaattcaatttatttccataaaaactaaactttcttcaacatatactgtatataagacactatgccagttcataccaagataagtaagagagaatcccatctcccaaggaggcacctgtctggtggaaaataaaactaatatagacacctataaaataggataaactaaggtaataataaaaataggactgactgagcattgggtatttttatattgcattactttattaaagtcctcaaaataagatacgattttaaataatataatcctgattataaataattaaatcatagagagactgcctaagcacacacactcgtaacaagtaacagagccaaaatgagagcgtcctaattctgtttgaatctaaaacctgttctcagtctactgtaccatacaaaaaactttgagagttaagaaagaagaaaataaaatctagataaaagataagcttcctgggggaactgccattgaagtggtcttggaataggattttaacacagagggacagagtatattttaggaagagacttcagaatttgcaaaaatagttatgaattcaggacacttttgggaaagtaaatactaatatttgtccagggtatagactatgtatcaaaatgaaaaatctgctgaaacaattgaatagctgaagacaaataaagaagaacttgaatgcacagattgagttcaagcttaacttagtagccaagaggtagtctttgaaagactcagttcacatctttttgaattaatatcttttatttaattttttaaattatatttattttatagaaaaatgcccactaattactctgtctaccaaagagaaaagaattaaagttacgacttaaatataaaatatataaataaatattacttaaatatccttgtttcaacaacgagctagcaagaagctagaaggaaacttctggtatcaaaacaataaaaaaaaagaaaaatttttagtgcaaccagtaaaagcattgaaataaggtatgctatttccaaactagttaaaaaaataaatataatgaaaagttaaccaatcaaaaaacagagggatatatgtacatataccaataaaaaaacagagggatatatatatccatatatatgtatgtgtgtgtgtatatatatatgagataatagaaagcataaaataattcagaaaaaccaaatatatcagaaattactgtaaataccgaactagaaataaaaattcagcaattatatgtaagagctttgttttaagcaaaaataaatagcaaagttgaaagttaataatgggaaaaaatgaatcatataatattaaccccccaaaacttgtttaactatatcaatacaagaaaaacagactatacaagaaggaatataaaaatagtataaaatttccccactatcagagtggggaatctcaaatatattccttgtatttcagaatataagggaaaatttatcgctctatgtatttatgttacaaaagaggggagttgaaaatgaatgagctgagcttctatcttaagaaattaggaaacgaacatgaaactaaaagtaaatgcaagaaaataataaattcaaaaataattcaattacaaacaaatataagcacaattagaagattggtaaagtcaaatattgatactttcagaggaccaagaaaatgaacatatctgtagtaatcctaaaatcaagaaaagagctacaaaatactgagagcaaaaatgaaaaataagcacagatgccataaacagataaaaagaaaataaaaacatgataaataattaaatgacaaaaaattggatcatttgattaaatgaataaaaaatgatatttcaaattgactcaagaagaattgaaaaatttaaataatttcataactattaaattagtagttaaaaaatcttcaaacatacaccaaaaaactcaaggtgtaaatgctttcagtagaaatttctaccaaaaaaaataagaacaaatgatcccaattgtacacagttatttcacagtatagaaaagagggaaaataaccctaacaacaaaatttgccaaagacaatatgagaagtaaaaacacaagccaatcaccctcatgaacatagatgacattatataatgataaagggttcaattcaacaagaagacttaactatcctaaatatacattcacccaatactagagaacccaaattcataaagcaaatacttctagacctgcaaaaagacttagccacacaacagtagtgggggaactcaacatcctacttagagcattagacagatcatcaaatcagaaaactaatttaaaaattctggacttaacttgaccaactggacttaatagaaatctacagaatactctacccattgaccacacaatatacattcttgtcatctgcacatgaaacacacttccaagatctaccacatgcttggccataaagcaagtcttaataaactaaaaaaatagaaatcataccaagaacagtggaataaaaatagaaattaataccaagaagacctctcaaaattactcaattacatggaaatttaacaacttgctcctgaatgacttttgagtaaaacaataaaattaaggcagaaataaaaaaaaaaattctttgaaataaatgaagagacacaacacaccaaaatctctaagatgcaaataagcacaatcagaaatgacaaagatgacattatcaccaatcacacagacatacataaaatcctcagagactattatgaacacctctatacacacaaaccagaatatcaagaaaaaatggataaatttctgaaaagcagtgttaagagggaagtttacagcactaaatgcctaccttgaaacatgagaaacatctctaacaatctaacatcatacctagaggaactagataaataaaaacaaactaaacccaaagctagcagaagaaaagatataactaaaattagagcagagctgaataaaatactgagaaacaaaagttcatgcaaagaatcaatgaaaccaaatttggttctttaaaaggataagcaaaattgacagactgctagctaaattaacaaagaaaatgagaggacatccaaataagcacaataagaaatgacaaaggtcacattacaaccaatcccacagaaatacataagatcctcagagactattatgaacacctctatgcacacaaatcagaatatctagatgaaatgcataaatttatgaaaacacacattctcccaagattgaatcaggaagaaattaaaagcctgaacagaccagtatccagttccaaaatgcaatcagtaataaaaacctaccaaccaaaaaacactgaggaccagattagttcactgacaaattctaccaaacatacaagaaagagctgatatcaattctactgaaatgattccaaaaagacaaagaggaggggctcctccctaagtgactctatgaagccagcatcactccaatatcaaaacctggcaaagatacaacaaaaaagaaagctacaggccaatatccccaattaaaaaaacaaaacattctctaaatatactagcaaacctaatctaaaggcacgtcaaaaagccaattgaccctgattaggtaggttttatttctgggatgaaaggttggttcaacatatgcaaatcaataaatgtgattcatatgtttgttgaacacatgtatgtcttcttttgagaagtgtctgttcatgtcctttgcccactttttaatggggttgtttgtttttttcttgtaaatttatttaaactccttgtagattctggatgttagacctttatcagataggcagattgcaaaaatttcctcccattctgtacatgcagccaacaaacatatgcaaaaaagctcaacatcaccgatcattatagaaaggcaaattaaaaccacgatgagatatcatctcatgccagttagaatggttattattaaaaagttataaaacaatggatgcttgttgggctgtggagaaatggaaacacttttacactcttggtgagaatgtaaattagttcaaccattgagtaagacagtgtggccattcctcaaagacctacaaccaaaaataccatttgacctagcaatcccattactgggtgaatacccaaaggaatacaaattattctattataaagatatgttccttgcaacactattcacaatagcaaatacatggaatcaaaccaaatgcccttcattgatagactggataaagaaaacatggtacatatacgtcatggaatactatgaagccatagaaagggacaagatcatgtcctttgcagggacgttgatggagctggaagccattatcctcagcaaactaatgcaggaacagaaaaccaaacaccacatgttctcacttataagtgggagctgaacatgaaaacagatgaacacagggaggggaacaccatacactggagtgggttggggagtagaggggagggagagaattgggaaaagtagctaatgcatgctgggtttaatacctaggtgatgggttgacaggtgcagcaaaccaccatggcagacgtttacctatgtaacaagcctgcacatcctgaacatgtatcccagaactttaaattacacttttaaaatatgtgattcaccacaaaaacagaattaaaaacaaaaaccatatgatcttctcaatagatagagaaaaactttcaataaaatccaacattttatgataaaatccctcaagaaattaggcattgaaagaacatatctcaaaacaataagagccatctgtgacaaacccacaaccaacatcatactgaatgggcaaacaatggaagcattcaccttgagaactagagaaagacaaggatgcccaatatcagcactcctcttcaaccagttagaatggttatctttaaaaacagcagtgaaacctgatcaatttgttattttctttttccctctgtccctctttctttttcttttcttttctgcctgcctgccttccttccttccttcctctctttctctttctttctttttctctctttccctccctcctttcctcctttcctccctccctccctccctccctcccttccttccttccttccttccttccctccctccctccctccttccttccctccttccttctttcacatcagaaatttaattctcactgtctgggggctaggaagtcccagtacaagctaccaggagattcagtgcctggtgagagctcactctctggttcacagacagtgccatttcactgtgtccttacatggtagaaagttcatttatttttgtctttaatatctatcattgatttatattttgtgcactgctaatccttaatcaatttttaccacagaaataaaatcttttgaactgcttaaagttgttttctctctctatctacacacataatacacatcactttaccccaatagcctaagaactggcctctctttatccagtcttgctctgtacagcattctctatccagcaatcagagttttaattttagaaaataacttgaatcatgtcagtttactttttgaaactttccaatggcttccccattatttggaataaaattacaactcccttctacgacacatgagactctgcatgagctaacttctgcctttgtctttctctttgtcccattcccgcatttcttcatgctcatgaaagtccagccccatcattacactccctgttcggtgcatgcagtagatttattcctactgcaggacaaggcaccacttatctcctcagcttgaagtactgttgcccagagtgttgccttatggtctcctgaaatctaggtctcaggtcaaatgttaccttctcggaggccttcctgaccctctatctgaaattattacccctatccttgttacttctctcacacatctcatctggtgttcttcaaatcactcatcacactctgcaatgttctttttggtttattttttatttattcttttttttttttttttttttttgagacagagtctcacccttttgcccaggctagagcgtactggtgtaatctcggctcactgcaaactccgcctcctgggttcaaatgattctcctgcctcaacctcctgagtagctgagattacaggtgcccaccaccatgcccagctattttttgtattttcagtagaaaatgggtttcaccacgttggccaggctggtcttgaactcctgaccttgtgatccacccaactcggtctaccaaagtgctgggattacaggtgtaagccaccgcgcccagcctatttattcattttttatttgtctcactaactaaaattgaatcagggggcttgtttgcttttcattcagtgaccccagagcctagaattatcctttgtacatgtggaagctaaaaaatatgttttaaatgaatttttggagtaacacatgtacccaggtcttctgcagttcctaccttatatgtgtccatgactcaacctcacaaaagtgtgtgtagatggtaatagctcaagctaatttattaaggatattatgaggaatgaatgagacagtattatataccactctgaatttctttgaaaaaatataataacaaaaatcatattattatgactactttcatattactcagataaagagtaattacttttttatggttaaaatagcatggaaattgaatcagaaggttgtaagcagaagtagggtcagttccctttgtttatttaagaatattaactaagctgagttggattttcaagaaagcttgttttctactagtttaaattctgattatctggtcaactgaatttttagaactatcactaaattaaaaagaaacagcagtggggtgtaacttttctcatctttacttcatttacccggtgaagcatctgcaaagcctctgtgggaggtttaaatgctaatattcagaaaagcagtcttggaagcaaacacccagctgtatttaaggcctgcattttcgtggtgaatgtgtctccagggctgtacctttccactgcccagacttttaagcaccatccatattaagcacaaatcagaacgcttttcacaaaccacttaatgctgtttaaaacccacaagtaaatcatcttaactaaaccctttgatatagctttgctctccaaactgtccctatctggttttaaacactattataagattgttttaaaaatttagaggtggcacaccacattaaagctgttatatctgtataaatcatgtgtggaataggactgtgctcttcccccatactgagatcaatgcttaaaattttatgtgattgtcctctttgcgcatatgtgtgtgctgggaggcggaggtggggtgcagtatgcttgcacctgtgcacctggttttaaagcggtgatttccaacttcttttctctttgagttggttgaggccctggtgcttgcaatgacactgaaacaagatgtgctttttaacatataggctgtaaatgttagtatttctgagtttcgcagatccctactcgccctggttttggagaaaaagctaagttccatcctcttgcctcatttcatgggtcatttatatgtacatgagcctcttcagcagcaatatacagtatctgcctcctctctcaatgaccaactttgagtattgtccctgatccgccatacatgttctgcaacagtgcggggttgactcaaagacaacaagagtggctatttccttctgctagttcagccctcacagttatgatctagctgtgggaagccctgttttctctcgggtgttctctataccacagctagtgtttgttgatcacttctgaaaaatgcactttttttgagacagtcttgttctgtcacccaggctggagtgcagtggcaagaccatagcgcactgtaatctggaactcctgggctcaagcaatcctccatcctcagcctcctgagtagtggggactacaggtgtgtgccatcatgcccagctaagtttttattattttttttttatacagatgaggtcttgctatgtttctcaaataggtctcaagctcctggcctcaagtggttctcccacttcaacctcccaaagttctgggatttcaggtgtgagccactgtgcctggcccaagttgcaagttttcaggtgcacacccctatttaattgatgtctttttgaaaatatatataataaagcaagccagggttctctaattttttctacagtctgtacaacctgacttgagttcagggccacaatcaggacctcatgactgctcaacagcttttgccaaagtggcccagtcacaagaattacacgtggattttgttaggaatacagacacctaggccccttcccctggaaattctgatgcagcagatctaggtggatccccatgatctagaagttctattagtgcctaagtaactctcatgagcaggcagaaggagcaaacacagctggtcaggattaacatttcccttcagggtgaacaggagaaagtttcactctccagatttgtaccaattaactcaaattatgcaggttattcataactgtgtcggatccttttgtttacctgaaaccagacatatttaggctttatttaataatggtggttaattacattgttacatctgacaatgagaaaagaaggaatctcttgggttaaaaaaattaaaaattaaaaagcacaatgggagccaggtcttcaggagactgaactgagcagatgccctggatctggtagatgcggaaatcttatcagctatggtctatggatctaactctcaggtgctcccacttgactgaaaacttcttctttctccacctcttcatctcattgtgtatcttgctcctccccctgcctccaactgggtaagaactcatattctactaggcaacatactgagcacatgactttaatccagtccgtctgcctctctcacatcagctgcataatcatttagcttaaagtgacattttaaaatctcagttttcttactagccttgatttttaaagagtcagtcgacttttaaaccttttaagactttaatgttatcaaacgtttaaataatatttccctaatcactggagtaaagccctgatgtgtgttgtggaggggtgatttaattttctgggttctgagtacctcttttctaattgatattcttcactgccagcttctctaaagagagatgggtttgtggggagggtggaaagaaagaagaaatgaaagaagaaagaaatgaaggaaggaaagcagaccaggaggaaaaaaggaaagagagagacagggaaagaagaaggagggagggagggaggaaaggaaggaaggaaggaaggaaggaaggaaggaaggaaggaaggaaggaaggaaattaaaggagaaaaaaatcatcattattccatttatgcttgtttgaggaaaggtaacacatctttttatgagaatttgttgctcaccttgtataagtagagacactagtatcagtcaagacttcacatagaaattattattcattaaaaatcctttgcacaaatatatttaaaaattacttaagctaagcaaatataaagcactttcactccagtgaactgagtattttaggatagcatccatattgtagcacgatttctccactttgcttattagatgatgatattgcacaaagaactaataagccaaaagagggtgaaatataaaactagattccaacttagaggatggatatatgctatcaattttttttctgcaattacaaagtatcttcatttacactgagtttccaagaaaaacctagactatgtttttatgtggaagaaactaactagaagtcttgttgtcattgttctctttttattaaaaattactgtttttgaggggaagaaattaaagtatgtttttgagtggaagaaactaaccagaagtctttttataattgttctttatttattaaaaattcacgatgtgtttgaaaccacctagtgcttatttatatgtagattctggtgtctagatgtatatgaccacaggcaacacagtacacatcatgggtcatgtccatgccatctgtgcaaatacatgggtaatgtgcgtgggttcattgtgtatagttagttaccaatttgtctctctgtaaaaaattgattttaggtaaaaggctctatttgaatatcctagagcaagatgttgtttgaaataaagtttgaaaaatgtgattgtacttttagcacacatttcctcaatcagtaatttagtctcaagtttggtcttaggcaagatctacatgtaaggcttatttctgatggtttctcaagctgggagagaaaacaattaaagaaaatacttagtcagtttttatctacacgtgtgccttcggtgatttatttaagcattccaacagataacatgtctccattatttttagcaaagggctttttgtcagtattttgtctccagttataataagtgttttaaacatctgtcaaagctgttctacttcccactcaacagcaaagaaaccatgatatgtgctggaggtcaggaataccagctacaagcagaattaggattaattattggtagacagggccgatatcatggtctggccacctgtgcagttacataaagcactaaagttagaaggatcctttgcttgctttagtgttttactggcaccaaattgaaattcctagtaatttttgaacaagaaacccatgtttttatttttcactgggccccacaaattgtgtagccagaactattgctagactatttgcttgacgtgtagtcccaggcacattatttaatcttcctaggcttcattttccacattttaagaaggggaggataatgacacctatttcattggttttgcgagaattaaaagagatcgcgctttcaatatgttaagtagagcacatggctcatgttaaaggcccattgttctgagattcactgatatatacccgtattctgggatagtccgtctactcgcaccttttgcccttggctagtgtgtaaacaactacttcacatcatcccctgatacctgatctccctcccacctgggagctccatcactgttgctaccattctcctagccatccgggtttgaaatgataaaccccttgactgcctaggccttattggccaccaaaacgtacaaattatgactacctcatcatgctctaacactctcatcctagtgacttatatccagttcccaagtacacctacactagaatgtagtctgcatattctaccacggagatcaatctacctggcatgtcactttctaccagcatattagtctgctctaaaactttttggcctggggaccaataattccctgtgactctcccgaccacatggagaaagaaaggaaaacatgaatttacatcacatgtgtatttaaaggcaaatcagagactacacagtagatggaaaaagcttttttagctactaatgtaatcccagtagctggggaataacagaattttcaagctgcctgtttggcagagaaacccagtgttccacaagactttgctcttctcttcatttgtttcttaaaaccacgctgtgttatttaaggaaatgatgatcaacaaaattctaactgaaaagtaacttgatgaaatattttccattaaccgttgagatattatagaaatgtactttttcctaagtgattctggggcagaaaaatacctttataatcctaatatatcacaattcctttagtgcctaatattgagggagcagcttttattcaagatggaaggaatattagatatcattcaatctagcttcctcattttacagataataaaactgaggatgagagtggtaaagtgatttgctcaaattcatgaacctgcctctcctaatattcagccaagtgtcttttccagaatgtcacagttccctgtataataagaatcagctttattttccacaagaataaaagaggttagagttagaaaaagaataagttttctggatacagagtgtcattgtgtctatgtgaaggaatgttagcaaaagtgaaaaaaacaaaaaccttgtacagaataaaagaagttattcctggcaattgactgaaatggaaagaaatcataaaagacttgaatgacaggcaaatgaataatgtgatgagatatatcaaattttgactctactgagatcaaaaggaagaatagagtatagggaatgaaagatgatgtctggatttaacattcatttgggaatcatttcaaaatcttgagataaaaggttctttagaaataataaatgttgtgtttctttaatttttagggactgagagattcatgcattgtcacaagatgttattaaaaacagctattcatttttcatggaatgagacagaatgcatattgtatattggaggcaaaactatatcctctgttattcccatatatttcctttcaatagccgatcagatgaaattgtgagtggatatgaaaggacaaaattaaacatggtaaaagaaattaaatcggggagtttttttttaagaaaaaatccttcatttgtttcgttgtcagaattaccaagatgagctaggtaataggttagctttacgagctaaaagtcatcatctatacatgcaaatcacgttgcatgcaaacgttctttctggtccattttcattagtgcttaagtatggagagactactacaggactttaaagcttctgtccaattacccagggacatctcaacatgaattatagctatgtataagcaaaaaaaagtatttgactttaaagcaaatacatcagactgtaaagcaaattcaatattattcatcttttgttgtattcaaagataagaaagtagtgattacttacattataaaggtttaaatatctatatttacccctgactttagtacataacaaaatatgaataatattaagattcccaggatatgataatttcaataataagaaagccctcttttgactaggattttcttatttccaacaggtttttgtgttgtgtttaatctgtctgtctgtgttttagatttactctattaggaaatattagttccaaccattgtccttacagctgtccttgcaggaacactactcattttggaacagattagtgtatcttggtaccccctttaccttgaatgtataaattatcttttagatctatttgttgctatgtaacaaaccaccctaaagctgagtggtttctaatgttattgcccagtagcattttgggccagcaaaatggttattctcctgggcttatcatttgtctgtggtcagccgcaggttgagtcagcagtttggctgaccttggctggtacctttcatatccctcatcacatctgtcacatctgtacagcacaacagttgtccacaaattccatcattttctagcagattagccggacttgttcacccggtggtgagcagagtgtcaggaaaatgagtggaaatcttcagggtttcttaaagcctagggtcagcatcatttctgctgtattctactggtcaaagtatgtcacagagcaggtccagattaaagggcgggaaagacaagtgggaaaaactgcaaagtaactttggaaaagagcctaggtatacagagggggatatttgcagccaattttgtaaacaatttacaaattactgaagaatttctacagaaaattcattttaattaccttggttatacttaaacataaaaacagtgaggcccagagatgtcgagcaactggcccaagttcacacagaaagttaaaagcagaactggaataaccaactgtcctagtttgcccaggattatgtcagttttagcactgaacatcccacatttcaggcaaactggggtggttggacaccctagggaaagggctaggatttcctgattcttagtttgatattattttctgaacactaaaattgatctatgtgactagctattggtgtttaagatcaatctaccctcattcctgcatcctctattagcatgcatgctgacatttaattagtttgtccattggttagactctactctgttccaaaatggtttaaggcattttataaagtactgtacatcacaaggggataactacacaaggctaccttgccattcttcaaacattccacgtattttaatgtttatgaatgctaattctttctgctttgtgattagtctttctctttctagaatggtttttgcttttttttttctattaatatcattcaatttatagtttccaattaccttctctgtgatgtaggccccagttgaagaattcatcattatctcctctgagctcctgggagacttggcccatattttgatcgccatacttagtacattgtttctactaagttacgtgttatctcattacagtgtgttttcaccttacatctcctttatttagtataatcttccatatccagtaggcactctgtcatttctttaagtcattgtttctgttgcataaatgagtgaacagactgtttagtgacagcctagtgaaatgtggaaattttcactttcttcactaaaaacccttgactgcttttcttcttagttccaattatccatttgctgcatttttatcttttccgttggtataattcctgccctaagcaacacagctctcatataatctgctgggttttaattggctgcagtttccaaagctaaatgattagtttcaaaaagattgtttctgacccaatgcactgtaaattctgcacggggatctgaagtgcttttgtttgaggccctgtgtttttgtgtttgtgtatgtcatttttatacccattctggattagtttccagaatatccagaaaaataccaaacacataataggtgctcagtgcacttcatgattcattgttttatcatttgctcatatgtctctatacacccatttatacttcagggcccttcataggcctcttcacttttggaaaactttcctgagcaagcccctccctgtccagctggagttctacaaacatttaccatagaacccattcttttatattttcataaagtattcaattctttgtctctccatccactgtctgtaaactctttgaagctggcatctgtagactatttgcttttgctgtacctggctcacaggaggtaccaaaacaacctttgtttatgtgattgattagtcaaattgatgaatcaatcaaaaactacagtttcagaggaaaatgttataaaaagaaaaagtatttcagacgtcttcttggctcgtattacctgtgtcatagcttttccatattcagaacagtttgcatcttagaatttggttagcagatatacttataagactttgcaggtaagaagaggaaatgcccagcaatcagcttgctaaatttctcaatttgccccacctaaacttgcaacttaaatttagacatttttctgaaataggtaagtctaaactatgagtaggatggatttccccaattttcttgcatcaactgatacaatatctacaaattatcgaaaagatgtcaaaaacacatggggctttagccagtccttataatgagagatgggtcttggtttagcagaagaaaagaatacatttcagataaggaaaataaaagcatctaatgcataaaatagaaacaatacggtatgttcctgtaatagtgaggcctttcatacctttagaatacaggataaaaatggagatttgcatcaacttgatgattggaactaagctgggagatgtaaacttggcatgttggtatatatgagtagaagaggagctttcaaaagtagcattcatgcaagttcagtggaaaagaccagtgacaggaaaacacttgtgtaaacagacatgatattctgacagtgagaatggggaggaaggtaaatgctcaagaaggataagattaaagtgaattatatttctgaagggaggaacaatccacttttctagccttttctcttgccactcagtcatgtatcttttacactccaatgatagagaatttctcataagcatcgagcttattgcatccctttagattccatcatctttcctcatgcagcggcttctgctttatctttactctaaactcctaagaaattccaatgtattctttttttaattttttaatttcaatagttttggtggtacaggtggtttttggttatatggataatttctttagtggtgatttccgagattttggtgcacctgtcaccagggcagagtatactatacccaatatgtagtcttttattgctcaccccactcccagactttccctctgagtctccgaagtccattctacaattcttatgcctttgcatcctcgtagcttagcttccatgtatatgtgagaacatgcaatacttggctttttattcttgaattacttcacttagaataatggcctccagctccatccatgttgctgcgaaatattatttcctttctttttatggctgagtaatatcagtggtgtaaacctaccatattttctttgtccactgattggttgatgagcacttacattggttccatagctttgcaactgcaaattgtgctgctgaaaacatgaatgtgcatgtcttttacatataatgacttattttcctttgggtagatacccagtagtaggattgctgaattgaacggtagttctacttttagttctttaaggaatcttcatactgttttctatagtggttgtactagtttacattgccaccctcagtgtaagtgttcccttttgccacacccacactaacgtctatttttttttttaattgtggcttttctggcaggagtaggatggtatctcattgtggttttaatttacatttccctgataattgtgatgttgaacatttttaaaaatatttgttggctgtttgtgtatcttcttttgagaattgtctattcatgttcttcacccactttttgatgggattatttgttttttcttgctgatttgtttgagctccacattttagagaagtataaaatatttaaaagacagaaagaatgtagagcctttggaataagagacgtgggagaatgtcctgaaaatacagttttccagaggtcaaaaaaaagaagttttaagaataaaaaaggtaaactggtgccaaatgtaaaaagtggtcaaaaactgataaaagaataatttagaatttgttaagaatctgattattgatatgaaacgtttaaaagaacagttttagcaaaagacattactaaaatgtgtattttattatatattttatttatcctaggctataaaaacctcaggactgtaagatttttaattagtgttaataatgcttgatcatagtgtatgacttttctcccttctgtattaccagcaatctgaacattagcactaggcttaatgtgattaagagaaatggattcttcctctaactggctgattttggagaagacatagaacaagggaatctttaagggtcatcttactctcacccaatatgagaattcctcctacaacctccttaactattaacttatttcacctttctagatgtccgtgaccttgtctctaaaataacgcacttggacttctagctctaacttctgattaaatgaattagaacataaagtcactgagtcagttgccttcaactcattctgcatgcaggctgtacaatattttcatccacattttaaaagtgaaatattttaaatgttagtaaatgttaaaaattagtaagcaaagagcaattagcacgggcacattctgaatgccttttagcccttgcttaaacttaagagaacagtctgttaaaaacaagataatatttttattgacatttcagttgttgcaaatgagtctttgccagctttcctcctgattctagtattttgcctaattctgatttcacgcgtgggtactttctgaacaatccatgtcttggagcgcatcatgtactaatgttgctctgacaaccttgtaatgggaatttgaacagttattacatttttcttgttaaaaccagggggaaagagcattccaagtgtttatagctccctaaccttactgtgatgaggtgaagtttgatgtagctatttcctcttactttgaaatctcatttttaataacactgttccacgcttggcgctgcatgtgtcagctgtgaacccattcacctttgcaaggagtagccttaatcctgcaaatcctactttgctccagtcagtacagggttgaagagaagaatctattctaattacttaaagtttacttaccagtgcctgcaatgctacaagggaactggaagctataatagaccaccctcttcagtttgggggaaattctacaagaaaggcttctgtaacatgagcagctcttgacttatcagcaacttccataggctaatgattatatttgccaacatacccacaacagtttacagagatttttgacttacagcagataaatgtaaagattgaaattacgaaataagtagaacttgtgaaaccctttacaaagtcacagaatatactttatcttttttgtcaagtagaatggaaatttgttaaattatctgcttctcacatattattttaaaacaaaacagatgaaagctctgaaatacaaggtagaaaacgtcacttttttttttttttttttgaggcagagtctttctctgtcacccaagctggaatgcagtagtgagatctccgctcactgcaacttccgcctcccaggttcaggcaattctcctgcctcagcctcctgagaagctgggattacaggtacccaccaccactcccagctcatttttatatttttagtagagacagggttttgccgtgttggccagactggtctcaaactcctgacctcaggtgatccacctgccttggcctcccaaaggtgtgagccaccacacttggctgataaggtcactttttaaaaagaatagtttttaggcatcatagtgtcattaggtactataagcagcaagttctagaaaaaaaaatcacatataataactatcttttgttgactacttagtagaaaccaagtgtacttctagacactctgcatatatcatcaaatttaatcctgacctaattgaaaaacatataataaaatattaacaaaagtaatccttaggtgaaggtaacagttaactttacatgggttatatcgattaatagataaaaagacaggtaaacatactgttttcctttgaggaaaatagcaagtgttttcctttgaggaaaatgggcaggacatagtatatatctgggtaatttgacccctccattcttagtgcatcttacctctctactagttttatacctgaatatgcttactgtactattccctttttaactaagaaatctctagaatccttctacaggcatatcatatgttcctctcccctttttgtactatgcaagtatttttcacaaattttgcacctagaatcttcatgttatattccacatcaactagcatgagagaggctgcttttcattaggcaataagaagcagagaaagatctatactgcaataactctatgataaaggcaggacggtatattttacactgatttcaccatatatcctccgcatcgcaattggaaatgtagattttataatgcttattttgcaattcaggaaactaatgttcgaggcttaacttattcaaagcgattacttgaagcaaaagcttcatgaacttgcccagggttattctgctgctgagggggagagatagcattggaacacagggtttatttgccttcaaagttctgttattcctattacatctctgtcatgaggaagactccatgcagcagaatacctaaattttagcaggtgtttttaagagatgcatgagcagagagagagaatttgcatctgtgtggatagagggatcttgcttcatttgcaagcaagaacttctgtgagacttccggtacatcaaagaatgcctttgcatggctgtcttctggaacaacctgtataaccacatgggaataactaggtccaaagtgtcacactggcttatgcatctcctcaagtagtcctacaaagtctaaaaagttaacagatacaaaccaatatcggaaggaaggacccatacggtaagatgaccacaaacatagcacttttcccactgagtcccctgttgttctaagtctgcctttgatgagtatccaggagcttgtggtctcctagtccttttcctcctctcctttgtactctccaaggtctcatcgtttcagacctctcaacccctccattctccatttagagttctggttccaattcaaggcaaaatcctcccagccaggtcttcaggtttccaggcagtgcccaaggctccatgcagcagcaagtcctttgcacttaaaagcaagtctttcacacatgcaagttcttcaaagggaaacaactcttagtcaaacaagcctttctctcataacattggccccattttacagtggaactctgatgcttaattatactaacaaagtatactttttaatggaacactagctacctttaaaagttagccctcagatcataaggcttaccatgaatgaacatgatttcagctcctgtaaagttcaaaccagtgctgctgatcagaagtcggttttcccacaaagggcgattcagggactgcagatggtgctgctgttatctctacatcaagccactaaaagggaagtgacatgggagtttaaatagaccacacctggaatggcagctgtcaccttcactcacagttgactagtcacagctaactgccaggtaatcagagaataagggccactaaatggcacagcaagttataaaatgcattcttaaccggcatatgatatctagctggatatccaggaataaaagaagagaggtcagctaagcagatagctagactgcgtgatgcaaaattttgctaatttctaatgccttaccaaagattcctttcccttaggtttgggacattttgtaatggaagaaaagggagcattctgagggaatgagggaggagggaataaagcatgcatgttgaagaaaactctaccgttgtaatttaagaaacaacaacatacatgccagaatccctttgtaaagtgaacttacagtttaaattgtacattgtatgattgtaaaaccattatataaatgaaaaaaatagggaccattactgccttaaaaacaaacaaaaaaatgaaatacatttgtttggaagatgagaagactatccagatttgactagagatatttgcctataatatcactttaaattgtttctggggacaagaagaaataataataataatagcctccctctctgtaatagaaaaatgttattaggtgacatgatatttatataaaatgttgtttccaatgagacaaaagtaaaatatcctactgtttttagaagcacctggtattcactgtatgacatcttactttcaagggagttcttgaaccacctctataaggcagtcaacttttaaagcaacttagtattttggcagttggaagacatattaactacagtcatacctatttatgcctaaatctaaaagttcaaaaaataattaactcagatttagtagatttggaatatggattgatagtttctagttttgaacctagcttagacattaacaaagtggactaataataaacttagactaataaaagtatccccaagaccactttttcctcactcctgccttgcttacacacttgtcagtaaattagagttttatttccttcatgccaggtatcctgcagattttgagggaaatagaagcccctagtgtaaaatacaagagtttctgacaaccggttgataaattcttatttattaaaaataatttctaacttagcatgaggtcaatagacttaatgaaaaaatttcatggtataaacaatattaaaatattctaattatgacaattctggcaaatcccagaatgcattagattacagaatcacaggcttatttccagatgctgcaactatagtattcttttttttttttttttttgaagtctaaacatctcagtggttccaaaatacagcagaatcagataaatgtttgggaaccatactgaaaaccaattctgagaatttaattaaaggctggctaaaagcaaacaaaaaaactattatatagtgtagttgagtgtgacattctcattggatagttgataattgcactgcttttcctccatatcaccacaaattcatcaatcaataaattgttatgaaaaatttatgtatcaaacgatagagtttatacaagtaaaagaaaattcttattttcaaagacctactactccagtgatacaaatgtatacacatacattttaacatataagcctatatagatatatgtatgcatgtgtgtgtgcttaatatcaaactcttcacaaaatgtaatatagtttatagaaagcaaagtttattttagatgaaacctagagagctgagtcaaatttacctaaacagagaatagtggggataattttttttttttttttgtaaagaaaaggcctaagtaaagctagtaaaggcattcgaagtgcattggtttgatgaaagtagaagacttgtgtataaataaaggagtgagaaaattagagaagagtttgaggtcatacttgtgcaaatcccagaaggccaagctgagaacggcacctgatcttatagagagtagggagataaaatattagaggagttccagcattgtgtgacaaatgttattgagcttggatagaattcagtgagattagtgctatatagcaaaagaatgcataaaatacaacataagtactggctttacaaaaacatcattggaccaacatgtatgggctacatggaagtggaaagagattgaggtaggaagcagatgcaatcattgagatgtgtgagatgtatggtaggaaaggtggatggcgtggggaaggaaaagaaagggtcaaatgggagagacacatattttcagcacaaagcttcaataaatacttgctaaacgaactaataaatctatataatatttcagctcattacatatcctatttttcttagttctgtcaagatcctctgagggaaacaagcaggctgggtacagaagttaaactttggaacactttctctttgagtccccattatatatgttctcatacatgccctcattgatgctgccagtccatatttttataatatcatgtattattcttttgtagcatttattatgattttattaacttttatattattatatatgtaaactgacagagatcgcaactactctacacactccataagagtgcaatgtatattttctcacaactgtatctagtatatatcaaagttcaataatgtttaattgatgtcacattgctatgtggaagatcaaagtaatttgcagcatattagctctgtgtttcttgcataaaattatcgtcttgagagctggctctagaaaaaatgcaaaatcagtggggagaaaaacttcttcccactttataatgatacttcaacacccttgaccaaattcttatctccttcatctgaactctgtcatgccaccgtgtttgcctgtcatcactaaaggaaagcaaaccataaaattaaatcacaaataacgctagaatgatttgccttttaaagattccccaaatagtccaggtacagtgctcactcctgtcatcccagcactttgggaggtcgaggcggatggatcacgaagtcaggcattcgagaccagcctggccaacatggcgaaaccctgtctctactaagaatacaaaaattagccaggcgtgttgacaggcgcttgtaatcccagctactcgggaggctgaggcaggcgaatcgcttgaacccgggaggcggaggttgcagtaagccaagattgcgccgctgtcctctagcctgggctacagagcaagacttcatctaaaacaagacaaaacaaaacaaaatcccccaaacaaggaatcaatcactggatgatagtatttcaggcattcctgaggtacacactcctggcaactatctcttccacttattttttttatttcttctaacaaaaatactaactaaacttgactcaataattctttgttaatgagagagaaaaaaattgttcttatttcaacatatacttcagatagaatttagtacttgaataagcattcagaataaaatgcgaaagtattattaagggcacaaaagtattatgcacttaacgattatgccgataattgttaagggcgcaacctaacaatgtaggatgtgacaaaaatatcaatatcggctttattcaccttcatgatggaatgtaaggcattcatttcttatttctccttggctttggagttagctcactcatttctacattctagctgtctaactagaaaggcaaaacatagccatgtgtggtggctcatgcctgtaatcccagcattttgagaggccgagatgagtggattgcttgagttcaggactttaagaccagcctggcaacatggtgaaaccctgtctctaccagaaatacaaaaaattagcctggcatggtgtcgtgttgctgtagtcccatagtcccagctactcatgaggctgaggtgggaggatggcttgagcccagtgggtggaggttgcagtgagcagagatggcgccactgtactccatcctgggtgacagagtgagaccctatctaaaaaaaaaaaaaaagaaaagaaaaagaaaagataaaacataaataagcaaaatagaattttctctataagttctagaaatctaataatgccaaatttttagcatttaagtaaattgtactagagtgacagtttataaaggaacactatttaaacaagagcacctgtagacgtgtcatattttaagggcaattataagaaattctatccaagttgatattttccaataatataggattgctatttttttttctgatacatggttaagcaattttctgaattttttaaaaacaagatacatttcagttcatgaatgaccttagatatgagttttctcactaggtgttataaaatgcgctagaagagaaaaaaacacagaacaatctatttataaaccatataatgagaataaggtaccctttatctaatttgcaatccataatagaaactataattgtctatagttagaggaaaataacttatatttgcttatcaattgtaccttgaagggctctgtatttaattaaatgtccaatgacaaatctgattccaccaattgcatctttagaatcagagattgatagaagccacagagtcaggggaaccatttgccacaacagtgaaatgtgggattgatgtcacttcagcctgggatggtttatttgaaaatggtaagcctctggtagcatcaataatgccatgttattatcttttggcatttatgcatatactcctgatagtgcagtccattgagtattgaattaaagagatttcaagtcctgtccttcactagaatatagcttttcttgaagtgttaatgcaaaaaaaaaaaatgtaaagacaaagaaaacttgtaatcccaaatttttctgtaccagaacatgtttatataggtttaccaagggaaagagagggagaaatacattggatttaaggtagaacctgttcatatcaagactgtttataaatgacacccaaaatcagatactggggagtggagagggaaaggttagactaacctttttccacttaactgacttttgtgggactgtatagatattgttttaaaaccagtgccgttttttgtttcagttaaattctccagttaccaattcactttagacagtgaaaaaatggaatgacagagagtctgaatgaaacagactgatgaggcaacatctcaaaaaggcaggatacaaatgatgaaaggcatatgtcagccaaccaagttatctttgtgatccagaggcatggcagagagacacaaatctgtccctgaagttctcagaatgaaaagtttggttcatagttcaagcgaggttaatattcccaatctcattctattctttatctctctaccaaaagagacaataatgttgttcattttacctactgcaattttatcttctttcttgcagtgtcttttgcttatgaattaattttttattcttactgtgataagaacacttaatatgcaatctatcctcttaagaaaatttaagtgtacaatccattattgttgactataggtgcagtattgtagagaagatctctagatctcattcatcttaaccgaaattttatgcctgttgattaatatctccccatttgctcctactcctgtccttggtaagcatcattccagtctttgattgtatgaatttgactattttggatatttcatgtaagtggaatcattaagtatttgtcttcctgtgtttggtgaatttagtagtttcttaacatatctctttttcttatttgtttacactacgttgtataggaaaatattttttaaatgctgcaatttttccagtactagtcatgaatcttcataaatattctgactctatcctttccagcacatggagggattacacctccgtgttgacttggaaactaggtgtggccatatgacgtgctttagccaatgaaatgtgagtggaagatgcctgtgtaatttctgggtaggagctttaacagccagagactgctttaccatgttcttgtcctctgccaccaacatggactgaggccattccaacatccaaagagataaggatgaagacagtaaagaacagaactccagctgaccttcaatgaacatgttgaggaataaggggcaaaaagttctctgttatttttagatactgagattcagagtttgtttttttactgaagcatagtgcatatcactgatgatataaacactgataatagtagagaaatggataaaatagaaaaattctattttaaaacatgaattaatgatattaactatcagacaccgaaaatgtaacatatatccctgtgttgtcttagttccttataaattagtctggtgttagaactgtaattttctgacacctacttagagatacggtagggtgcttgttacagttcacttctttgcatggcattatgaaacataggcagccatgtttcactcctcataactagggtaataaaaatatgagaagatagagaataggcagcgcacatctttctttacttgaaattgttcagctcattttgagattgataaaatggcacaattaagtttaaaaataaagaagtgaaagtttcagactaaaggtcatgacataatttaaagctgagggcaaaatgatataattgaagagggaagagtgccttttaacaacagtaattgactaactcccagttaataatgttatgactgaaaattaagagcatagctatgctcaggtgatatatctatattaagaagaaagcaaaatcaaagtagtattgtctatttatatatcctactcatcaaatatctttgtaacagaattcttgattgcttctatgctagtcattagagttaaacatagaatattgtattctttatttaacctgtttgagtctttcattatggaagtcaaatcttagtctctctttaatgatatcggatagatattgctgtgatcagacaactgttctgtatctgtgctgtccaacaccatagccactgttgaacatttggtatgtagctagtgccacagaggaactaaattttcagttttactgaaattactttacatataaatgtaaagtattaattaatttacattttaagagcaaaatgtagctagtagctactatattaatcatacagctggtatcgccatgtaacctgaaactaaagttgaatcttcaaggtcacaaataaacatttgaaaggtttaatgcccaaccagggatgccatgccaaaaaaaaaaaaaaaaaaaaaaaaaaaaaaaaaaaacaagaaagaaaaaagaaaaagaaagaaaaagaaaaaaacaagcaaacaaacaaacaaaaaactttgaaaagtaccaacaccaaaatcttagcattcagagcctcagtattgttcaaaagttattaaagtggatgaagggagcacaatgaaaggttttgccaccagagaattacatagcatatgacaatactgaatgcataattttccccacttctttctaacttcttaatctaaatgggtcacatttctgtcagcaaacaaattcctatagtcaatacaatttcttggaaatctgacattattataaacacttcaaattactttaccttcttggtaaactatcagtttctcagatttttgtttccacacaagctcaaaagtctccatgtatgtaatttcactttttttaaaccttttagcgtatgtctcatgtggtcttgttgccaagagagtgtaacataagtacatttctaaaacttaccatttacataaaacttgaattttcaagtagagccatttgagacctcagatctattcttccatccctcttgaatgtatatggtcttgatttgtttggaactgccatccatgtaagtatcttattctaccactaagtggttggagcataggtaaaagtattcgaactttgggcgtgcatccaagatttgatttttcagcagtttaaaacaaaactacctgatgtgttccactgtatgagatcaaaaatagacagtgttatctttgtgagacaacatcaaaatttgatttaaaatattcagatgaaacatttttttcttaaggttgtttctgtgggtaaactcaagggaagattaattctatacctagaagctgtcattgatctggcactgatatacatatatagtctgttttttaatcagtatttggatcatattccaaagtgtcagttttatgtgatagttaaaacagtttgtggcaggaagaactttaaaagattttcatgaatctcaattaaataacttgaagttttaaaaattcaatcacattaaaatattttttgttttttaataaagttctgatttgatagattatcacattaattacaaaccttcagggctcgcctttgtccattgtttaaaatgcttagtgtagtgtgttaaaagttcttcaactctgggaccaaatttttagccccttcttacagaagttttttttccttctgctcacaacttaacttgtcagtccttgaaaaatgctctcttttgaatagttagaaggctattcttcctttccccattcaacaaatctcgctcatcctttaagactcaatttacatgtcatctcattcattcattcaacaaatagataatgagcacttgctgtgtaccagtcactatgcttagtgctttataaattaattcatttaatactctcaaatgtttttgtgaagtcgatattaatgttatcatttcacaaagacaggtaagaactgcctaccttttgtcccactccactccacccaccattctgactgtggaagctccatgggtgtccccattattggattgcgctgacaccattagtcttcaccaccagtcagtttctttaggactgcctcctctcccatggccaaacctcagagaaggactacatgaattttctagactgctataggtatacagtaaaaaaaaaaaaaaaaaaaaaaaagaaagaaagaaagagactctgattaatgtggcataaacctggttgcatcttgagaatttcagtctagagattcaagttagtttgttagcaaaatggctttagttcctactatgcttttcctatgtggtgactacaagttgtcttcttattcccatcaactattaagactaattaaggagtaagatattatttgtatttagctcattttgatcaatatcagaaaacatttattgagtgactattatgcaagggcatctacaaacacacacaccaaaaaaacaaaacttgatgtaataacaaaaaacaattcaaaactttgagagagaactgtcctgggggaagaagttgagtatatatttgaagcatgttgtttcctggagtgttatggaggatttaacacatgaacacgccagcagaatgtaaatgtaacagagaggttggggtaggagaaataggacacctctgtcttcttttcccagaagtgccccaaacctgtaagatgagaccatatgctcagtttatagcaggaatgttttggtaaaagacctattttttaattataatataatttttaaatcataaaatgttagtggaatttgagagattgttctattttttcctatatgcctgattggaaataattatttaaatggaaaattagatattgtttttaaaatgttacaaggtattttgggttttgaaactcagaaactaagaaatttattcatatatggcccagtgaggtgtgcatgaaagaaagaatctggttctacattcatgtattacctcaagccattcatatgaaaaattcaggccaatgaccacaagagggatgaagaagagaatttgttggatggatctgtctgaagccattaatgcttttggagaagaaccacctcttcctgcctttccattcttctagtactctaagacagtccctcagccagaatagcaataaactcttggcatctggcccaagtttaggttctctggggctggattgctcttatatcaaaaagtcacatatgagatccatcagtaccagcaagcagaggaaagagttcttctgactgctgggtcagtagaattcatccataattcactcaacaaacagcagttttatataaaagagaaaatacattttaccttgctgagggcaaaactaaatgtattaataaaccagttaagcaaaaagaagtcgccttcatattgatgttatgtaattgtcacttgcaaaacaacctgtagagcatggaaaatatcctatctaataaaaaaaatttggtgattataaattggacttagaagagtactaacatagtatattcaggtatcactgattactggcttgattaccagagggaattagaaaaaaaaaaagactttttaatgaacttggttacctaaaaagagaaaaaagagtataaacccagtttgtttccttacctgtttttttctaggttataaaaaatagcttctgagagacaaatagaaatataattgcctattacaattttattttacctgtataatgataatataatatcttttttcttcctcttaatctattattcttgactaatctcatctttgaaaggcaagtcttacattattttacatgtagatttttcacatttcttcttacaagtttgaattgttgatttaaaaaaaagtaaaataaaagatttaaacttactataaagagaaagcattggtatatagcaaagtgaatgaaatactggataatagctcccaagaagctcttttgggataatagtgcaaattgaattgcctgccttgaaagaacatcacaggtaggagttgaagaaattctcagcttctctgatttctttccagccagtaaatgtgtctatcaaagtcacatggtcagcactacttgcttgcttggttagacttgtattcagttaaaaaataaaataaaaaataaaagcaaatactgaaataagcatatgtttcttttctcctggcaaaaggacctactgtcttctgaaaaggaagtagattttaggcaaaaacattgtgtgtctattaaaatcactctacgtaccatcactcaaaagcattttttgaataacttcaggacctgggttctggtatttcttactccatcttgagcactgatctgctttgtgacactgattgagccacatccctgtactttcagtccctgtcttgcaaaatactggaaataaataatgctctttccaactgccacttgttatgcttctagtgtcttatttatgttatggaactctgctatgagaagaaaaatagcagaacacaaaatctatgaagtttcctggcctgatagtatctgttgcaaaatagtgtttctgggaggattacgtgaaatagtacatataaaatgtctaccacatagcatatgctcaacaatgttaatccacttgccacagggtcacttccaatatctcactctggtaaaaattaccttcaccacctgaaaatctctttgtatcaggcataatagctggacttaagaataacaggactgaagaatacctgaaagtctaaaattgttattgcaaaatcagtacactaacttttgcagggcatttttttttttgtaaagaatggcattctatttcaacacactatattttacttaacaactattagttattcaataagtggataacatttacttgaataagtgaatgaataagtcaattgaataccgtacttctccactacggcattaatgtataatgtatcttgggctatttgtctcattagtttacataggagaacctgacttactctgtgatactgatttggcctgtgtagcagattcctgtcgtgaattcaacacgaactgggaaaatttctctaacttttttaacctcgcagttgttttttttttcccttccatgtaatgggcataataacacataatgtacagagatttgtcaaaattgaagataatatctaacgtcaaatctatggtatgagataaatatgtatttatttttaagtaaatttgtatcacttttgagtatatcatgtgcttttaaaataaccactttaaatttactttttaataacatttctgaatgtacactgttggggtagtgtaggagattccctcactacctttggactaggctgttgctcatgacagcagaatgaaatttgctaacctctactgtgatcccgaatttcttgtgatcaatatcaaaaaaagatgtgaaaggcagtactgctcgttacactatagtttcttttaactatgcctatctattattatttggtcatagaaataagaaaatgacattgatataaaatgcaaatgactctttgaatcaataataaattactgctcacaaactattcaataacaagtaattgatttgaagccaggcagaattttagacttatctattgtcttcagctgtacagagttaatgaggatttgtaattactttggattttaactaatacatctttttcattttggaaattgattttatattagtgtcatattttatggtttacacaattacctgactaaataaaggttgacaaaattgaccataatcaaaggcttgggagtacaataagccattttaatgcatagaatgtgttttctcttttcaagaatacccatctttttaaattttttatgtataattgttaaaaatttctcctttagaattgtaaaatgggaaagggaatagcttttagtaactaaaaagcattattcacataaagttctttggatttttcaaattacattgtttacctagaaaaaagttgaaaacctgtatctggcattttaaatttctacgtcataagccatgtacattttctacattaaccatgtcaaagtgtgaacttttagtctcctttttaaaagactggttcaaaaaaaaaacaaaaaagaatataccagacattctttgaatgtcactcaccaaggaacacttacatatgcctcttgtgaaaaagaagaggcatagaacagccactgaagatattatcctaaacttttatttggcttggtttggaattgtccagcagcataaacacacgattgctgtattctcagctggaaacaggttaagctagaaacacatattactacagccaaacaaaatagatcaatttgtccatggttattcatttatgtttctccttgggggtccctaagaagcaaatgatatgcaaacagctgcatgattattgctatgctcttgttgctatttggtgattgctatttacatgtaaattactacttggcaaagtacaacttctcttcaccagcaaccagacaacaaaacagttcttactaagctgtccaagattaattactcaaaaatacttcctaaaggatgattcctttagatttctgcatttcctagaaaagtaattttagaatgaataaaatataaaagaacaatcccaccatgattctaaggcagtatctatttaataagcaactttagaagattatggaagaatatagaaatgtaggtttcttgctgtgaggactgatttgggcagaatgggaaagaaaagaaaaacggaaagctagagtagatgcttaaagacagatgataagagatcaaagataaacttgatttatttccaaattttatctctgagtcaggctagatgatatcactcctcgcccttaatgtgtttatacctaaaaattgtcatgagactagagattattaaactgcctgaattaggcaaataaaaagaaaaggagttctgcacattggtgtcagttaacacttccgtgcctttctttacaaaacaaaaattatttaatgatatgaaaatagatatatttacaactgggtcataatctatatgcagttttgcatgtttttctcctaacattatatgaaatgtcattttcatattaattaatgtaaccacagcaaaatgttaatgattgtataatatctcctttatgcctgcactgctacttatttagtccccagatgtgttgtttttcacttttcactattataggatattttaaaatggaaatacttaagcacgcatctttgttttactcatccagttacttacttggaatttttgtaacaagcatgtgattaaggattttatacatattgacaaattgctctccggggaagttatccaatttacaccaccattaaattagtaagagaatgtcatttccttcatttgatttcatttaaactgatcatagtatcaatagtctacttagtgactcttttttttccttcaatttcatgtttcagaggatattaatcaacccaaaaaagttcaagctgtattagtatagtcaagaaaaatgggaaaaatgaaaggatttatgattcaacagaagaatcataatccatttaatccacgtttaatccatttaatcctggtttttcacaactggaatacctatgattataagccatagatttgggggaagaaaaaataagaattttagaaacagttgaaacaaagtgaagacaaggtttattttcaaatataccttggagacttgtagattttatataaaataatagggtcaaaagtgacaagcttatttttacaccatttttgataaatatggttgactctatattaatcaagatagtaagggagaaagaaaggtataaatatcccctattactattttaaaaaggaattagtcataatgtaataaaaataaatttattttaaacttattttattgtaatagcatctagtatttttaacacataagtaattcgatagactatcattcagcattttttttcaacaaacattttatttttccagtactgtaggggtgaaagtaaagcatccccttcgccttcagaaagtttgctgaaaacccattccaaaaaggcagattaattggagaaaaaggcatacaaatgtattggatcatagtttatgtgacatgggagccctcagaatgaagacccaactcactcaatggggtgcagaagcttacataccatctggaggttacagaaagaatgagggcttggatcctggcaaaacagtttacaggagaggggagaagaggaattttgaaaaggagcaataaattacttctaggcggaactgatggacttgaagaacataaaatggtctaggaccaagactattggatccataaagtagacaatgttttgtgacaaaagtctgcctaggttttagacagattttaatcttccttcctgtgatgtgggttttgataatgaaaactcaagaaaggaaatagaggagatttttttcttctttggtgtgaccagactgtagacagataagggaacttcagcctgtgctttgggagaggtagaagattgaaaaacagtgggggcagggggtggggagggcaattgttcctctccttggtgggtctgcctggtcttcatgtagaggataagtgaaaagtctcttctagcatctgttgatctctaaaggactttaatttaaaatattcattataccagggagccatattttgaaatagtatttcctgttctccttcagtatttaccatgtgccaggcactgattgatgtcctggacctaataatagtgaataaaatagagagtctcttgttttcttttcatggagattccattgtagtgggagaaaacagtcaaaaatcaagtaaaaaacatagtaagcaaaatagaggaaagtattatgaagaaaaatagagcagattaaaagtattaaaaatgatagagaattacaattttaaaaaaagatgaacagggaaggggttttagggttctccagagagaaccaatggaatggataggcagacatagagacagatgtatacgggtagagagaaagagagagaggatttattagggtaatttcttccagatagaggatttattaggggaactggttcatgaaattatggagtctgagaagtcccagggcaggctatctgcaagctggagaccctgggatgccagtagcaaggctcagtccaaatctaaacacttcagaaccaagaaagccaacgatgtcattctcagtttgaggttgaagacctgagaacggggtgatggtggggtggggaggtggaatggtataagtcttggagtcccaaggtcaaagaatctgatgtccaaggacaggaggagaagaatgtcttccaagttcagcagagagattgagagagagaggccaattcctcttgcgtctctttttgttctatcaggcgcccagcagattggatcacactaaggatggatcttccctgctcagtccactcagactcacttgctaatcttctctggaaacaccctcacaaacataccccaaaatgatatcttgccagttctcaagctatttttttattccattcaagatgacacctaaaattaacaatcaaagaagtccaatctggagaggtcagatttgagcatagatctgagtaaaatgaaacgtgagcaatgtgaatgtctggggaggatgctcttaagcagagaaaaaccatttggagtatgcttaggtgtttgaagactactaaatgggccattctgatggtgtagttagtgaaaggaaaattgtcagaggggaggtcagagccaagaggtagtggtggtaaaacatggagtggaaggaaaacttacaggttaggctacaaaagtactttggattttttcctgaatgtgtctggaggtttgatattatcatactcatgttaactctccctactgtgggaagaatggattctaggcaatgaggatgtaagcaagagatcagttcagaggcttttgcaatatccaaaggaaaattattgaatatgttttgtagataatttgactgatttgctgtgtgtgtagatgtggggtgggagagaagtgaagtacattaatcagaactgtgaatttgcttccagggtaatagtttaaggaccaaaacattatataaatagtttaccagaagtatattcctacagtttttattccgatactatttttttttcaggagaatgtactcatctttgtctcatattttaggagtctaacaaaactaatgattcagctttaaaatttgtgaaatagtataaataaatcagtccatcacaatttctaccctttaaatatgaaatatttttgccacaaggtttttctattattgttagataaaaatcagcactttcttttatatctctatatatgtctagtcttaatattccatgcagaaagaggaatcaaattcataaataatacatctttacctcctaggtggaataaatataaatatggtgagttgtatgctaatcacaaatgtaatgtaaagcattttagtttaaaccttttgatgtcatttaactgattacaatgccaatcattcatctaaatattgaaattagtcatttttgctaatttaaaaagtcttccctaaattttttattgaaccattaatcagtcaaactcctaaggaaaatgaagacagtttttgtagtctaaccaagaatcaaaacaaattctgcaactcaaaatgctttgaggaacagaaaagatattgggtggaaaaagatatctagctttgagtactaatattcaaagttaataacagtgaatgactataatgcaattaaatgggttcggtggattataaatatattgattataaaaatattactataaaattgagttaaccagtatttattgagtactcactagggttaaggtagtttttaaaattattagctataaatcatattagagaataaaacaaagtttggaaattactatgtcatcatcaacttaatttgagcctacagtgaagagctgttaggtaataaagaagaatgtctttagggtatatcaaatgggcttataaaccaaaaagttcttgttcttctttataaaaatagccaatatttattttgtgtttaccatgcaccaggtactgtgctaagcactttatggtcaatatctttttcagtatttccagaaaccctctgagggcagtactgttattgtaaaagatacagaaactgaggctcagaattgttaaaatagtttgcttaaagtctcatgaagtaagcaacaaagacagaatatgagcccaggcattatgactctacatcccattctcttgaaaactggatattagaaatttggtaaatataagattaacatcccctttcctattatttgtgcaatatatctttttttctgtacataagcaccatcttacataaactatacataagggcaaaggtttgtaaatgtgtatcaagaaaattattatagatcctggcagagaagtcagagaacagagaaaggtaaacagcatgcaaggaaaaagctataaaagaaataaagatgagaggcagggagaagccaccaggaaaatttttaaagagatacatgacaagacccagttcagacagatttctggcaatgagccctgggaataaaagcaactaatttggaagtatcaataccatataaagtattgtgatttagtataaacacaacagtagtgctcagcatactatccacagcaaaagacatttatcttcactctttgcaagtcttgaaagagtaacaaatttctgaaagggaacaaaagagagtggggtcttgtagagaaactcatgtttataaggacctagacaagagatgcatcaggattaagaaataaaactgtgtaccaataaattgctcatgtgaataggtatataaaccaaggttcttcacatgtaaataaaatagttcttatgctttaagccaatggttctcaaactttagtatgcataaaattaatctggatggcttgttgaaatacagacgtctgagtctcatcctcataatttctgattctgtagatctggggcgaggcctggaaatttgcatttctaacaggtgattgccaatgctattggtctgggacaccatctcttgaaataggtaaggatgatgttgctaagaattgaagatgttatagaaaataaagtgggagatattttactccattcatctagtttatacaggcattctttccagtttttttcaacttttattttagattcaaggggtacatgaacaggtttattaactgggtatattgcatgaagctgaggtttgtgatatgattgattctgtcacccaggtactgaatataatacccagtagcttttcaaccttggacctctccctacttccctctagtaatcctcagtgtctattttcatctttatgtccatgtgtactcatcgttcagttgccacttataagtgaaaacatgcagaatttggtttcctggtacttcgttaattcacttagtataatgaccttcagctccaccttgccacaaagcacatgatttcattcttttttatggctgtgtagtagtccatgttatatatgtatgacattttccttatccagttcaccgttgatgggcacataggttgattccatgacttcgctattgtaaatagtgctgtgatgaacatgtgagtgtatgtgtctttctggtaaaacagtttattttcttttggatatatacccagtaatagcaatgctgggtcaaatggaagtttggctagtggtctatcaattttgcttatcctttcaaataaccaacttttggttttactgattatttggatgcatttttgggtctcaatatttccttcttttctgccgtgattttagttatttcttttcttctcctagagttgggtttaattattgtttttttagtttttctaggtgtgatgttaggtcattaatttaagagctttctattttttgaggtagatatgcagcactataaaccttcctcttaacattgatttttctgcatcccagaaatttttgtatgtgtgtatctattttcatttatttcaaataattttttgatttctgccttaattttgttgtttacccaaaattcattcaggagcaagttgtttgttttccatgcaattgtgtggttttaaaagatcttcttggtattggtttacagttgtattccactgtgacccaagagtatggttgggatgattttgagttttttttaatttatcgagacttacttcctgggcagatcttggagtatgttccacgtgcagatgaaaagaatttatattgtgatgttgatagatggagtattctgtagatgtctactaggtccaatttgtcaaatgttacgtttaagtccagaattcacttgttaattttgtaccttgataatctttgtaataccgtcagttggtccccctctactattgtgtggccatgtgaggctttttgtaggtctagaagtacttgttttatgaatctgggtgctcaggttcatatatatttaggatagctaactcttcttgttgaattgaatcctttaacattatgtattgtccttctctgtcttttttttaaaatcgttattggtttcaagtttgttttatctgatataagaatagtaacttctgctgttttatgttttccttttgcaaggtagatctttcttgaaccctttactttcagcctatgtatgtcattacatgtgagatgggtctcttgaagacagaggaaaaatgggtcttgtttttgtatacaacttgccattgtaagtcttttaagtgggttgtttagatcgtttaccttcaaggttaatattgacatgtaagcttttaatcttattgtgaagtcattagctggtttctttgtagtttctattctatggttgctttataggtcctgtgggctatgtattgaagtgtggttttgtggtataaggtaccactcttttttttctcttttgagatagggtcccgttctgacacccaggatggagtgcagtggcatgatcataggttattgcagccttgacttttcaggcacaatggatcttcccacattagcctcccaggtagcccaggtagctgggattacaggtgcacaccaccatgcgcagctaatttttttttttttttttttttttttttagagatagggttttgccatgctgcccgagctggtctcaaacctctggtctcaatctatccactcacgttggcctcccaaagtgctgggattataggcatgagccacagcacccagctggtattgctttttcctttctgtgtttaggaatcccttaaagatctcttataggctaggctagtgatgacacattcctttagcagttgcttgcctggaaaagatgatgataacaatcctttgaaagcagttatacgttcctgcttcatgttcccctggttttcatcatagtttttaatgttatttttcttaaaaaataatgttgtccccttacaggacagttagtaatataattgtatagcaggaataatttgtatcagttatgatggagttttcattccctggaagtggttaagttcaagatgtataattatttttctatgttttacctgaaatcctacctggagtcaaggaagcagaaagccaaatgaatcttaatggttcataaacagactttctgactttctttctttcttttttttttttttttttttttttgagatggagtctctctcttgtcacccaggctggagtgcaatggcacaatcttggctcactgccacctccgccttccaggttcaagcgattctcctgcctcagcctcctgagtagctgtgattgtagttgcctgccactgcatgcagctaatttttttatatttttagtaaagacaaagtttcaccatcttggccaggctggtcttgaactcctgacctcaggtgatctgcccacctcggcctcccaaagttctgggattacaggcatgagccaccacacccagcccccataaacagactttcttagggtaggaataatggctactctgagtcctacactgtcttttctaatatcctttctgcagatgatctctattgtatcaattgtcctttatgcaccaattattcaaaatttatatctttgactcgaatatctcctcttagccccaaactcatatatccaattgcctactgaacatctccacttggctggctttctcccttttacgtacccaaacctgaactcataatctcaacctcattcctaaacttattctccctccttttttcctgtctcagtaaacagaagcactatgtgttcatgtgcttaagccagagatttaacagtcatctttgatactttcctctttatcttttaccacatctaatcaatcagtaactgcagttgattctctatcctatacattgttcatgtttatttcaagttgcataatggctcccaaagaggtccatatcctaatccccagaacctgtaagtatgtcactttacatggcaaagtgttgcagatggatattatgtggctaatcaactgatattaaactagaaaaacatttctttctttattcctatgaacctaatgtaatcacaagcacctttacaagcaaaacagggagacagaataggagaatttgagaaagatacagctatagtagaaaggcacagagagatacaacattcttggctcagaaaataaaagctaaggtatgtgtgtagcctctagaggcttgaatgggcgaggaagctataatgactccatgttccttcttgcctcagagagaccttttatgtgctactacatctatctgggatactttccctccccacccactcctatgccacccccctaagccaacttctacctggctaccagggttgatataaaatattacttgcccagagaaaaactatctgaatttgcataatactagattgtatcccccctcccatcatgcattagtgttctgcaattatacattatatcactcgctactatttcagatcattaatatttgtgtaacaatttgtttacagagtttgttttctccaatagatttaagcactagagaatatgaggccagaatatatatccactttatttgttgtgatatccaaataacttgtacactgtttgaaatagagtaggtccacaggaaatatctactgaatgagcacataattaaataaatgaatggatggacaaatgaaggttaggtgaatgaaatgagaaaatacatttatatagcgtgcgttatgccagtttaaggtatattttgaagtggctatacccctttcaggtagccttttttctattcacagctagaaatttgacagaaactttcaagctgggttttcaaagtagatttgtcttaatcttgaccaatgggccagtaaacgccccagtccataagagttatttgccattctatgaccatttttctatgcttccatttttacacttatacacagacactcatcacatcaaaattcctttgaagaccgaagaaagagattgcaatcacagataaaactgcagttgcttagaagtgtgagtaaagctattttcatcagtatttctaaagagtggcataaatatatggctctctgtgcatgaatattttttaattttcttcggagctacagaagttcttttggtctcttttacatacatttaaattgaccagtatgaaatatttccccaaaaaaataaatagctaaagtccaagatgttgcatatcacagaggattatcttagtgccaaagaaaataccagttgttcatattcacactcttttctcataatcacatgtgaaagctacaattagtatgtaaaaacgagaatctcatatatatttgtgtgtgtgtttgtgtgtgtgtgtgtgttgtattaatcaggttaaaaaaacacctgactggtacaactaatggttgtgctaatcattagtcgtggtaaaaaaaatcaccatcactagtggttttttaacctgattagtacaactttccaaaataggaatatagactggaaatcatacatggaaaataaattctaatttttactgatgatgttctattggcttcataagtgaaataagcaagtaacctctgttctcagaaaaaaagaagtaatgcatatacacacaccatattcaaattaaacccacactttctcattgatatccgcatattctttaagaaagacaaaggtaaaacttaaaattcaaacacttcaaagacacagtcatttgaaagcttaccttttatgtttcattcacttgtttccttcattccctctcttattcattcattcattcagtacatttctttaaatggcacccatgtgctagacgctatgttaggcattggagaggtacttgcaaacacaacagacgtagtccctgctctcacgtaccttagaataaagctataacagaacagaatttaatatactggtagtacaaagaatatggaaaagaatattttcttaaagggaacgatatgtataaaagtactgaagtgagaaagaggtgggcattgtgagcaagggccaaagtatccagtggcaaaagatgagacatcacaaggttatcaagcagggctctgcagggcagggatggctgtgtgaactacagtagttctagaactgtgcttgagtacccacaggatgccatgggtttgggcttacttattgttagtttttacgttgctcaggaggcatgctattctcctagataagatttggaagtggaagtgtaaggatgagagcagaataaatagcctggaagggctgaggaaaggctattgcttggagggaggggagttaaagagatggcatgatccacaggaagtacagttttggcgggggaaaattgggcaatttaagcaggattttaatgacttattgttgactgatttggaggtaagctatattccatctcccataaaaattttcaaggaaataccaataaacaatggcttttcagttagaattgtatgctgttgatcggttgttatgtaacattggtatcaagatggtaacggagagcagggctacctaaggggtctccctgaaattcagagttaaaatgttaagtaacttttattatatcctcgtggcaatggtaagaaaattaagcacgggagttatctgatcttatttaccgtttaagaggttttccctggcttttgtgtggaatgaaatgagttgcagagaagcaagagtgggtacagaatcactaattaaaaggctattttagtgttcaggagacagaggatagtggcatggactagtgagctagtgatgaagagcaaaggaaagaaggatttcaggtattttggggaggtaaatgcaacaaaccttgatatggatttgatatggagtgtgaggatttgagtgactgggtagaaacatatgctttttactgagatgggatatgggaggaagaatgattccaggatggaatgagaggaggtttaatagttaagttttcaacatgttaaggttgaggtatttgtgagttatccaaatggctatgtttggggggaaactgacacaaaaagcctggacttgattcttggcaggtggtaatggtcgaaacaaagcaggtgaaagagattgccaacagagagtataaatgaaaagggaacaaagcccactgcctaaaaatggaaataaaaaaaaggctgaccagagaggtaggcggggagaacaaaaggcatgtctgaaaataaagccaaaggaaaagaacttttcaagaaactggctcatcataataatgtgcttaccagtgaggatctaaaaacctcgaatttacatccctgccttacagttgaggtaggctgaagttgggggaagggagacttgaacaaaaataatttcaacaagtccatgataagggccatgatagaagcatgtacagagtattctagggaccttagagaagcatttaattcagcttggaagggcactgaggcaaggagaaaggtagggcgggggcatccacacacagggactagaatgtacacaggcgcagtttagagagacaacagattcatttccaagaggaggccttgggagtagaagaacactgaacgtttgagggctttgagcaaaggaaaagccaaatcatatatagccaatttggcttccttcaacaattcttagttgaactctggttgacctcattagacaacttctctcattagactgagaactctttgagggccaaggtcaacgcttattcaggtttctaatacttatttgaccatgagttatttacctatctcctggggcagtttcctcacttttaaaagtagacactcaatataatgattatgaaaattaaataaagggtgataatggatgtaatgcatctcatatagagcctgcctggcacatactaaaagcacgacatatggtaggagctggtagtggtagaagagatattaatgggggcagtaggagtagtaactgtagtaatagttgaggaagtaaagtcaactgctcttgcttatttaaataatgtcttctcaaattttaggggttttgagatatatttgtcagtgtttctagtttatttttacatggagatatcatggattggtccattatgcacattgttgaaataagcttgctagtgagggcactacagcagttaggatgaatcatatttatcttttgagaatatcatgtgacattatagttaattttgagtaactaagcaataaaatccccaagtgtttcatacgtattttttagaactgaaaccaaatggtgcgctatgtattatgaatgcaccaaaggttctaataatcaagaccaccattttgcaaaaaaggtattttccttaaatacaatctatctgccttgagaaagcaaatatttatgattacacagtttttgcttttcatatatagcaaaactagtgtttttgaattatgatttgcaaataaaaaggcaactcatattttctatttttagtattactctataggattattatagactttatgtattataaattattcaggcctttataaaaatagcagaacagtatattttaatattaattttaatgatattacaaaatggacagcataaataagagatagttggaaattctgtggtaattttctcaaaaatgaccacatagatcaaaagaaattatatacactgatgtttatatgcagtcattggcaatgacattaatgatgaatagcaacttacatatgcagttaatggtgagttcaacccatcacccttcacacaggctgtcagcttttagatactctgcacaaaaatgtactgccaccaacagatatgaaaagaattgccaacatgagaggattaactgttccatttaggatgtccagctggctaatgggattcattttggtttgttgtcagattcagcctggcatatttaatttttgttctcttgaaagtatagcttctcactgagattctgcacgcataacaccaatgaaaatggcgtagtaaaaagttgaaaaattcagactccctgtttatctctagcaacacagctacaaagaaaatataattatagttttgcattgggaatgtatttataagggcttattggaccccagatagatattttaaccctgatgcaattcaccaagaaccatgtaaagttataaatgtggccatatgcctcttcttcactcattccctccacacgtatttattgagctgctctctgttctcagcaacagtgagcttgaccccctttaccatataatctgaaagggtctagactatttggccttttgttactgatattagttccaatgggaggttaccgagggtaagtaatcaagatacttgctggtaactggagttaaaaattgaacactacaatttgtatctaatttcaaagatggttctccctcaaattcaatttataatgtcatttgattttgattattttttaatgataccaaagatggatttatagatggaagaaccaggaaaagcaaaagctagtccagcaggtgaaatgtcagaaaataacgaaggattgccaggatagaaatcagaaaagctaaatggaaaaatgagataaatctgctaaagatacaaataaatgatatctttaaactccttaaatatatcaacaaaaaaagataaaggaaatatgtcttctgcaggagatagagaagggctcatagctgcttctaataattcaattacattcaaaaataaacttattgagcatgactttttcctttaaactcagtttttacaaaaataaatgaaatatgaacttagaagggcaggctgtaaacccttgaggatgtgcttacagaatcttattttcttctatgttcccctgaaagggtggtattctcgatgaaattcagcctccacattttattggctgtatttccttgggcaaattcacttttctaaacctcagtgtcacaaattatgacacgggtggtaggaatttaaatgagataatgaatataaagtgcttatgtcagtgccaggcatatggctaatgcctaataaatgataaactggagttttattattttattccatgtatttctttatcaatcaattgggttcattggactacaaatccctgtaaatcaggggctgttatttatttttgtattcttagcatgtaacagagtgcctagtacattgtacctactcagaaaatgcttgtgcaacaaaactgcacattctgatcatccatcagccttaaaggcctctatcaatttctaccaatctgcctaaatttgactttcaagatgcggcagaaataaacattttcccaaaagctttccatggactccagtccacctaccaaatacaagcacagtgagttgccctgtctctgtatttcagttgtattttattgttttctgcactactccaaacatgaggacattgcaattatttgttcatgtgttcatgttttccctccaattaactcatctttttatacttagaatttataccgtggcttgtatgtagataactctcagtatatattggtttgattaattgttaattcattcattgattcatttaggggtttattattaaagttaattattatattttctcttgggattctaaagacataaagagacaacataatttaagttgtgataaaaacatttacattcctgtttggatatgtgttatcttgttaggttggatataaaagtgtttttttttttttttttgagacagaatctcattctgtcattcaggctggagtgcagtggcatgatctcagctcactgcaatgtccacctcctgggttcaagcaatcctcctgcctcagcctcccaagtagctgggactacaggcatgtgccaccatgcccagctaattttttatatttttagtagagatggggtttcaccattttaaccaggatggtctcgatctcctgaccttatgatcctcctgcctctacctcccacagtgctgggattacaggcatgagccactgcgcccggccagaaaagattttttaaaagaattatatttaaatccctcagataaaacaagtgtgcctcttaccataaaattgtgagaactaggttagatcactttcctaattttcttccatcactaatagtcttaaataagcaatatattcattaaatatttactacttgcccagcacaaactaatatgacgagttttcttacacaaagagtaaaatcaccatgagtattactctctcttctgctttctgatattggtgacaattttaactgtgctgttttctgactagcaaatatggctatggtcacacctgtagttgctggtattattttgtaattctttcatctttcattcgggtttatgatctcttgtttctatttggtttcaatcataacttataggttgattttaaatgatggtccatcatctgctttgttagatatatctctgctgttctttgagttaaggtctggtttcattcctgttcgtaatttattgaatactggtacatgatattatttgtcaccattatctggaagttcagtgctatgttcaggggcatataaaaatgatactctcaatctataaatcatacagtattgtcttaactttggaataatgttttgttgaattaggaaaacagatgtgactaaatcatccatagctcaatgaagatcagattaaacccaggattgtcaaagcagacgtacaaaagaacaaccatcagcataacactggtcttgggaatttgaaatactttgtccttgaatatggtattcaaggctggctatttcaatcttctgttcaatataaatggaaataaaatttcttcatatatcactccttatggcagtggcatttttacatcttttctaaagatcacatattcatctgtatttggacttagagcctgccagaaatctgatttatgccagttcttttgcttttcttctaatttagtttgaggaattaaaatgaactttgctctatttcccttgaagattatattttcaattctggaggaaaaaatgacctattttatgcttatgttcttttaatttattttagttttttgtaataattgacattaatcaatctagtgataaataaaatcattatacaaaaaaaatcatatgaataataaatttttactaccaggacaatatcacaagtgtgttcacagcactttcaaagctcttcctaaacaaaggtaaaaggatcatcatttgcttaaacaaactatgtgtatgcccagtatggatttattacaccattcagttataaagagaatgaaaataaatatgggcctggtttccacattgttaaaaaaaaaaaataaagtaacacagaagaaacaaacacttgggaaaaaaaagaaaaataatatgtcattttatttcacctttcttatttagattggacatcaagaaaagtctatggtaatgtgaactccattacctgcaaggaaaattagagaaattaaaatgaattcagatatttttatcattaacagtttaaaataaaatatatacttacttaaatatgtatgtttacatatatgtaatataatagatattttaactaaaacatacactccaggtataaatacagaattctatggcatataaaagatttaaggtaaagacaaggatgtgtttttatattttactaaagaaagatgttttccattatccatttctcttttatatgtaaatcattcttccatcacatgtgtcaaatagtgttgcacaaaataaaatgtaaatatcaattttaatattcaggctgttttacccatataggaggcttataatgtgaaattcctactgtgaaccaataattcaaagagtttcaaatataaatttatttcaaattggaaacataccagaaactatttattcaactattaattcaatttaaaatgtatctactgaacactagctatgggccaggtgctatgctaaatataggaactctcatggggaagaaagcaagaaattacacaataaataaattctaatttaaatacctagatgataaatgaaaggatgacattcatttttatctgattaaatagctatctcaaattatccatgtaatattatctaaataaaatctcagggaagttggtgactgtgtgtgtatgtgtatcaagtgtcctggagtaaaaatcacaaaacctggaatctagtcacttattgagaacttgggcaagtcagtttatcactatgagcttcagttctgctggtaaattgccatacattatcaggccggtatggaaaatgcaattaggatatgattaattgaaatacattataaaaagtactttaacaaaattatgcaaaagatgatgtgggagcaaagagagtaaagcattacccatatttcttaatcattctgcccacagtgtaaagggtggttttgagagaactgggaagacagccagggataccagtcaaaatgatggaaatatctaggtgagtccctaaatattgacactggcgatgaacttgaagaataaaaaactgacttgagagatattggaaagatagaattaacagaacttagttgacaaaatagatgacggaaagggaaatgaaggacagagagtcatctggattcaacttgggttagggtgccactcattaagatagaaacatgaaagagaataaaataagggagatgagaaaatgagcaggttaagaagagttgatttaagggtacttttaaaaatccaacttgaaatgttctgtaggcaagtggatatatagtcctggcactaaggaaaaaaaaaaatgaaccgataccaaacatttttgagttaacattcactgattcaataaatactcatggagtacctactatgtactaggcgcttttctaggtaccgggaactcagcaatgaacaaaacaaagtctctgccttaaataatttgtattgtatcagggaaagtcagatgacatttttgtaaagaatgtgatttgtcagattgtgttaagtgcaatggagaaaaaaataaatgggtaaatggaatagaatgccaaaaaataggaattaggattttggcttcatataatacaatcagaaaaggcctattcatttaagaaacagcaaacagattactatggctgatgatgattgagtgatggggagagcggtaggtgatgtggttacagagctcgtaggaggacagaatgtgtgaggtcttacggtcactgaaggactttgatttttcactttgagtgatatagaagcctttcaagtgttgaggaggggatcatgatatgacttattctctactggattgctatgactactgggtgaagaatgaactgaaggagcataatggcagaagcagaaggacaggttagaatgctattgtacaaattttaggcaagaaataagggtggcttgaaccacaatgcttggtagtagagatgatgagaagtgatatctttctagacgtatttggaaggtagaaatgacaggattttctagttgactggagtttgagtgtatgggaaagaaaggaatgcaagatgattctagaatttttgacctgaggaattgaaacaactaaaagaataaaattagtccttattgatggaaccatttgcagaaaaaagtagatctggatgactgaagaatttaagtgagaacctaatataaataagaatatttgaagacagttaaatatatacattggtagcaggagatgtagtcacagggcagagatatggcataatcaccatatagattataattaaagccccggtttagctcaccatggaatttgtgctagtgaaagaaattgtagaagtaccacacttcaaaatttgaagtctttggaaataaaaatatcagaaaaagaaactgatttacatagtcatttagatagaagaaaacaaaacagaagtcaagagcagaaagtatttcaaggagaagaaaagaatcccttgtgccaaatggtgctgatatgtcaagtaaagatgaggacacagttttgaccatagcattttagtaacatagaattcagtggtaaccttgacaggagcaggcgcagtaagccagggacaaaagtctcattagggcagtttcaagaaatcataggataatggccaggtgtggtggctcacgcctgtaatcccatcactttgggaggccaaggtgggcagatcacttgaggtcaggagttcatgatcagcctggccaacatggcaaaaccctatctctactgaaaatacaaaaattagccgggtgtgatggcacatacctgtaaccccagctactcgggaggctgaggcaggagaatcacttgaacctgggaggtggaggctgcggtgagctgagattagcctgggtgacaagagtgagactctgtgtccaaaaaaagaaaaaaagaagaaagaaaataataggttaatatttagagaaagcaagttgtagactcataaagaagagaagaaactgatggctaagaatataatccctggtgcaatgctctcaagtatggaatggctgacaaatcctagcgcacagtagaaaggttagcccagcagggtgtcatgataagttatcaagagaaagagaggaagtagagtagaaacaagggcatcccttaacagtgaagaggggaagagatagaaagtttgagccaaaagaagttggtgtgaaataattgcctgaaagagcagaagaataaataaaccagtgatctccaggcagtattaggagcttacttgagttagtgctcatgaattttaaaagaaatatgccaacatggctttgtatttttctccagctgtgtttaactgtatgggtgcaggcatagaggaggtggagagttcaatttaaaatagaacttcaggttttaccaagtgagtatgataaatgtaaagagggggaagtaaaagaggcaagaacataggaagaagtggttatgataactcatcatggaatttaagctagataaatagatggcaaaggacagtgagattaatgaattgttggtcttgatgagattaaaggcttgttggagttagggtacagaaaagggtgaactagaaggatggagttgaagttcaagagtaggatatttgcaattgagattatcagggggttttaattactagtaaaggaaaggccaaaggcctgaccagaggcgtgaagagccgagatgagttagaggacagaggagggtaagaaactgagaagccagagaagtagaataattatctgggatattaaaatcaccaagaattaagacagatagagtgttagaatgaaaaacggcaagctaggagctaaaattttcaaggaatgaaagtgattaggaagaaggttactatataattctaacacaaagtgtcagttggggctatgacctggtgatgtaagagtcaaagttgaatatttttagtgaacaggaaatgagatgttctggaaagggcagtgagaagcaagaaagtcccccatccttcagctgccatccttatgggcatgagcgttgtacagaaataatgttcacatcaaagggctaacagggaagtattgtcggcaggaaaaatccaggtttccattggaacaaaatggtcgaggaaaaattgaaagtttgcaaatatgacagtatggtgatgactgaagcttcatttccatagggcacgtggttggggggaggcatgttaaagttggagaggggtagaattcggagtctaaaaaggcaatacatacagccatgtggggattaaagtctagggaatgaaagacgacttgggagtcttgcagttattgtgatttcaaggagcagggaacagggaaaaatgaaattagcccaatcctgagggttccaaggcagaaagtgttgacgagactgcttgttttggaaacagtgaggggtggggtgccctttgaggaacacacgaacagttgggacttcctaacttctgctttgtggctagcagaaggacaatcctgagcacaggggtgttcttttgacctctcttaatagtggcttgcagaaggagaggtatttagcacattctcagaagagagaataacaacttacctctatttagtccctaatgcattttgttataattttgtagcagtcttctcagagtgaaaacatcttgaaaacctaggaatattaattttgtttcccagtgcttgtcaaagtatttggtacagagtatcctctaagtcaacatttgttatagaaatgaataaaatagcgtaagaaatcctaacctgacagggttattcaagtgatttaactggtgattaagttaggtagcatatgtgtaatttatggtaagctgaaaattcttatatattatgatgggtaatttgaggtgtcaatttgactggattaaaggataccttgaaagccagtaaagcattatgtctaggtgtgtctgtgagggtgtttctgggagagatttgtgtgtgagttggtgggctgacaggaaagagctgccctcaatgtggatgggtaccattcaattggctggggtcctggatagaacaaaaaagcagagaggaaaggcaagtttactctctctttcctggagctgggacaccctttgtctcttgcccttggacatcagaacgccaggctctctggcctttggacttcagtagacccccaagttctcaggctttcccctcagacggagaattacactatcaccttcccttccctggttctgggactttcagacttgaactgagcctcactaccaggatttctgggtcaccagcttgcagatggcctatcttgggacttgtcagcctccataatggcataagccaattctcctaataaattccctctcacacttctatgttatccgtctgtctgtctgtctgcctatctgtctatctgttgatctctcttctatctttctctcctgttggttctttgtctctggagaactctgactaatacatatgtagattgagcatccctaatctgaaaatccaaacatactaactgctccaaaacccaaaatttttgagcttctatatgaaactacaaatagaaaatttcgcacttgacttcatgtgacaggttgcaatcaaaatgcaggtgcacaacataatttattcagtgtctccaagcggttactgtatcaagtaaccttttaatcaaaacacagcatcctaggtgtagacagaaagcttggcattttttgctgttgctgttgttaacagctgacacagatattcctgggatgctactgtgtttcttggttaccctgaacacattattttttcactgcattaatgatgtcattttttttttactgtaaagtacttatatgtgaataagttcaggaaagtgattacatattagtagaatataaattcaaactgagtaattattatggtgatgccaaacaaccacagattgtccacgtggatggctgagaaaatgacacctttgctttctggtggttgactgtacctaaaccttgtttcatgcaccaaattatttaaaatcttgtataaaattatcttcaggctatgtgtacatgtatgaaacataaatgaattttgtgtttagacttgggtctcccaaaatatttcagtatttatatacaaatattccaaaatctgaaaaaattcaaaatctgcaacactactggtctcaagcatcttggataagccaagggctactcaacttgaacatacaatgtaatatgtatgaatcatttcatcctagttttatgttttttttctagtcatgtttgaaaatgtatctgtaacattgaaccaagcttcattgacgacatctataaggaaacattactttcctctcccttattatctcagtattaaacacatttggtgagtattctaattgttaaagccagctggagcctgaaaactgtaaatgccagtccctgagtaggaggtaggatcttcctactagtcaactctagccattgacaaacatgaactaaactcagaaaaatgagactcgctgggcaaaacctagttatactaggaaagagaacagatctctttttctcttgggtcagattttaaagactccacctgtgcaggtctgcagtcactcctggacagaatggcaatgtgcagctggaccagttccgggaaaaaaggaaggagattccaagggaaggggagggcaatgtttatgaactacagagtttaagctatactcctctatgccagattgttagtaatatggtacccactctatttatgtattccacttttgtctttaaaaaatttagagccagtgtggcaaataaaatttagggaaggtcaggttcatctatgcatgagtcagagctttcacgggaaagggacctgaggtagccagagggatgctagcagaaggcattggtagggagagatcaggtggtgtgatttgagcttttttcctcctcaaggcatgatctcaacttgtaaacagtccaaaggtttttattatccagatgattctcattttagtgcttaccttgtatatttctggttttctcgcattaaggaaaatggcattttcttacatcattctctgtaatgattctctataacaattcctattaacatttaaaaacaacattatttctaaatgaacaattcaagctcaatcatgactatcaaattttactaaaatttggtagtttagtatctgcttcgatccatgtttcataaaccaattcaatataatgttaatgtgttctgaagaaacaaatgagtttcatggttaaacaagtttttttattttatttttttattttatattcagtgggtacatgtgcagatttgttatgtagatttattgtatagtgctggggtttcggcttctattgaaacccatcactgaaataataaacatagtaccccataggtagtttttcaagcctttctctcctgctttccttccactttttggagtcccaagtgcttactgtttccatctttatgtctgtgtgtacccactcttttgctcccacctacgagaacatgtggtatttgattttctagattaaataagttttaaaacactggattaaacagttaaacagacttagaccttcttggcgcattcaatatatgcatttgctctgactctgaaaggagatacagcataaacttctaatgcttatttaatctcagaaactcctttactggagtacctgttgccaacctagatgtcatccacaaaatataattgggaaattctaatctaggtgattaaattatgctttcttttcttcagcctattggagtgaggaatttttttttttttgagactgagtctggagtgaggaattttaagggaacattattcttgtatttcataataaagccctgtacttggttataatgttaaaaaattgattattcttcagaattcagtgtgctagtttccttccttctttccttccttcctctttttctttcatttctctatcatctgtctccgagattgatgcataccttcctctttcatactgtctttctcaagtttaggtgtcaagtttatggtaccgacttcacataataaattagagacctttccattggggtcatatctttaaattctgtcttttttaactagattcaataggtctttaaactctattaactacctgtgtgattatgagaaagtcacttcttgatgtctcatttttgatatatgtaaaactcaggataatcatacctactttgtagagttcttgggaagagtagacaaaattacgccgctaaatcacttagcacataaaatgacatttaacaccaaacgagtattagctactgtcgttaccattctggatagcatacagctggtttcttccaccaaccaccaattatatatgtctttattgaagtcatgtttttggtgtgcactggtttggtattttcagacctctaacccatttgctgctcattgatcactaatctcttggctctgcaaatgatgatgcgtttaaatttctgatgagtgactcttacgtaggtaggtgttacacatttgcaacatgtctgaacacacggtttgtatttaaatggaaactgggacttgacaggagcctctggggaatcatcactacctaataggtttccttaatgaccagtcaattaagaacttgtatttgcaaagtgctttgccatcattgtttttctttcaattctctgagccattactatcatcttactgatgaaacagagatacagaaaggcttattgacttgcttttggctacatggcctgaaattccagggactctagggatttaggtctcaaaaatcctgcagttctaagcaaacagggttaggctttctcaatagactcactcaagagacagagaactaaatgtagcctgctcacaaaccatgagaggacttaagggcttttggtctgtaaaagagttctgtgatcgtccccaaatcactccattaatagccgttctctaacagtcatgatttgctcattaaattattcaccagtattagaatcagataccatggaatagagaagttttatcttaatgtgtgagatatttcaggatgagtgttacaagacttaattcttaagtaaaaagcgagacattccctttagcttctctgtaaatgtagtaaataccgctgtataaatataagcatgggctctttgtagcctgcaaagcagattttgtgttttatgtgagggaaataacaatcagtaatacttagggttttgaattcagggtttgattaagggtgactgtattacaatttttctcatctaaatagtgttcattaaatattagaagaaaagagctcaaaatgtaggcagtgattatgtctaaatgttggaatcatacaagatctttactttcttccgtacacatttttacaattgtcatatatattataatgaattgccattacttttatattttctaatcaggagtacacacacacaaaatttaaataccctttgtgtttttataacattagatctatgatttttattataaggagggctgagagtataattacagaaacagcctgttagcttctcttaagaaacattctctcattatttcaagttttgttttcccttggatctcagctttttagtgacaaatgaaataagtattatgtcagtttgtaacaaattattcatttcaaaataagaactccacagaacgtttaattactattctcagcgagtagatcatattcactgttgaaaatataatatagttagaatcttctgtttgggcattttatacacaagataaattcattttttcctaataatttttacctttaagctaatgtaaagggatataaatgattaggcaaggtgacttttaaatgttgtgaacaatgcatgaacatctttaagtatacatattagtagaaatttattgtgtcagctctttgtaatatatttcactaagcaatgcaaaataaaataaaagatacagtctccattttcatcattgcctataatctaagccctcctcatattttgcataggctatttcagtaacctcctaaatgatctctttgctagcataatcctctgtttcacatgtaaacgtgatcatgtcttttatagtctcctcatgcctctttctctacaggataaagtccatactctttagcatggcaaacaaggtctctgcaacctggtttcatctttctgttaccttctgccagcccacctcaaatttactctggaataaggttgggctgctgaagtcccctgagactccaggcagggtcccatctctgtgcagctggcttatactattttctctccattgaatttcacgcattcataggggaaaggaatgagctcttccgtctggtctttttatctcccttcttcagaagaggagtggcttatctgacttgtaagaccagtgacagctagatctgaactgagttattgtgttaaaggtcactgttcttatggacttctcatgtctcatggtatcttgcctcagttctgcatccttaggtggaaagagtttgtcttgcccctataagttaaacctgaatcattcgaacctgcaactcttgcctgcagctgggtcagttctgctcggaagccgcgatttatacacacgtctccaccattttctccaattcaactctgctaggggagccttatatttttttgtcaaaaaaaatgcgtgtatttgtgtgtgtgtgtgtgtatcctttattgtccctttccttctattatatgtcttcatattattcacgacacccacagagaagaaaatgactaataggatttggggtgcaaaaacctgccttgaactttcgaggttctgccattctccagggactgggtgctaattttaccttatggtgggatacaggaagccttgccaggattacaatcaggttttctataaataaaactcactgatgacatttacgtcttcattttctctctagggagtgtttctaaattgtttaatttagaaggtgtatgtttgaaaccctaaagcttttaaaaatattttaaattaattctctgtaaataaaacatttctaaattacacttaacccctttatctcattcattctcctctcatctggaaggtttagccaatattagtaacttttatacttgttcacaggctctagcatttctctttttaataagaccttatccatatactcataatttttaaaaactgtaactcattcctttgtttttaataaaactctgagcactctatctctgcagctttgagatacctgcttagtttataatccaagcttgtcccatagttgtttggtcttgtacatattgtcatttaatatctcagcccccaaatcagtatctatacatggagaagataatacaacttcaaaaggagagttgctctcagggctaagtgccatggctgtgctgtgaaaagtttgtatattttaactcatgtttcaatgtgaaagacaaatagccatagcctctttctcttttccctgcccttccaagctttaacaatatatctctttcaaggacagtatgcagggcactcactgttcaaaatacactttgtcaccccccaaaccggtgtaactgagatctgctaactaactccctttgatctcaagtatttgtgtgagtcgtttttgccaccactgccctgttggcctctttggtgtactggactaatgtgccttctgtgagatgcatgaagcccccgggccaacaaataacaggaccaatggaaagtatgaaaaattacaggtcagatagatatatctaacaaacaaacacgtgtggataatggaaactgggcactcttgtaacatatagggagtagtctatgctcttgctctagcatccttgtcacttatcttgcggtgtaaatatttatttgattgtttggtagtgcggttcttatttagtaataaatattttggcagcatgagctaacaaaaaaaaaagaatgtttaatgaaaaaattaagtactgaatttataattcttaaagaacttgatgaacatattagtcgaacaaaatatttgtagatacttaccaagaggactgctgagcacttgaaaaccagggggcagaatgtgctgatgaaacatcagcgttttttcaaaagttaatagattttaggaagattatgtctaaagatgacaatttgacatgtgaagctgctggctatgcatttgcatattactctgtgaagcatcacttttcatttagataaatgtctgttcctctaaactaatttcattcattttctgttccaagttttcatatgaaagtacaaaaagtgaagcaattgctgttaatgcgttgccttcattaacagcatcagaccttgaaaatagctaaatgatactggttttaaaacaatgcagtaaaattaaatatcaattaagtttattcaaattgaatcaatatctgtcttcaaaaccatggaattgaagtatagctctttgtgatccattctgttgaagatgaaatatctgacaccataataaatgctatgataaattcagtttaaaatgtaaaaaaattaaaggaaaagtgtttgcttttaaaattatatttattgaattattttgaaatgataaaataaaatatacatttgggtgtagcacaatgtcatggcacaaatgatattaggaatctcatgggggccaggtgcggtagctcacacctgtaatcccagcactttgggaggccaaggcaggcggatcacgaggtcaggagatcgagaccatcctggctaacacacagtgaaaccccatctctaataaaaatacaaaaaaattagccaggcatggtggcgggtgcctgtagtcccagctacttgggaggctgaggcagaagaatggcgtgaaccatgaggtggagcttgcagtgagccgagcttgtgccactgcattccagcctgggcgacagggtgagactccatctcaaaaaaaaaaaaaagaaaagaaaagaaaaaaaaaatctcatggggtagagctcttctcaaaatttatgtagtgcacatttaagttacactttaatccaaacaaactgtgatattctaccaatataaacaggagaaaagtacttggtgtggagagaaaacagtattatgaaaatatttagtctcaaacatttatgcatttcaatagtaactgcccctccaacagaattgaggatgtcttccatttagcagaatgcgcttttgcatatcaggtaatttatcacctatagagagaagatttttctcaattaaatatattatgatctgcagaaaagttccatgtaatatatcaagaattttaaaaatgcattcttcagaaaaatacaagtgacgaggcattagacacatatatatgtaagaaactgagtaaaatatatggctttgtatccagaattattattgtgcttgcttgtgttattttaaaatttgcataagatcaatactaagatttcaaatttttttctttaatgtgtatggccatatgttcaatttttgaaagaattttatttttgaaaatggcctttaaacagaatgattttataggtccaccgatattataaaactgatttgtcagttaatctataaatatttcaaaaactctataattttagttattttttgtgcctttttttccctctcaaaacttttctaatttggattacaaatttttacggtcagtcctcatacacatggaatactcggaaaatcagtaaaatgtcatcaacacaagcagaagaacaatcaacaaaacacaacttagttttctagctgaactcggctaaggctttttgcctgttcttcgtgaggaaaaactagacattaacaacaatattgcattgttatggatttaatctttgtgtctccgaaaaattcatatgttgaacacttaccccctaatgtgatggtatttggaagcagggtctttgggagacaattaggttttaatgaggtcatgagaatgtggaccccatgaaggaattagtgagcttataagaagaggaagagagaccagagctctctgcttgaggacacggtaaaaaagtaaccatctgcaagccaggaggaaggttgtcaccaggagccacattttctggcaccttggtcttagatttcccaccctttagaaccatgagaaataatgtcaatcatttaagtctctctgtctgtggtattttgttgtatgagcccaagctgactaagacatccattttataattaatttagttgttgtaattgttgtgtgtaattaaacttgtataagtaaatgcacattatacttattcacaatgtaagtggagttcatggtatgtatatgtgtatatggtataaaatataccatgtatgtttattacataccatgttccaggcattgtcctaggtactgggaaacagcagtgagcaagagacaaaaatcttcattgagtctatgttctagtgtatgcgtgaaggggtagggggagacagacagttgccaaaatgagagtaggagattatagaaactctagttagttatggcagtgaaggtttttgggctcaaagtgcaagccatataatatcagcattctttttagaatgcttctgaacctaggtatactcctaacggggcaagcaacccggtacatcgacttataggtttccctacgttaatttgaacagatattaccaacttaagtgtcttcaattttattgtcataccaggtccttaaatctattcccgctctacctatttcccagattttattaaattatcttgtgcaatttagatagatatgcttttcctcagctcaaagctacatgagtattttttttccagaaaagactgactgctacttatactttttttgtatacttaaagtattttgaaatatcttcagctacactgtgataggtttaggtgcctcttagcttcctgtgtatagtatgtctttattcctacatgaaagcctcttggcaggtgggttagccagtcctctggcctcagttctgtttaataatatctttcagacagaattctctcctgatcctatctgctagtttttctgaaactcttaacctttcacaatatgaccttaaccacgtctcctttagtcacaattttattcctggaggaaataagcaatcttcagccttgagcctctaagtgaaatcgtcaaccagacttccaccaccctgtggcttggctgcctgcctgaattgttgtgacttctacagcgactcatttgtctcctttttctccttaaccccaaaggcttcttccacttggtgcgttcttttaggctatgatcatccagcaagtcttgctgtattctgtggcgttaacaaggtagccttattacaaacagagacccagaagcgtttagagatctgcttaagtttggaaggttaattgctggcagaaccagacctggaactctggtcccctgactccctgttccaagcattttctaattcacgtactgccaaaacaaagcaaaagcaaacaaaaaacccccgctgaataaaatgcttttatgcgtgacacagaagaagtgaactgaatgtcaatatgtgcctgaagaaaggtggcccatttaggctgatgaagctgtgatgaaggtccctagttgatgaacaatatatattcattgattgattgaaaataattgacttcttattccttgagattttccccaaacgaaaactgcatgtttagtgcctccttctaaaggtatctgaatttttttcagtacttaaaagactcagaagtataacctgtattatttttcactatttttaattaatgttaactcattattaatgattctttaaaaatgtctactctgtatgagtaaaatcatctataatacaaaatgcttcaaagtatgttatagcattcctgttttacagatgaggaaactaaggttcagaaagttaaataatgtgccaacaatcagacagagcttaagggtgagagccaggatctgcctcctcagggcatgccctgagcatgagatcaccataatgaagacatcatgggttgtttttacccataaagtattaatttttaatggcttaaccacaaaaaaagtattctcataaaaaggagaacagaaagaagtaataaaaatgcaattttccattccatttgatttatgagaaacaataaggggctagagcaactgagcaaacattctaaaattagaatccagctagtatcaaataatcaaactctaatcagcaaaatcgtttacatgacacttattataatgttgctactttttgttgtcacaggattgcatcattaacattattagtaaacctgcgcaatcagttaaaaatcactcatttcctgagaatcgcagaatgttgaatttttttacgatttcagtaaagttatattcttggagtacaagtacttttaaaattatttgttcttaatcagaaggttatgtgatgtctctgataataatgtatctattttaaatattgaaaattccctttcatcaaatataaaaaaacgcttattatgttcttgcccccaaattggtcaaaatgtacagcaaataataaatcagatttgttttgatgtacttcgtattcttgttaaaaagaaaaagatttccaaactctatagaaaattataaaagcaaaatgaatttactgattattaatcaaatggcgtgaatactaacctttcttccttgaaaaataaaatgggcacacagttttggtgagtataaaaagcctttcgcaagaaaaaactatgccaaaacattatatctggtattaatgctgactataatttctggcatcataatgcctaaatgttttaaagaagctaacaaataatttgatgaccgtatataaattatattattttatgctaacttttgtttatatatggaatagattaccaggcagtaaagtattatttctagtgcatataagtttcaaatctgttagtataagtttcaaatctgttaggtttcaagtctacttaaaattaaaatgtttctctgctactgaactaagcaatacttagtaatttaattatattttaaatatagcaattttatcacatttctttttttattacactgtaagttctggggtacatgtgcagaatgtgcaggtttgttaacattaggtatttctcctaatgctatccctcctctagcaccccaaccccgaacaagcccctgtgtgtgatgttccccactttgtgtccatgtgttctcattgtttactgccgctaatgaggacatgcagtgtttggctttctgttcttgtgtttgtttgctgagaatgatggttttcagcgtcatccatgtccctgcaaaggacatgaactcatccttttttatggctgcatagtattccatggtgtatctgtgccacattttctttatccagtctatcaatcattgatgggcacttgggttggttccaagtctttgctattgcgaacagtgccacattgtccagcctatcattgatgggcatttgggttggttccaagtctttgctgttgtgaacagtgccacaataaacatacatgtgcagatgtctttatagtagaatgtgttataatgctttgggtatataagcagtagtgggattgctgggtcaaatggtatttctggttctcgatccttgaggaatcgccaccctgtcttccacaatggttgaatgaatttacactcccatgaacagtgtaaaagccctccaatctctccacatcctctctagtatctgttgtttcctgactttttaatgatggccattctaactggcatgagatggtatctcagtgtgggtttgatttgtatttccctaatgaccagtgatgatgagctttatttcatatgtttgttggctgcataaatgtcatctttttagaaatgtcttttcatatcctttgcctactttttgatgggttttttttcttgtaaatttgtttgagttctttctttgtagattctggatattagccctttgtcggatgggtagatcacaaaaattttctcccattctgtaggttgcctgttcactctgatgatagtttctttggctgtgcagaaactctttagtttaattagatcccattagtcaattttggcttttgttgccattgcttttggtgttttagtcatgaagtctttgcccatgcttatgtcctgaatggtattgcttaggttgtcttctagggttttcatggttttaggtctaacatttaagtctttaatctatcttgagttaatttttgtataaggtgtaaggaaggggtccagttttagttttctgcatatggctatccagttttcccaacactatttattacatattgattcctttccacattgcttgtttttgtaaggtttgtccaagatcagatggttgtagatatgtggtgttatttctggggcctctcttctgttccattggtctatgtatctgttttggtaccagaaccatgatgttttggttactgtagccttgtagtgtagtttgaagtccgagagcatgatgcctccagctttggtctttttgcttaggattgtcttggctatatgggctctttttttgttcatatgaaatttaaagtagttttttctaattctgggaagaaagtcagtggtagcttgatggggatagcaatgaatctataaattactttggggagtatggccattttcacaatattgattcttcctatccatgcacatggaatgtttttccatttgtttgtgtcctctctgatttccttgagcagtggtttgtagttctccttgaggtccttcacatcccttgtaagttgtattcctaggtattttatttctttgtagaaattgtcaatgggacttcactgatgattgggctattatttgtgtataagaatgcttgtgatttttgcacattgattttgtatcctgagactttgctgaagttgcttatcatcataaggagatttggggctgagaagatggggttttctaaatatataatcttgtcatctgcaaacagagacaatttgactcatgtcttcctattttaataccctttatttctttctcttgccttactgccctggagagagcttccaatactatgttgagtaggaatggtgagagggggcacccttgtcttatgctggttttcaaagggaatgcttccagtttgtgcccattcagtatgatactggctatgggtttgtcacaaatagctcttattattttgatatgttccatcaatgcctagtttatttagagtttttagcatgaagcggtgttgaattttgtcgaaggccttttctgcatctattgagataatcatgtggtttttatcattggttctgtttatgtgatggattacgtttattgatttgcatatgttgaaccagccctgcatcccagggatgaagctgacttgatcatggtggataagctttttgatgtgctgctggatttggtttgccagtattttactgaggcttttcacatcgacgttcatcagggatatcggcctgaaattatctttttttgttgtgcctctgcctggttttggtatcaggatgatgctggcctcataaaatgagttagggaagagtccctctttttctattgtttggaatagtttcagaaggaatggtaccagctcctctttgtacctctggtagaatttggctgtgaatctgtctggtcctgggctttttttggttggtaggctattaatttcagaacttgttatcggtctattcagggattcaacttcttcctggtttagtcttgggagggtgtatgtgcccagaaatgtatcaatttcttatttcttctagattttctagcttatttgcctagaggtatttatagattctctgatggtagtttgtgtttctgtgggatccgtggtgatatcccctttaccattttttagtgtgtctatttgattcttctctctttatcagtctggctagtggtctctctagtttgttagtctttttaaaaaaccagctcctggattcacagattttttgaagtttttcgtgtgtgtgtctctgtctccttcagttctgctctgaccttagttatttcttgtcttctgctagcttttgaatttgtttgctcttgcttctcttgttcttttaattgtgatattagggtgttgattttagatcttccctgctttctttttatcacttttcttaatatgcaaattagttgaagcagtattttgtttattaaacccttataatggcatgttgttagtacataatgaagtataaacattgaaagagggaaaaaatcacatacaattgcacatactgaaagaggaaaacatatagattacgttttagaaataagattcacatggttgtagttttatatcatgataagagcaaatagttgcaaaataaaaatattttaagcagatatttaatatagaattttgaaaatccagaacccaggaataaatatgctaaaatgggcagaattctatttaaggaaatttttccagtagcattacagaaattaaataaatgtgagatataccatgttaatgaattgaaaaactcaatcttgtaaaaaaaaaaaatcccaagtctcaacagtgttttagtattggtcatgtatatttgctttgtttttgtggagcttgataagcaaattctgaaaattatatgaaagtgcgaaagttgaaaaattgtaaagattcacataaagaaagaaggtggaaaacttgccttacagaatatgaagacaactatgatacagtcttataagaatgcagaatttaaataaaatactgacaccaattggcttgcaaacacatgttatagaatggatagaaacaccaaacgaagatctgcatagttacagatgcttaagacagtggtgatattccagatctatatagataaataaaaaaagcatgtgaaaaaaggaagaaatttacccctattttgcattatactcaaaaatacattcaggtgaattaaagctctaaatacaaaagtaaacataaaatttttaaacatgatattggagaatatcttaatgaccttggagtggagcagaaaaatttaaaaagagagaaggaaaggaaaagggaggaaaaaaacaaaagtggcaaccattgaggaagactaattttttgaaaatctgtattagaattaggaaattttgttcttcaagtgccaagacaaactcagaagagaaagatgagttgtttgaactacaaagctaaaaatgatctatctagatttacagtcacacaaacaaaccaaaatcaaaacgaacaaaatggatcagggttactggaaatggagagttgttggtcaaaggatacaaattgcagttgtaagatgcataagttctggagatctaatgcacaggatagtgactgtaattaataataatgtattgcatacttgacatttactaacacagtatttgcgctacacacacaaaataacttcaaggtgatgcatatataacatttcatcttgtatacatatatcaaaacttcatgttgtttactttgaatatataccattttgttaactatatcacaataaagctgggaaaaatgcgataaagtagaaaaattggcaaatatcctgaccaagctttccataaacaagaaacttcaatagaagaagtgttcaactttattagtattagagaaatgcaaatttttaaaaatacattgtgtgatagccttaatacaaatgctccaaattaggaaacattttaataatctgaaaataccaagttataatggaacaaggggcaaccatacatgctggaagggttatatattttcatgaccactccagagacagtttggcattatgttccaaggatatgaatacccaagaatttagcttttcaacttttatgcaaatataccactaatctgttgtacatgtgcatacaacaatgttcatagcagcactgttagcactagcaaaaactgaaaaccacccacgtgtccatcaacaatgaaatgataaattcatgacagtgtattcagataatggaatactatgcaacaatgaaaattaataaactaaagctatatctaacaatataggtgaatcacataaacatactgttgaatgaaaggagtaagacacaaaggagcacatactgtgcaattctattcacctaaagctcaaaaacaggcaaaactaatatagatgctaaaactacaggaaaagtcaatgaataatcatcaccaaagtcagactggtattgcatagatttgtcttgtgaaaaaaaaaagttaaaatggtgtgtagggttgtgatcatggtgggccataaaaaaagtgtaggttttaaaatgttgccaatgttctagctcctcaccttcataatgattacataggtgttcccttcattatttctgcactcttcttggatataatgttaaatttgtacttatttttaaaatatctaccatacaccaaaactgctctattactgctaagtcacctaggttgtggatttctcagaacgaatatggatggctgtttatacttctgctgttgagctttaaaaaaaaatgatcattgcaattacattgaagagatgtagatcaatttgactccagagcttgtatttagagtttctttcatgtgtatgttctaatcacacctcagaaccctaagaaatagacattatagaacagtagaggtgaatatttcatgcattggtttaaagaacaccaacatgttagaaatttagaagaaatgtgggtgacaaaggtcgttaggttctccttctaaagataacaaggtgacaatagagcacatgccagatattacttatgccagtgaacttgctgaatatttgcagcatttcctctgaggttcaaaagacctccaaaatagacataatctagagtgattgataggcagttcccatgggccactatttcttcaggcagtgtttttttaagtactgtgaagtgcactcactttatcacaacatgtatatttcttttcatatatatactttaagttctggggatacataggcagaacgtgcaggtttgttacataggtatacacgtgccatggtggtttgctgcacccatcatctacattaggtatttctcctaatgctattccctcccctagcccctcacccaccaacaggccctagtatgtgatgttcccctctctgtgtccatgtgttctcattgttcacctcccacttatgactgacaacatgcggtgtttggttttctgtttctgtgtttgtttgctgagaatgatggtttccagcatcatccatgtccctgcaaagaacatgaattcaacttttttatggctgcatagtattccatggagtggatttgccacattttcgttatccagtctctcattgatgggcatttgggttggtgccaagtctttgctattgtgaatagtgctgcaataaacatatgtatgcatgtgtctttatagcagaatgatttataatccgttgggtatatacccagtaatgggattgctcggacaaatcacaacatgtatatttgtaacagatgaagaaagatgattgtttatgattcccagtagaaatgtagtttcatcaagagagaagagagtgaaagagtgagaaacagagatactaaatttaggaaattcattgaacagaaactccactttggactggaaatacatttctccaaaatcacaaaagagttactttgtgcacactcaagttacttctacttatggggaaaagtcaactatacattcataaatgattaacacttatgggataataatgacaactaacatgcaccgtatgccaggaatcatgctgcgcacttaatattcattacttcattcaatctttccatcactcctatgtggtggagaacactatctgcagtgccactaacgagcaacgtttgatctccctaatatgtaactaagatacaaagtagttaagagacttaagttgtataaccacaaggtcacataactagatctggatataccattatagggatccagatcagtatgactccagagcttgtattcttaagagttttcagaatatcttccatgtatatgttccagtcatacctcacaacagacattacagaacagtagagctgaatatttcatgcaattgtgtaaagaacaccaattctaaaaattatcattaggtatcccattcattttttttaattgtcaagtaagattagataataaaccaatacaattttctttactgaagtttttcatgattgggctgtgactcttcacaagagagctgtatagctagtggtattatctaaactgatgaattgtggggtccccttgaagaaggcccaagccccaatagagatgaaaatgttctaaatgaggctgtagagaatcagacaattgaaggacatttctagcagactgacttggtaaatattatagttaatacctgcagattgacattgcattctattaatgttcagtaaaacggttatatatcatagttcattcaaatatattttactctttgcaatttgtagagtatactgaaagatattttcatggatgatgttcaatattcttactagtaaatgcatattgtaagtaactttacagagagaatgtctaatcagagactaaactgacttcacatagacagtaggaagaagtccatgaagtggatttgagtcctctccttgctatgtagtttattttttcatttacaaaatgaataatacttatatcaaaaaagcaatgatgtaaataaaatttttatgctagacatacatatgacagaaggtggttattaattttagtaaaagcagaggtcagaggtctgtgcttttttagactagtaattgatatctcctctcaaggatagccctggagcttcctacacacacacacacacacacacacacacacacacacacacacaaaacaaaaaacaaaaaacaaaaaacacacctaagcattgattggtcttggaactgctcaaattcccttgacttcctaatttactcaaataagtcatcttctctaatggaactttaaaattgagagtggttcactatgctatggaggagtgaggccagcaggagacagccattcattcgtccaagtgggtgaatagggaagagtctgggctcaggatccagactccttggactctcattctggctgcctcacctactccctgctctttgttctcatctgcaacatccagacagtgaaagtaccaacgcagaaggttgtcatgagcattaaatgaactaaccgcgataaagaacttagaataatgcctgacacatattaacaccataaatgttaatgattctagttcttccatgcccaatcaatgataatgcagccactttcattatcctctatgctaattatactttattctattcactaaacagaactaactagcaatgttttgttagcctaatactagttattgtatttgagaataacaaattattattttattataaattattcataatttgaaatgtttacaaacagaaactagctggcttcatgaatgaaggcgtactgattttttaatttttgaaaattaacatccattgattttgatacaattcctccaagatattgtctagtattaggcatctgcttaagctattgcttttctcaccttgttagatataactcattcacacaactagatcaggcttatcactaccccataaaaaggataattacaatcaggaacatcaaaaatgtggcagaaacaaacgagagaactgaagagttgaaacttgatatttcatctcttgtttgctaatggtgcaaatgctttttccctcttcatattaatagtaatgagatctttgaatataatgtatatttcttggtaactgccttttttccccagttgctaagtaatatttcacctttcatcagaagagaaagatagatggtacttaacctgctttgcaagtcagagtaccagataactcaattcatttctggaatgccaaatgaggtttttattctcactagaggaagccaagggagtgtaaatatgactctagttcattattgcctttgtgcctcctacagccttagaaatgtgttagagtatattaagttttaaaacaacattatttttagagtacttggcaaaaattatctttcaaaatctctgtactaaatttcatttcgacaaattaaaaacaaaaaaattgatatttagcttatttagacatgacctttgttaacattcatttggagaatcttaaattaagattgagacataatagctaataaaaataaggagtcaggttacaacctgagtctcattataaaaattattacacttataattgtttatattatatacatatttaaacttgtttatgtttttttctgttttgttttacattatgccactcagtacagagcattctcactgtaatgttagtggtctaatgaatgttttgtatatcagagcaatatatttacatgatacagctgatctggatatgtacagatggatatgaaaatatttcttgaaggaataattcccttggatgtcatactactaatacttatcaagcaactattttctggaagtcaataaatacagtatacaacttcctacattattgctttggagtttactgtgaataccagaggtcctgaaatcaatcaatcagttgtctgacctactgcctaccacacacttcttgtttctgctgaccttgtttatttgctcaacttaatgtgcttaccttctaaccaaataatctcttctccagcccactgattatttcatttcctctgatttagttttctctgttttgaatagtttacctcattaggaccttccattatccctaaggatatttctgagtgaaaacaatcaaaatcattgctgttactcctatgtaccagacactttaaaaaggacttcatatgttttatatcatttagtccccaaatacacacatgagttattattattcttattttacaaatgaaagaattgaggcttagagaagttgcataactcacccaaggtcaaaatcctatctgactcaagtctacactcctaaccacaaaggtgagtttgaaagattctttaaaaactaggactagcctactactgttaacctacccttgtaaactgctaatgttattactgtgaacattcatagatccttattgaattttaaatcaaaagcttgagagactaagttttcatgattctctatgtccatcatttggcattgacgatatggacaatcaaaggcaaaaaaatctacttctgataacaggagaataaatagaaggagatgacaaagtgtatagttaataatgtatacttttaatgtggttctgtatttcttagtcctttgaattttatttagcctttcaattattatttgctggatttctgctttaaattaaaatacaatcttattaaaagagatagctatatctttcttattctatataccaatcctcatattacattaggctcatgaataaatagcaaatcaaatggaaaaattcatattttagttatacctaggtgaattagaaaaaaatggaggacacagcaaaagtgaacaactaaagagaagtcccaaaatacatactaaaaatataattttgttctgttctcattctccatcgtttataccataaattataacactagtactatagttgtatttcaataacagaaaagacatggaataaaaatgataaaactgctttaaaaataaaataacttggtaatttagtaacagatgactaatatgatttttgtagacatatcagaaaaccagcatgtaatattggtgagagtatggaaattagccagaagattctgtttgggtttttgaatattttagttacttgcttgcacaagttgcataacttttcttactaatttgtaaaagagattgataatccctgacctatgacactttttaaaaatcaagggagatattacacataaaagtcataaaaccataaaatattgtataaatgtatattttttacttattttttaagcagtccacagtcaatctcaggttctagttgataggtttcagctaaggagttgtctgttgaaagccggagtgcatcaaagtgaatgggaggttgggtaaaggaagaggagatgagggtcaggactagatgggtggcagcaaaaataaaaaattaaagaggcaattttggaaacattatgaaagaataggagactcagattctcatctactacaaatgaataattattaatcttgtaaataatatggttgaaggacaataaaataaagagtacatagatcttggtgcccctcctgctttcactgtactccagtgggaagtatcagatcctgtgtaacttggccctctcctctgttatcagtgtttctcacatagcaggtgctcaataagtatttactgagcaaagaaatgaataaattaatgaataggtcacagggttattgtgtcaaataagataatgtattgaaaagtgactaatgtatcaaaagagctctgttaattgtaaataatgacatataggaaaatgttattactaacttacaggaagtatttttaggtttcttagtaagaaagttccaataaagctcttcaaaaattaattgggttaccttcaaaatagtgaattccctatctctgaaagtttaaacatagaagttgaatcatcttccatcacataaccaaaataattactactgagagcgggagagtgaatgaataaggtctcatgcaattttaagattctacagtgccattaggaatgatacctaatgtttatttgatgcttgtttggtgtttgttaggcacagtgctgatcgccttgcattctattttgttaacccctaaagcaatccttgagataaatattattattacatacagaaaaatgggggctctgacaagttaaagaacttgcctgcatcataagctaggacataactaaggaaggattttaagccatatttatctaactcctgagctttcagtttaaagtgtgtatcactatgatactctgtctcataaaagagtagttttctctgttccagtttaccttctaaatgattggtgttggctgcttgatgattcaagtctctgttaccagaagcaaatcaaaagtaccatttctgatttcatgaatccctttaactaccaaatggtacgtgatgcatggaaagaagcaaataactataatatgattttttggagtgaaaaatacatttttaataaggtgtcattgatacttaatattccagaagcagtgctcaagattttgaaccaattagagatttgggcttcatctgaccagacattattacaaattttacaataatagtttagtagatgattactgcccccggcatatgaaaatgttccatgtaaacatctcattaccaagactaaatattaaagaaatgtattcctctaaaaggccctttgtgtttcagaatatggaaataattcttctgttcatttcatattattcaaggtaagtgttggcatcctaactgtatatggcctccaaataaggagttaatactaatgtattctattactccttagctcatggtaatcatgccaagaacactttttaaaattaaccccatgctctctcatgggttcatttaagaagaaatgttataagaattctttggaattagtgaaaaacaattttgtcctcctaccattaagtctgtcttcatatctaaagcagaataggcacaaaggaaagtagttactagctttgtgttaatgacttttaatttgtgtacacttaacagtatcttgaaaaattgtcttacctggtggattctctgtttggtcagatatctaaattaaaaaggcctttctctatgagtttcttggatcagttatcttagttttagagtcatatggtgtgaaggactaaaagatacattagaaatcaactagaataatttcctcattttataggtgaaagaaattgcctgtaagtgaaatgacttacttaatgacacacagaaaaatggggcagaagaagacttagaccccaagtgtcttatttcctagtttttatcctatgcatgattcatggaggaattcctgattgtgctacaatataaaatcatgtcatttccaacccttttaaagtggcatttcctgccacaacttccaaaccccgcccccaaattccaattaaaacagtacactgagtttaatattcatcaaaaacaaacaaaaaaaaattaaagtaacaatgtatttaatcttttattctttcagagagtgattaagacatatactgtgtgtaagatactgtgtgtaagagaccgtagcttctgcttaaaaacattatttaagcttaatttcaatagcaacagagaaaattggagatgactgataaatacatttaaagcaggcaaaatttgagatgttttcttaaacattcatttctgtattaatgtattcacttaacaaatacctagcactttatctgggtcaatcctcatgttagacacgagagatacaatgataaacacaaataggcctggaactgcctatttgagcttttaatataatggagaagcttatctcaaataagtatcacactaattaatgagtaataaattaggttaagtaaattaactgcttttctgaaggaaagaggtgtgatcctatgcatatgtgtaacaaaagaaacagacctagattaggactgaggtagtcaaggagaacttctggaaggaggtgacacttaaactgagaactgactgaagaatgggtgtcagctagccaaaagatagatggcagtagtggagtgaaggagctagaagtgattaaacttgttgaagaaggcatgtcaaatgccaagacaggccaaaagctaggcctcttgtggcagacagttagccaagctgtgaatgcaacggaaaagtcctggacagaatttacaagtgcatctccattgaatacacaaatgataagagtgcacaacagtctttgctgctatggagaaaattctggtggtctaggtagatcaagccaaccacaacattcccttaaactaaatcctactctagagcagagccttaatcctcttcaattctataaagtttgacagaggtgaggaagctgtagaaaaaaaaattttgaaccttgaagaggttggttcatgaggttgaagaaaataaatcatctccataacataaaatcacaaggtgagccagcaagtgctgacgtagaagctgcagcaagttacccagaagatataactaagggcattgatgaaagtggctacactaaacagtagattttcaatgtagacaaaacagccttattttggaagaggatgccgtctacgacttccaaagctagagaagagaagtgaatgcctggcttcaaagctgattctcttgttaggggctaatgtaactggtgattctaagttgaagccaatattcatttaatactccaaaaattgtagggctcttgagaattatgctaaatctactctgcctatgctctataaatgatacaacaaagactggataacacaacatctatttacagcttgctttactgaatattttaagcccactgttgagaaatactgctcagaataagattcctttcaaaatgttaccactcattgacaatgcacctggtcatctcagagccctgttggaaatggacaaagaaattaatgtgtttttcatgtctgctaacacaacattaattctgcagcccttggatgaaggagtaatttaattttcaagtcttattatttaagaattacattttgtaaggcttaagctaacatagatagtaattcctctgatggatctgggcaaagtaaattaaaaacgttctggaaaatgtttaccattgtagatgccattaagaacattcatagttcatggcaggaggtcagaatatcaacattaacaggagttggaagaatttgattccaacccttagggatgactctgaggagttcaagacttcagtagaggaagttactgcagatgtgttaggaaagagcaagagtagtattggaattggagactgatggtgtgactgaattcctgcaatctcatgataaaagttgaagggatgaggagttgtcccttatggatgaataaagaaagtggtttcttgagatggaatctattcctggtgaagatgctatgaacactgataaagaaagaaaggatttaggatatcacatcaactttgttgataaaactgtggcagggtttgaagagggttgactcctatttttgagagaagctctgttgggtgaagtatgaaccaacagcattgcatgctacagagaaatctttcatgaaaggaagagtccattgatgcagcaaactgtatcgttgtcttattttaagtaattgccaccagttacttaaactgtgactggacaagccatttaatatttctgaataatctgagtatttgccactagtcagttaagccaccacagccttcaacagccatcaccctgataagtcagcagccatctacggtgaagacccttcaccagcgaaaagattagaactggctgaaggctcagattacggttagcgttttatagcaataaattattttaaattaagatatgtgcattgtttcttagacaaaatgctattgtacacttaaccacagtatagtataacaataacttttgtatgcattggaaaacaagacatttttgtgacttgctttattaagatactgattttattgaggtggtttgcaactaaatccgcaatagttctaaggtgtgctagaacttttcttccatagtagctgagatttaagttgtctagttagtatgactaagtttttccattaatacaaatgtctatgctcatatcttcattgactatgctcattcacaccggccttctctctgtccctaggctaaaacttattctagtctcatgacctttttacctgttatttattccctccaacaagaatattttcctcccagattctgtgtaggtatttcttatccttgaggtcttagcttactgttactgtatgaaaatacttcccccaacttttctagataaaagaacacaccacagttcctgacccatggaaggcactccacaaatagtagctaatatgtttaatgttaaataataataattgaacgccttctattagtccttgcacagtaatagccacttttaacatttctaattctcaccatacaaatattaccatctctcattttgcaaatagattattcagacagattaaatggcatgcccaaaagcttgtgacagtctgtctaaatataaaatctgtgtatgattttgtttgcactatgtcaattttcattacaagaaataaaatgcacaaatgatgcagttattttgggcttaacacttcataagatagtcaggctattatgattttagattgggttatccaaacaatactatcatatttctccaaaacctttctatttatggcactggctaagccctacactcaaccaacattttaacttattcttgatttcctcatatactctagtcaacaatgacttaaaattctttttgtacttacagttatcccctaccacagaaattagctcttgagtgttgtcagtaagcaggttgtttcacataagtgaaaaagggatcagtgattatctcaaacgcactgagcatgttttatattcttgcgtgtcatccatagacaaggacagttccatgctgtctatggtggagtacaaattggaagtcagaaatggcatcttttctttgctctgagactgatcttgatgagaaagaaacttaaacttcaaggcaacttcagagaaaggaaaaaaaaagaatacactgattctctgatgcttactgttaactttaagatagaaaagaaattatagaaggtatcctgaaacaaaaacaaaaaaaaaactttttatttatgggtaaataggtgaaatgtgctagaaatcttgcccacactcttctttttatacatgagggggatgaggcagggaattaaagggaggtcaattacacatgagattacaagtgatgttattgtactgactgccactgtattttacaatgccacacataaaagttgattgatgttgatttgactctgttcaaaaaaataacttgagctaaattgtggaagagctgtgaatgaattgaaacaataaataaaatgagttcttttaatattaaaaagcttagccacggtcaagctttctaattaggtcagcataatttaaaatggactaagaaccatcccaggtggggatatcaaatatttataatcttgccccggatgctatctctgtgaccttagtggtttcagaagagcacttaatgtacccctagttcctatgagatttagatatttatgcagacaacagattaaaaagaacacgcaaaaatctcacacaaattcaagaaataatgaaggttacaattctttacgaatatttgtccttttcctttttagtcagcattaagaaatactgtcaggcttcatgtccaagttaatgtgaaatgacagattattcagttcagagcactgtgaagagctacagggtaaatgattcaatgccacctcaactatgtgtttttactgaaaaagttatcagttttgaactatatccaattctacagcatatttcagtgtaggaacatctcagtggaaacgtttagaacccagtgcaaagtcactctgaaagcatttacttagctttattgtgtttggttttaatttctctctctttgtgagatcaatttctcattagtgcaaagccgaatacttccaggggaaaacgaaggaatgtatttagttgagacaggtttttaccaaactattcgaaaagctaaaagaaaaaaaaacctctaatatatagtagaaaaaaatgttataaatacgttggtttatatctagctataaatagtgttttttcaaagtatggttcaaaggagaaacaaccattaagttttcagtagctttgtactgtcaaggaaaaaccagcttattcatgttaatacacatactgtagtaccatatgtacctaaaacagtgaaaaatcataaaaaatattttagcagtggaaataaagacagtaattgcaatccagtcaaatgaagttaattcaaaatgcaaacgcagtttgcattaaaactaataatattaaaacaaatactattaaaactaatagtagttactgtctctatctgtaactttcactccctgccacccaactgtagttagatagccagagatctcatcatgaaccttcatggggaaaaaaaaaatgtggtctgataaattaattacattaaaaaaagtgattaatcaaataccctgatgaggaaatggagaacatattaactaccatttgttgactacttattgtgttattatgatactcatttccttcctcaagtaaatttcagtctagggaaaacatttacaacagaatatgctgagtgctgggatactgaggagtagactagaagtataagaggacagaggaagagtaatgatgtgtgggtgaaaagataataactaggaatctgggaacattgcctaggtgtaatttgagtatcagcaaaacaataaaaattagagaatgataagtaatgtattagatatgagacttggaagcaggaaaagtcttacagaagtgaaggaaggctatttgcaaaaactcaagatcatgacaaaacagactcttcagagaccaagtagtgcattacgaatggaaaataggatggatatagatgtaaaaaagcagctgggattttgagatggaatcagaaaggcagaaagaggttatgattatgaggaatatcctatgtcatgctaagaagtttgggttttatcctgaatgcagtggggagcattaagtcagttagtgacatcaacctatgtcacactgtgaaggcatcaagaccaatgtgttgaaatggggagtggcctgataccaaaggcaaaggtagcagaattgcagtaacatagatgaatcctgatgagagtctcaaataaggtaggggaggtcagataaagcagtaataacataattaagcctaaggtgggaacaaagctacattaggcacccagtatactgaagaaacacctaaaattctggaaatcagacagctcctccagagccttgctagctgcaccagctctgcttatccaaatccttatcagcatagcattgccttccccattatgccaccttccattcctcacccctttacatatgagaatattaaagagaagggaagacattttttgcacactttagcgtagtgggggttgctaggctttttcttaacctaaccttcctacctccaaattcaaggaagagggaaggctcctagcactcatccccagaaattataaaaccagtattttatttcttgtttgagagtttgcctaggcaacagacttgccgattagctcttggccctgtttggacaggaagagaaaagaagtagagagagatgacaagacagagcagtggcaggaaagaaacctacacctccaccgtttagaaaggcaagagtatgcaagtttcccgtgggttggatggatggactttggagaaggtaggccagcatgaactttctaggctccatgagcaaaatggtagaggtggtagttgaaagaagtttagaaaagacagtgccagaggagtcgtctaagtcagggaactctgcagtaaggaggttccacagacatcacaggtgtgcttacaagagcgagcctttggaggcctgcctcagtcacagatggttctgtggacaaccagcttcacccagagtggcagctatgtcccagaagggaccacaacagaagttacataagtaagacgctggtcccttgcctgctcattctgtcctactttgatacacagagaaggaaaggaacctggaagcaggaggagaacaaatgtgaaaagagactttcctcctcacagctgcagggtcctgggtcccactctattgtcaatactgaactagagaagagaaagagaagagcaataaatcagagctaagctttacctttataacaactgaaagttatcaaaaagctatgggaccttcctggatgtccaaaagggatagaaaaatggatttgacagcatagttaaaggcaacggttagaaggagtaaaaccacttcatctttgttacccactgcatttagactctccagtaagtcagaaacaaggatatggatatcagagatacgtaaaacgtggaatagatccaacttcacctatttgttataagagaaaaaggaaagtaaattaaaacttttgagttagtagcctgaattatgttctgagctttaaaaaagaaatactctaggctttccttctctgggcatagtaatcgcacctataaaataaacaattgtatgatagttcttaaccttgttttcatcacagagtcccttgagaatctaagggcaactatatactgtctccacaaaaataggtacatgcacacatggaagtttccacacaaaatcctataaaatggaaaacattgaaatgagaagccaatttgagcaaaaagattgagtgtagctctatatatattaagcctgatatgcctgtgacgaataccttgtagagacagccttcagaaagaagacaagtctgtttctccattttgttttttgtttgtttgttttaatctcaagcaccttctgatatccagctgacaaaaaggcggcccccttcttattcttccattagagcctggaggttctgaaattattcggtcgcttagcacacaagtctctgcagtttcttcatgattcttgcagtgatgctgagccccaggggtggtggctcattaattaaagtaaattctgcacttaggctttcttcctcactttccaagtgctgtcatccttgtctctctgggtcacctcacttcttccttccagctaaactttatctagaagaaagaccatggtgacagcacagcctttcttgagtgtgtattgcccttagctgttaaaaaattttactgatcacgttaaagagtatgaatttctttcatttccatcatctgtaggaaacacgtgtcttatcttgttacccttgagtttcctcttctgtcagcctggattgtaggtcagagctgctactaagcatgtgatcttatgcaaagctttcttttgatatttacttcaggtcagtgtgcagtggctgaaaattcagtacaaatttgggaatccagcaggtctacttttaaaatcctcaggtttgtcagcccggtgtgcttcattttcttccttttcctgtattaaatgagtgtaataatatatgctaggtctttgtaagtgttaagataaggtatcaaaagtgccttgtacagtgcctagcaaatactaagggcttaataaatgttatcgaagtaaattattaccattgccttttttaacaaaaaaggaatttaaagtgatctggatctcaatgtcttcatctataaaatacagtgattcaagtatattcagtttgatttagtcctcatttattgagtatgcagtacttggaaaacactatgtaccagttaatgtgtcctttatgaagacaaaaagtgaaggaggttacgaattagtcaaggagacactgacgggaaaatatgtaacaaatcaaagagcctggttgaaattagggttctgccacttgctaaataaccttgaacaaggtagtaagtcatactgagccacatttttatcatcagtaaatgagaccaataatactcaactcacacagtggttagaagcattacatgaaacaaagttgggaagaaaagtagtatgatgtctgacacatgaggtgatccgtaaatgtttattattagcagaaacattttaagactttcataggtcctgggctctcttatttttttaagatctcatcctgcattatatcaaaaataataaaatgtacttatatcctataaaaaggtgctttttgctagaaaaatgtaaaaattacttttataattgactttatagttgaagggattcataactttttttttcttgagatggagtctcacccttgcccaggctagagtgcagtggctccatcttggctcactgcaacctctgccttccggttccaagtgattatcctgcctcaacctcccgagttgctgggattacaggcacctgccaccatgtccagctaatttttgtacttttagtagagacggggttttaccatgttggctaggctggtcacaaactcctgacctcaagtgacccacccacctctgcctcccaaagtgctgggattacaggcataagccactgagccagcctatgacaatggaagaattaggttgtagttggctgattgttataacgttacattgtattattttcaacactacagttattattttattgttcaagccaatagttattttttaaggtctcaaatttttatgttggcccttaaaaatgttgaaactatagtgcttaatggacaagtgctcttgtctattaaggaaaaatgtaacaaatgctatgatgaagccctgaggaagcaaaaatgaaggcaggaaaaattctatgtaaagtggattaaggatgagttcaggcagatatatttgagcagtgataaatagttaggaatctgaccactgaaaagcatgtggtcttacataactagaataatggtctccaaatagaagtctgagcaatttagagagtgagcaagagatccatgaggggaatggaagatggaagggagaaaatagtataacatacttgcttttaattctaattctaatttgaaactactgtttgttttactacatatttaatatatgagtatatttcatatagtatggtgtgtgtgtgtgtgtgtgtgtgtgtataaaatgcatatgtaacctctcaataaagcatatattgaggatgcattacaagacagttccgagatcttcccagcacagagcaggaaataattgaggttatgactatttggtgaagatattcagctcttctgctgaagagtatgttatcttgtaggcatggggagccatgaaatgtttaggaaaagagtgatcagatttgtaattttagaaattaaatcctgagataatgtgcaatttgaaggaaaggagcaaagactagagttcagaaaagtaattaagaaaaaattcaataggcttatccatggatcattttacctattcccctcccaagccaggaaaaagataaggctaactaattttgaacctccaagtgagatgtcagctcctctgagatgccttccctaactgtgctcacagcacccctgctgtgtatttcaagtagctccctgtatttccccctttccagaattgattacactacatagtaattgcgtgtttacttgtctaactcttcctttcacactgtggtacctgagggtaggaactgggtcatattcagaatcttatcccagaagccatctacagtacctggaatttagaaactactcaatgtgtagtttctatagtagtagttgatgaatctgactgaaatacttcactccttctccacttccagccattcagtgaactaattcccattagttcccattttcaagtctgtgcttagataccactttcacctgaaaggtgtgtctctgtttagcacttatctcctttaattaaaattgtatgtataattgtctttccttttaaaaagatggctatttcatctgccaaaacagggagccgacatatacgtagagtttaaagttctgttcagtgttaaattgaatatattcatgctcttctggggatattgttgtaagtcctgtggtgtgaaggagatggcctacatagtcaacccagatgacgtcatatactttcagcctctatgtagccactgtttttctcgtccaagttctctctcttctgacctggtttatggccacatccccaccctgtactcagcataaaaaaacctgccagggttctcatttcaaaggagcgaactcaatgtcctgtacagagaaaataggtagaggcaaaagcagagagtaccattatttatgaaggttttcagaatccatctgttctctggatcatgaaccctttatcaatgcactgtagcaaaaccctcagctccactccctcttctaccataaggagaatagcagctcttttcttgtgctcttcattagtagctactgacagtacagctgccatcatgcctctccaaacgttattaactcgttttcctaaaagcaaaacactattctggtctgttttatttcttttctatcttataaacataccatgctcacttttgaattctcctcctttgctcatttgttcccttttttcttaaaatcttcgtctacttcctcctccctgttcattctttcaaatctgtatcaaatcttgtccacttgtaactggactcctccagcttttattggtccttccttctgagctacactagaattatagtttgatacataattttaacattctgcaattcgcatgtgaacaattaaattgttaggactttatggacaaagattgtaccttaaaacttccttcatctcttctgccattatggcatagcacaagatatacactaagcattaatgctattcaccagacagttgtggtttttcttccacacacatagtaagattgtgtttccttgctgttctgaggtcacatgagactatttgccttgccagtgaagtgtgaatagaagtgttgtgtgctgtttttatgtgacaaatttaaaagtcacagtttgatttgggatattctatttttctctatcttggtcactggagaggtgtcagcacggatgcttaaatgaaggtgatatattgaagaactctccagctgacccccaatgggtggcatcccaaagattcaacgtcacttgctgaaggtgctgggagagccacctgcttagtgcatagcatgttttcacatttttgtgggtacatcagaggcatatacaagtatggggcacatgacctgttttgatacaggaatacaatgtgtaatcatcacatcagggcaagcactcatcatttctttgtgttgtgaacattccaattgtactccctcagttattctaaaatgtacaacaaattattgtcaactgtagttatcctgttgtgctcttaaatactagatcattcattgtatctaattatatttttgtacccattaactatcgtcatctccaccatcatcccctactcccatgctgccacagcctcaggtaactatcattctattctctagtttcatgagttcaactgctttaatttttaacctgtagcatttggatcatgagcatcagatattgggccagtttaggacagaagcaatcagagataacagagaaaacttctatggaataaatgtgaaacttctctactcctgacataagcataaccttcctattctacagtactgtaagagtactggtacacaatagtataaaaccattaggttgaaccaagtaaaattgacatttttataagataaaaatagccaaataatgaaaattttctatagttcaaccaaatagaaataagaccaggaggaaaaatgtgaaaaacctgcgagaagaaatgtgacacccttgaattagctattgagtcatatagtgtctgataataatgaaacctgcatttacctgattatacctgagaggtgatgatatactagaattcacttgttactagattataaccatattgaactaaaaataatttatccattgctaagccagaactaatgaatcaaatttgcatttacataaataacaaaggaaatttatattttataattacattccccagcttaaaagtctttttgaactcatttaagaagtagataatcgtaatagtcctatgtcttttttaaatatttaatgtgtagcttaaatctttcccacaaagaaaactttaggtgtagaactccctactggagaattctaccaaacatttaaggcaaaattaatgccaactctacaaaaactcttccagagatttgaggtggggcagatacttcccaactcattatacaaggacaacattatgcttaaacccaaactagacaaaaacattaacagaaaatacaattataggcaatatctcatgagaatcaagatgcaaaattcttagcaaaactatcttgacgaagaacaaagtgaaatgaattatttttcccgatttaaggattattagatgactacagtaatcaagactgtgtaatgctggtgcaggaatagacacataggttaacagaacaaaacagataacaaaaataaacccacataaatatgctcaactgatttttgacaaaagcaaaaaagtaattcaatggaaaaaggatagccttttggaaaatggtgctagagtgatttaatatcctgaggcaaaaacaaagacaaacaacaacaacaaacctctcaacctgtcttacatctccacaaaaattacctcaaaatgaatcagagacttaaacgtcaatgtaatattgtaaaaattttaaaaatacacacaaggaaagcataatgaactaaggttaaacaaagaattggcagatatgattccaaaagtatgatctataaaaggaaagttgatagattggtacttatcaatcaaaattaagaactcttgctctgtgaaagctcaggtaaaaaggataaaaggtaagctacggactggcagaaaatgctttcaaatcacgtacccaacaaagaactggtatctagaatatataaagtactctcaacacttatcaggaaagtaaaaataatccaattagaaaatgagcagaagatatgaagagacagcaagcacagaaaaagattttcaacatcattacaatcagaaaacaaaacaaaacaactaaaacatcacccactgctaactggtgatgatgtgtacaaagtggatcattcatacattgctggtatgaatgttaaatgatacagccaccttgaaaaacattttggctgtttcttacgaaactacatatgcaatttccatatgacacagatattatactcttgggcatttatcccagagaaattaaaacttatgttcacataaatatctgtacatcaatgcttgtagcaattttgtttgtaattataaaaaagtagaacctgcccagatgttgttcaatagctgaatggttaagcaaactatggtacatccatagcatggatcactacttagcaataaaaggaaataaactactgatacatgcaacaatttggatgagcctccaggcaggaaagtaaactgattgaaaaaaaccaatccccaaaagttatatactgttagattccactaatctaagatttttttgaaatggaaaaataatattataaatggagagaaattagcagttgccaggaattaggaagcgaatggtggtgagtatgtgggatgaagatgagtgtggttataaaaaggaaaataaagaatcggtgggttagaaatgtccaatatttttattgtggtggtagataaacccaaagtggtgaaaaatattgtataaaacttaaaatgcgcacttacacaaataagtcaaactggaaaaatctaaattaagatgaacgcgtataaaaatatcaatatgctggttgtgatattatactataattttgtaaaatattattggagaatactgaggaaagcatagaaggaatctgttttatttcttaaaactgcatgtgaccttacaattatctccaaaatgttcatttattaaataaatactttaaaaaagcaccaaaaatatagatataaacctttaaaaagatgtctaagatctatagaccaataactataaaacattgcttagagaaattgaagacctaaatagatggagttatgtcttcttcatgagttatatgactcactgaagttccaatcaaaatctcagcatgcctttttagaaactgacaagctaattcttaaattcatttggaaatgcaaaggacacagaacagccaaaacaatttgaaaaggaagagtaaagtaaaaggacttaatctatacaacttcaagagaggtcattatgctatagtattcaaaatggtgtgggtttgtcataaagacaggtaaatcaatgcagcagaacagagaatcaagaatttgacctacatatatatgccaattgatttttaacagtgatgtaaagcctgtgggaaaatacagtgttttagtttgggcagctgtaacaaattactgcagcctggttgcttacatatttatatctcatagttctggaggctgtgaagtccaggatcaggatgctaagatggttagtttctagtgaaggccctctttttggtttacagatggctattttccttctgtgtcctcacttgtcagagagcagagagagagagaaaacaatctctttcatgtctcttcttataagggcactaatctttatgaccttactaccatccaaagactccatctctaaatatcatcacattggcaattagaggcttatcatatgaatttgaggcagacataaacatccagatcatagaagttcatcatttcaaaatcaaagtatgatgcaactgagtaaccatttgcaaaataaataaatagtaagattctacttcataccacaaacaaaaagtgattcaaagtgtatcacagacataaacatcaaatttaaaactataacatttctaggaaaagaaaaacagaaatctctgtgaccttaggttaggtaaatatttctgaataaaacaaaagcacaatgcataaaataaaatcaataaattaaacttcaacatgaggaatttctgtttttggaaaaacattgagaaatgccacagactggtagaaaatagttgcatgtttcatacctaaaataagagttatttatacactgtaaaaaaaaaactctaaatcttgaaatctaatgaataaattgataaaaaagggtaaatatttgaacaattagctcaccaaagacaatatgcagatggaaaatgaacatatgaaaaattgctcaagatcattagggaaatgcaacttaaagccacaatggattctactacctacttgttatgatagctaaaataaaatagactgaccatacgaagtgctgcaagagctctcatacactgctggtaggaatgtaaagtggtacaaccacttggaaagattatgtcagcttcttaaaaaggtaaacgtaagcataaagaagttgatctagtcattgcaatcttaaatatttacccaaaagaaatgaaagcatatatccatagaagacttgtgcacaaatgttcatggtatctttattttttatagccctaagctgagagcaacccaaacatccatcaacaggtaaatggataaacaaattatggtatatacacacaatggaatgaatactactcagcaataaaaggaagtgaattactgataattggagccccagggctgaatctcaatttaattatgccaagtgaaataaactagagtaaaagtatgtaatgtattattctgtttatagaaaattctagaaaaatgcaaactagaaaaatgcaaactaacttatcgtgatgggaaacagatcagtagttgcctaggacaacgatggggttagaaggggctgggggaatgcaagggaacacagggatgcttctgagggtgatgcatatgtttattatcttcactatggtaatggttttatgactacagacatacaggaaaacttttcaaagcatacactttaaacatgtgcgattatatgcctataataactcagtaaagttgttgaaaaatgttaatagcttcccattgcccttaaaattaagaacaaatgattttcacaggatactatgttctacagggtctccccctcgcctacctctccagtctcatcttttgcccctccctgaccatctctctgttgccatcaggattggccatttcttcaaggttttcttgtccttccgacctcaggatctttgcaaatgcaagtccccctgctttcccacactgaaggataagctcaaatcaatcacccttcagttctcagctcaaatattaccccctaagaagagacttaactacttccgtaaatagctcaggtttctgtgttatttcctggcactctctactatttcctttttaacatttatcacacatttcacttatattttcagtaaaatttaatgtatatcacatgccactacagtacatttacatatattatgtaatcaatacttttaaagaactagatattatgacagttttacatttaggaaggagattaagaaactttgcttaagatcacacatagagtagtcagtgtcagtaatttgaacacagccctatcctgctttaaaacatagggtcttaattaatgattaattaaatgattctatgatataatgtccaccctgatatgataccaaaaagaaatctgatctgctgaaagcggatgtatgccaaggaatgcaagtggcttccagaagctgaaagcagtatccagctgacagacagcaagggaacagggacacatacaagacaaattctgccaacaggcatgaacttggaagcagcttcctctcctgagcgtccagagaggagccctgcctggccaacaccttttgagactgtaagcagaaaatccaattaagcccacccccccagacttctaaccaaaagaataaatgtatgtttagttcattaatagctatttgttatgcagcagtggaaaactattacttttctattttctaaagtgcttacatatgatatatagggatcatttacaaattatatttcttattaataagttgatacagtatggctctgtatccccacctaaatctcatctacattgtaatccctacatgttgaagaagggacccagtgggaggtcattgtatcatgggggtggtttcccccatgctggtctcatgatttgtagtgagttctcatgaggactgatggttttatatggggctcttcccaccttggcgctctctctcctgccgccatgtgaagaaggacatgtttgcttcccttttctccatgattagaagtttcttgaggcctccccattcatgaagactgtgagtcaattaaacctctttacttcataaattacccagtctcaggtacgtctttataccagtgtgaaaattgtctcatacataagtcatgggctcaatcaagtcattttaacttttggggggttttgttgcttgatctgtaaaatgaagttttactggataagttctactctctcaacttccctaagtctaagaattcatttctagctttttgcaactattgtgacacaccctgatcaggtatcctccattctcctctccagattcattctccacccttcagtactctgcagtataccccaagagactgacccctaagaactacatcagtgggctcccttgtccctgagaatggggcagcagaagtgataaagaagagcgaggtctcggtatttatttcctggcttcctacaagtacacaatacattaaggggaaaaatgattcctaacttcacttgtgaatttttggaagcagaggaaggacacgtaatggactgaactgtgtcctcccaaaatgcatatgttgaagccctaaccctcaatttaaatgtatttgagggagggcttctaagaagtaattaaagttaaatgtgttcataagtataggctcccaatccaatagaactggtgatgttttagaagaggaagagaaacctctctctctctgccacacatgtgcactgaggaaaggccacgtgagcacacggtgagaaggcagcaatctgcaagccaggaagacagacagcccttacccaaacccaaccattcttgcacctgattttggactgtccagtcttcagaattgtgaggaaataaatttctgttgttaaacaacgtaatctagaaatcaaagatcactaaataatatcgcaatgggtaaacagacggtacttccaggcaagcagtctatttgtaaaggtttaaactaagttgtgtagtatctgacaagtaagccaaacatagatatggagagtccaggctgggcagggtggctcatgcctgtaatcccagcactttgggaggccaagacaggtacattctttgagtctaggagtttgagaccatcatgggcaacatggcaaagcccatctctacaaataaataagtaactaaatacaaaaattagccaggcatggtggtgcatgcctgtagtcccagtctttactcaggaggctgaggtgggagaatctcttgatcccagaaggttgaggctgcactgagccatgactgtaccactgcattccagcctgggtgacagagcaagaccttgtctcaaaaataaataaaaatataatgaaataacaaatatagggtccagaaaatggccccgaaatcaagataggcaaaataagtcaataataaattcctacaagataggggtaatcacagtgatgtcctacatgaactgggctactggacagactaacaaagcagagactgagtaactaggtgcaaggtgagaagcaagacatctccagggctagatagaaacttatggagaagtctagagaccaggacataagtgtgacttgatcttgaatgcaagaatgctgatttaaatttccaaaatctctcccagcccctgaaaaccttcacctcactgctcccttcactccctttcttcaagtcaaagactgtctgagcagaattaatccccatatatgaaaattctataatgtagaagccacatggtaatagcagaggaatgaagacaaaggggctgtattgtaaggaagtattaattcaatattaaattatctaagtaattacgtgtgcaataaccagacattgtaatgtaaatcacattatctaatctgtatttttgtgaagttaaaaaaaatgagctcagctggtaagcatttgcaatttgaatcagtagacagaattttggagaaatgacactgccacttaacagacaaaaaacattgtggaattttttttccatttgtgtgtgtcttctattacctctttcagcagtgttttatagttctccttatagagatctgtcacctccttagttacatatagtcctaggtattttaatttttttgcagctattgtaaatgggattatgttcttcatttcactcttgcttgttgtgtatagaaatgctgttgagttttgtacatcgattttgtatcctgtaactttattgtagttgtttatcagttccaggagtcatttggcagtctttagggttttctaggtatagaatcagattgtcagcaaagctggaaaaatcagtattaaaatggccatacttcccaaaacaatctacaattcaacgctattcctatcaagctgccaacggtttttttttttcgtgtaactagaaaaacttattctaaaattcatatggaaccataaaatagaccaaataaccaaagcatttctaagcagaaagtagaaagcgggaggcatcatattacagggcttcaaactatagtataaggttacagtaaactaaaacagcatggtactagtacaaagacagacacatagaccaatgggactgaatagagaaaccagaaagaaagctccacacctacagtcatcttaccaaagttgacaaaaataagtaatgaggaaaggacttcttggtcaataaatggtgttgggatcgctgacaagtcatatgcaaaagaatgaaactggacccctacctctcaccatatacaataattaactaaaaatggattaaaaatgtaaatgtaagacctcaaagtataagaatcctagaagaaaaactaggaaacatcattctggacattggccttgggacatttgtgactaagtcctcaaaaacaattgtaaccacagcaaaaaacattgacaagtgtgacctaattaaactaaagagcttctgcagagcaaaagaaaactatcaatatagtaaataccctgcagaatgggagaaaatattctcaaactacgcacacaacaaaggtctaatatccagaatctatgaggaacataaacaattgaacaactgaaaaacagctccattaaaagagcaaaagacatgaacagacacttcttacaggaagacatacaagaggccagccaggtgcagtggctcactcctgtaatcctagcactttgggaggccacggtgggcaaatcacttgaagccaggagttcaagaccagactgaccaacatggtgaaaccatatctctacaaaacatacaaaaattagccgggtgtagcgggccacagggggcgaggagagacctgaggcaggaggatcccttgcatcccccagaggttgaggctgcagcgagctgtgattgcaccactgtactccagtctgggtgacagagtgagactctgtcttaaaacaacaacaagaacaaaacagacaagaggccaacaaacatacgaaaaaatgatccacattactaattgtcagagaaatgcaaatcaaagccataatgagacaccatctcacaccagtcaaaatggctatcattaacaagacaaaaacaacagatgctggtgaggctgtggagaagagggaatgtttacatactgttggtgggaatgtaaactagttcagccactatggaaagcaatttggagattcctcagagaacttaaactgctattcaacccaacaatcccattactggttatacatccaaaagaaaataaatagttctaccaaaatgaaatactcatatgttcattgtagcactagtcacaataatgaagacatcgactcaacctatgtgcccatcaatggtgaattatataaagaaaatgtggtacatacacactgtggaatactagccagccataaaaatgaacgagatcttgtcctttgtaacaacatggatgcaactggaggccattatccaaagtgaattaacacggcaacagaaaaccagtgccacatgttctcactcttaagtgggaggtaaacaatggaactcatggacattaaaatggcaacaataaaaactgaagactactagaggagagagggagaaagtggggcaagagttgaaaaactaactattgggtactgtgctctaccctgggtgacaggatcaatcaatccgaaacctcatcatcatgcaatatacccacccaggtaacaaacctgcccatgtatcccctggatctaaaataaaagttaaaattataaaataaataagttgaattaaaaaaaaaaaaaaaaaccttgtggtactcaaaattctgcatgcccaagtggatcaggggccgaaagtacagggcattcataaactgtctttaatagtttatgttaaatgttgcctcctgtcagtaagaaagcactcctcttaaatcaaaaactataatactgccagtgtctgtgacacatttatttctttaaaggaagtaaacttttaagccaaacttcttacctgctagatgagaattcacccaagtcagtaaaatccacataatttcaagatattaacaatcagcacaaattaatgtcaaccatctgtaattcttacaagaggatgcttgtttgtttacaaagagtataatttttgctttctaatacattgttttgtagcataggtatctttggggttgaaatggaataaataacatttcattttcatagaaaatgaacactatataatgaatagaacttttcattgacaatcttgaatgcattacattactcttaagggcattgtgtttttcaaatgttttaagctagcatctctcctagacttaaatgacaaaatgaagttcaccatttctagtttgactttttttctaaatttgtcttccttcttacacatcataaatcaagtttgatccatattggaaaccatatgttttcaaactgatatctttattaatgaaaatatgtaagtataaattcctgggcagtttttttcagcagcctagaatctaatatcaattgttacgaagttcaatgctctaaataaccatgagctccagttaattgacaagattgaatacacattttaaaataacataaagaatgttgactaaacatttagtcattatttctaaatcttaaatagtttaatattatcatactgccatggaataaattgtccttagaatcaggaggatccaattttaggattttaggattttaaagttcacaggggctactggttcttacccaaagctagtggcatattcactaaaaccacaacagccgtgtctattatgtttcaggttgccggagtaggtcgatgcactggtgaaataataggttatatttctggagcatagaagggagaaaaggacaaaagtactaattaaatttgaaatctgtataatcctggaataaatacacaggagaatacgttaattccaaatgtcagcctcattttcactgaacttctaaaaatttttaacaacgctttaatttttcaccttcatatgaaagtgaaggtccagttttaacaaaggtcttgaaagagcccaaatgcaaacttagatatcatattcttatgtttagaaagtgcagtgcaagcagcccaggtatcaggttgcattttcatactcttgctactctggtggcaacgcagaataactgccataaatcatctcttggctgtatacaattaattttgtgttctgtacttatactcctctatgtttttatgctgttttttttttttatatatgacttttgaggtcactcttggttttaggtgaaatactcaagcttaatattaaaatatcactgggtgatattgtagtaacaagttctaataaccaaactcagggtcaccccttctgcaagttttaaaattaactgtcaaaaaatgtcaaaagaaaaatatcttgttactccttaacctttttgaatataagaagatttaagtaagcttattatacttcttgaagggtaaaatatttctactatcactgcatattttcacagtgatcctttatcttacttattatcaccctagaaatggttttagacttcatcattggttcttactatttagctgattgcagtaaaacagaaaaaaaaactgtttttaaataattttcagaatagctattcttccagacgggagtctacggatcctaaatgcttccaaatcagacgagggaaagtacgtttgccgaggggaaaacgtctttggttctgctgaaattatagcttcgctatctgtaaaaggtaagacagcacgggtaaatgttttacaagcatagtctcatggtcttatcggaaagagaataaatataatataaatgcatatatgtttggacttaagtgtgtgcatgcttgtgtttataaaatacattgcaaacatagaactaaaacagccacattgttactttccaccatttagggtaccaaaaatgaaggaacctcttattggcagaaattttattttgctttgaataaaatttgtgagagaatgaggcaagctttctgaagttttagtcagtgtctcaaaacttgaaagtatgccaacggtataaaaatatttttcctctaccaagaataattttagcatcaatcactaatattactctgttatcacttcaactagggatttggggcagaaaggagcagcagcaggaggatatgatggaggggtggtataggacttcgcattagataaactggctccagagctgtttgttgatgtctgtatcaatgaaatttttatatgcctttattttatataagcaatattaatattactgcttatatgtttccattcattttatcgttctaaaatgagctcgatttcaagcctagaacattctgttgaggctctatgtcattgtttagtgacagaaaacctatcttaggcagtcccttcagatgtttttcacattgagtctttaattgttttcactgtgcatgtatcatatggcaaaccatactccggccataaaaatataaaaatattattttttctgtctttaaaataaaaatgtaattaatacatttacattactggtactaaaataccagtactctgatattttagaagagagaacatcaagaaagaaaagaacaaaatgtaaaatatactttcatttatataatgcattactggactcaaacgcagcctttcagttcttattccttctgtgtgctagttgttccattttgtaataaggcaatgctagatccaaagacatttttaaaataacaacaaaaatgttattttcttaatcatgagtttaattgtttactcagaacactccaatccccacaaaatttaaactacagtgtactgcttttatctgtcttctctgatgaggccagaacttagaatgccatatggaacatttgacttccagaatgttaatatttacagtgacattcctgtcccaggattccatttttttctcagtgactgcatagaaggacatggaacattaaaggatctgatcagtggttaggagtggtgtttcatcagactgcactgtcgcaaacaatagacctagaataggaaatttaagccaattgttaatcactgtgttaattgtcttgaggtatctatgaccaggaatctaactaggaaagaagataaaaccaaaatcttcatcacctctctactatatttaaaacacatcatcttgtaatcagctaatcactaacttaactcttaaatgtaaagcctgttttagcctttattggttcaaagttgctctaaacccagtaaaaaagtgtgtttttaaaatttaactgaatcattaaggagttaaacataaacattgttttctaaaaacatttccattcagtgtttctacctttctttatatatgccaattaagccatctacaatacagcaaaggtacaaaaacaggtacgttcttctgattaaaaaatacttttctactcctaaaagctttttgtcgagtgtaaagcaaatacaaggtagtgttgttgtagtattatatttttatctctgttaagatagttatttggagggaggtgctttctattgccctgtagcctcctctcatctttaagcaagtgaaccctctctgaattcttcctgaaacacataacctttttattgtaaaaaatcttttatttacttaatgatccttgaaagtggtcagagaggctacagcctcttctttttttctaatgttcctccttccataatgtcaaatgctgcttctaattaggtagtctcttgtctttttaaaatccaagtcacattcttaataggaacagaggctcttaaatcatttctcccctacaaaaacatggtaatatgccctagcatccaaaagctaataaagatgtaaaaaagctggtatatgtatctggagcaactgtattgtatagatttcttcttttctcaattatttcaagcaaaatattatgtatggtaacacaacaggttgattatcttaattaacgtatttttatttctatagaacctacaaggatagaacttactcctaaaagaacagaattgacagtgggagaaagcattgtccttaattgcaaagcaattcacgatgctagtttggatgtcactttctactggactctgaaaggacagcctattgatttcgaggaagagggtggacattttgaaagcatcagggccgtaagtgaatacacttttattcttttagtaatgataactttagaaattttgaatcaaatgtaagaccttgcttagctatgaagtgctaagaaaaaaaaaaacagaacatcgacttgataaaaacaattactttctgccattattttatgttatgtcaaactgaaagtaatatgtaattattttaaaacccccagtaaaaaactgagaatacctcattatttaaatctggtttctttgccacctttgtttaatatttacacaatacttctcaaaagttatgttgctacataaagtggcaattcattatttaaagcatcgttaacagtaattatgataaaataaataaataaaatgcctgcctgtccttctcctcaagaacagtaatttttggagtttctttaattttttacaagctatagagcttaaacatacaactcgtagtcataaatgcacattagccttaagtcagtattcaaagatatactcatttctgccatttttttcttaatatcttcttttatattgtgtacctacatggcaatcaaccaaatggagtgggaaatctcttgaaccaaatcctacagaaccatcacagtgctttaactctagagaagtgaaaagaggccccttccccacatggacttatttaaaatgtaatagagtaacataatgagagagggaggagaaagacagatggaactggggtggcagaaaaagagcgactttggctggaatcttccttctatattggctaaagagatggagccaaatacaatttttgcctacaaattggatttaaaatgctgttgcatacttattagtatcagttgatccatcctgaaacactttgagaagcattggaaaaccatagctttagtgagcccaagtatttaaactcagtgtcaattggattttattttaaaggttatgggatacaaggaaaaaaaaaaaaaagccctaaatccaaagtcaggaattctctggatcaaatcccagcttaatctctagtcagctgtgtaacataaagccagtcacatgatttgcctgggcattaatttctggagaaatcaaagtgaaaaagttacaccagataatttctaagatagcttctcaccttagaatttggtaaatgtatattagtggaagagtaaagatgagctctctttgttgcattttccaatgtaacaaaaattagcccactttcttcaaaactattcctttcttcctggtttactatccaattaataggagagagtatataaataagaaacaattgccaactacattgttcaccatctcattaaatgagcgaattttaactgttaatatccaagttatatgtaaagtatttagagtgtgttaaattaaacacattttgctctgctttatggttttccttcttcctttaccttgggtgataattccttcctacaatacttttcctacacattttataacatggatgttgtaaaacagaccaagaaaatttaattttaaaatatcacattttgattaaaaaatcccatgagaaaaatatcttcttaggattgtctgcaaacatcccttttgagtgatcacatatctaaagaaaaaatacatctaaaaataaatagcccctcttcttataagtaatccctctctttattttacaataccaatataaaaatgaatgtacctggtgaagttacatgaattattgtttttgtctcttagacatagatatgtttaggttgatgtcattcatttgtatcaataaatacctttttttccatgaagttggcagttaagaacatctgctgtattcttctttgcatatatgctttccttgccccagagagtgccaaatggactccttattccacgcaaacccatataattacaacccactttgaaattaggctctggattagagacagtaacaataaactctgagatagaagaagaaagcaaatcatggtactgagaagggagaaaaacatttagctttaaggtataaagccaaaatatacttttagtatgcatatgtattttaaaacatatggaagcttcaaaactatggcatgtataagaaattatctatcacctttctctcagttacttcaaacactgagtcttggttggcttcaaggacacacaccagagaaaataccattgtatgacaataaaaaggcaaagaatggaaagaacaacattctgtttcccttctgcccttctcatgtaaattatgtctggaaaataatgctttaggagaaaacatataaaagtgttataaaggcagatttgggaggccttctgggcttgtggataccttctttctgtgagaccaaggacagactgtgggagtcagagggacaggatggggctgagaagagagccaagtggggtgactcaaggtctgctttgagtttccaagaagagtcattaaaggatctcctaaggtgtctaacttatcccagcagagtaaaaaaatgaaaatgggattccgggacttaagcaggaatagagtgtgcctatgattggagcactgtccaggctaactgtcctgggacagaaccctgccagtgggtgagtgaatgagggtgaatcagaagaaaaacacattaccactgcatgaggtaacttaaactaactaaacctctcaggtgggaaaaagagataacaatattttgtattattttgtagatgccaaaatatgacttaatgatgttccctatttttcaactgttgtactggtatcttttatacacagacattagcttgcatataaatctctagtcaattattttatgtagccttcatatacaatctatatacaatgtacattgtatacatccacatctatatacaatgcacatttttatgttttaaaatagatgattgctttgaactccatttcaacagagtgcataaacatatgatcacatcaggctaaaaaataatagtattgctttaaattaaaaattaagtttaaattaaaacattcataatgaaaatgcttctactatttatgttgccctcttaggccatgttttacaaactcagcaatttgactaatttggagtgaatccattattggaagtcactgttgaaaggggagaagcaatcagttagtacataaacatttgatccaattcatccaaatccttttttttggcaaattttatgaataaactgaatgtgataagctagtgagtatattcttaagattttaaatctttttagttctacaagctaaatgctgttgggggatggggatccaaaataaaaggcatagcccttcacacctaagagagcaccatttaagggtagaaattgcagtatgggctatgatctgctataataaagctacaccagagaactatgtgcattcagctgtttgttagaaggggttggtatttgaaatggacctggcctcagatccattcaaatggaaggatttcagcaggtgcataggagaagctgcatctcagacagagcgagcacgttgggcaaacaaagaagggcagaagagcttagtgcgtgttttgggaacagtgaggaaccagtgagggtgtatagtagacaataagtcactgtttgttgaataagtttaaaggaaagcagcagaggcctcaaaggcactgatttcggagctataaaatttgatttgtattttgagtacagcagggattcacatgattcagatttgtttttaggaagataattctgacagctgtgtggagcagggattggctagtttgtggattttacattcagtgtagacctgttaagtagaggttataataaggagataatcgttgtaagtgttgaccttaaataaccatcctgtaaccaaataaaagcatttactatggtgtcctgacttgagagtttatgttggtcagaggtctacaagaacctctgattcctctcaggatatctgaatagcatctgagctattgagcattgccatgtggccccagagccacagtcttaatggaggactgtgctgagccactgttttccagtgacttgaagtcctctaattattcaaataggatataagaaagtttctatccttataatgcataaagaagtgttacactgaatatcatggtggcctgcaatttgctgcttttttaacacagaaaaatatctcacgcatttgttgtcagaatggtccactagagaagaattgccctttcattgtgaacttgataaattgcaaccaaataggcaactgagccaaagtgctatatagctgtatggtccttcacatttacccaattctctggttatagcaatacatgtaggaaggcagaatgggaattttgagcccatttttttaatgaggaaactgaagaataagacttttccaggccacataaattggggtaataagattcaatatcatgtgatttttaaactacacatttgttcactctcctttataaaccctctccatattcactgaccacttcttatgtgttaagcctttgtctataaactgtgagaaataaaaataaaaggaaggtttgaatccagtcttcagtaaacataaagataatgcaagacattaagcaattcaagaaaaatatgaccataaaaacaattactaactaacttttaaaatcacagccaaattttgttgaagactagaaagagattaatgtgatattttgtcattgtggagaaaagcaaaataaataattgaacacctatgtgccaagcactgagctaagatagatggatactgtatgtatgtctgtctagacacacacacacacacacaatagctcactgattcctcttaacagccatatgaagtaatgttatttggggaaaacatgctacctgacctagacctcagtgagtagcattagaatagtcaaagaagaaaaaggaaggcaacctaaggtgagaaaagatattgttatcttagggttgtgctggatcttagagattattgagtttggcctaggctggtaccggaagtctctttcagtatcactagtgtatgtcctaaccctttaagtgatgaggactcactcctctaaagttcgtttcattatcagtcacttctgaatgtcagaagattggaaagtaggagtaattatgatcacctgtatgccaagcatgagactcataaggaaacatgcctgattcatatgcagaatttttgtggaatattaggtgaatagaaagacagaatataaaccccttagtgccttgagaattttatattagctggaaaactctagcctatattaattttcttattacagacacttctactcctagtttatcttcttcagaattagctatttcctaaggagtaaaagtctctgaatagaacatagtaagtgctcaattggcaacattctgtttcctgattgataaatattaattgtgtaaaaatcaatggaatgcttgggtatactgccagtttactaaggcacaaagctgtaagcgtttcataagcaaatgcttcatcctcttcttcatcaacttggcatgcgaagtcctggagccatttcaccactaaacaggaagtgtatcaaagggcggaagatctaacaaaggctcacagtctcttagactcattatgtttgctagtagcattcacactttcatgtaaatggtcccatggactccgagcgctaccctttccctatctcactaagggcctatcctttctcatcagttcagatcctacctcttggttctttggcctgctctgaacgctggcaacctagtaatccacccattttctattccaacctcctgaccgccacatatttgctatattactgttccctcccaatctttcacctaacttaaaaaattgtgtaattttaataggacagaaacatacagtaaccatcaaccaaaacttggggaccctcacgaagaaagattaccttcaaaggttttagaatattcagactatcccagaaaagtgcaccatattcattctccctgacttgtatgtgctaaaaaatgtgtctccactcactgtcttctcaaagtagaaatcattccgaaagcaaataagaatgtccatcttttttttggtattatatatgtttgtttcatatagtttatgaatatgatcaatatatgccatttaattatgttattctataatatttcatgtattgatgataaactgcagggatcctaaaagcaagggctaataagtaattttatttttcatcactttgtactaagaatgtccataaaacagccattcagctagccaatgctgtttcaataaaaacaaaacctgatataaagcgttttctctgcttagccaactgctacattatttcagaggttttaatataattaaatactgcataaaattctgttaaaatctgttttcataacagaatagtttgtttccttgcttttttactttttacacaaaatggaatatcacgttagcacagtttggaattgaatgaaagatgactgccttgatgacacctaagacagtctgttattgggagacccttacttcctatgggtcacagggcagtcagtactggaaagtagtgctgtattgattgcccatctccactttactctaattagcagatttttcacacatagcaaaatgtgaagtgcgtctcttcactttctgtagattgtcaaaattagtaaaattaggtaacgtcttcaagttgtcccatataaaaagacaggcttagccatccaattcataggctgaactttgttcatctaaatataatctaccaaaacaaacttcctatattgtcgtaggtatacagagcatttttattaatttggaagttccatttttgatagctgttttatctttatgacaggtctcataacattatgtgtgctatgaatagttactagtatccttgcaaatttttattttggtgtagaactgcaggtctttgttattattgtcagagagagaatataaagctctctgatagagaaaggcaatttttgtcgggggcatgcttggaaatattagatcaataccttggattctgtaatctctgaggggataagagtaccgtaattcccagagccagctaggatattttaggttattggatagaaaaaaaattgaagaatgagaaatagaagacactccttactccttagaatttgctctcctaggttgtaaatttcaaaagttaaatatgcttctagctcagtaactccagaaacttaaaaaatgcttacaggtatctaggactgtatatgttttctctttctgaggttttgtgtttttccaatgttgtttttccatttcatacctatataaactcagactagtttttaataatcctatattctcactgagttgattgtttttaatccaacaaaaacatgaatttatctggaatgaagtgcctattattgggaaatgtgatcactggtaggccacagtgggttgttgcattcactgttgttaactttgacagtaaagtcaatccgatttatttcagtgatgtttattaaaccaaattctcacctaactccaagttacttttgacaatgacttacttagacataacagtctttctgatatacataacaaacttctcatgcaaatttctattgattatcctgtaattgtacattgaagagcaatcaatggctcctggctttaaaaccattttccctttccaatctgacagaaacttcagaaggcaaaaaaaaaaagtcttaattatatacatgctattaaaagcttagaatgagtgaataaccaaataaatgaatattatcaaaaccattctttataacattatcactttccacttgtatcaaatgttcaagttactgaaatgagtacctaaattatctttggtgcctaataaccatcttttctcagtattcaactttacacataatcggtactttcttttatttatatcttaagggactgctgttcacatcttgataatttttcaatatatctctacctccctcctgttttcctttacttgtctttcactattcatattactcgtgagcctattccaatgaattgaaattggaaggataactaatgtgtcaactttaactgaagataccataagccagtgtagtagatactgtggtgtgttgcccaggttctcccttcaagactgaaccactccttccccaagctatggagaatattgggggctgacagctctcagcagtgttccgctctgggaattgccttcagtcaaagagagttatctggttcaagctgtgctccaccccaatctcatgctcaatgcatagagatgattagtgtacaggggtgattataaagaccagacccctggcctcagctccagaattacatctctcacctgttgaatgcctaatagatacctggcaatatgctagacttttcaaatattatttcatttacttccctcaaatacgctatggtatagaaattgtgttattgttgttgtcattgttgtttgacaaaacaagaaaaagaaatttagaaagataaacaactttcccaaacttaaacaactgttggatacaagagttatccaaactaggactgaactccaatacattatcatttatcagatctagggcatatctagaactatttagcaagatcacatttttaatttcctacttagtaaacttagtaatatcttgtgaaaaatgtaattatccttcatccattttagaatttgtgagtcaattatttccattgccggtaacattttcatgtattcttctaatattactcattcttatgaagtttatattatgattatgtggttacatttacactatatgagatccaattttcaagtatttatacatttcactatcatgggcaatctcctgcccctttgccagaaaacatatttctattaaatatagatatatatttatatttatatatttatattaaaagcagccgtataagtcagattattaaaaccttaattgtttgttttataataagtttgaaacagtttcattgtctgagtaagacctaagctaaaacatttaaatagaattttacatttttaacagccctttttacccttcttccctcataggtattatttcattggattcctgtaactacactgttagtcagccaagttatatataaatgagaacactgagccccaggaaggaagacaagtaaaggtcctccctaatgaagacctgagcaacacaggcccatttacgcaacagcccccatcatcacttgggcttccttgaacttaaaacttcattgccatgaacgatgttccaaatctgatttgctgttgtaaagcacagagagaactaaaactagctgtaactcttcattgtgtcttttaacactgagatgataaaaaagatggtgttattctctgaagtcttacctctttagctgggtaactacatctgttactactatacttacttgatcactattaaaacattaaaattaaaattatgttcagtaagataaaatcatcaaattgtttaaaattctcccataaaagttactgagaattatttgaaaaacatcttaaaatatcctactacacttgcctcttcagatgttctgtgggtgtgttttcccattaattaaagctcattcttctggctgctgcaattgtttcattttatggtatgtgaacccatttttatcaacatccctttttaggctttgaagcttctctcaaaatggatatgagatgcagtatgttacattgctttaacaactgaagtggatgcaaagaatgtagagtacaaaggtctcaatcattcttctgaagaaaataattggtatccacattttggacattaaaatcatacctgttcttaataagtatgcatttacagcattgttttatgcagttttggccaccaaaatccagttttcaagtcaggtatctggcagtgtctcagattcttttctttactcccatatatccatcaaattttcaaatattactaattccattttgaatctgttgattccttttctccattcctggagtcaaagtcctattcccagcacttatttctagtgctgtcatctcaccaccttttacactataatgactatcattaccatgtttctaacaagccgagtttatcatactgcccctccccatcccatccaattacataaatgtgcacgtacacacacacacacacacacacacacacacactgcccctatcttggatctaactccagcctacatatcaaacttcatcttccaacatttttctcttattattttacagcaaagcataataattctctgaaaatatcatgttctcacatgctgacccactgccaagaatactcttccctgacttgtaagctttgcaaactgcagcatttgcctccaggcaacttgaagtcctttcccagtgcttccattataccttacagatcccgccaccaggatctatgctgctttaaacatttgctcagttttttttcctcttctagtctttatgtttctgaaagttagttaggaacatacttatttgctgggcttaacacagtacctggtgcacagtaaagaccaaataaatatttgtagtcattaaaggaatcagtagacataggagtatatgaactaaaaactagccatttagagtagctcaccaagaaacaaacattgactaatatatatatatatatatatatatatatatatatatatatatatataattataggcagacagatagatatatcgctctctatatagatatctatatatctctcattgatctatatggagagatgatatatagatatctatagatctatagatatagatctgtaaatatagatacacatgaaaagaaagagagaagagagacaggctctcactctgtcgcctaggctaaagtacagtagtacaatctcagctcactatagcccccacctcccagactcaagccatcctcccacctcagcctccagttaaagagttttagttaacagaggaagtttctaacttctgttgtaattatagaatattatcagtgataaacatgtttattcattttacttcacataaaaatttaagtatttttaatgttgtcctaaaagtaattattttctctggagataataatcacaggagttgctcataaaagagaaaaatacaatggattctagttttcatgttgaagaaatactgatatgttttataagcattgcattattttaaggagaatgccctacatatatgtatgtatctaggagatataatttaacctggagaatgatgaaatgcgtaatataataaggccctgaatactggaatttttaccttgtaggaataatatatgaaaaagatttttctttttagttttttgaaagccttcttagataaaagattgttcctattatttaataccacataaggtttaggatttatataagcaaacagttcagttttacattttgaaatactattgatatgtaagtattgtgtttttagattgactcctatgttatttctcaaagtgattttcaaagagttgggtttttgagaggccattatttctaagacatctttaaaattctaccttcattttgcaatttctctttcggcatctgttttgtattaaattctaaagggtgactaagtgttatgatatatttagttttcagcttttcagaatcctctagtttctttcatggactatttttatcatattacagcacaaaaatcagctttaggagtctagaattaataataggtagcatctcaaatatgttttctctctcagaaaaggaggaagaggaaattttagaaaagactattggactattattcacttcctttttccatctggtatccattatataagagacctggaaaaggtcactttaaagaatttgagaagcatgacaccattttatttaatgaataattgaagcctctattgagcatttatcagtgtacaatacaatcagccttctgtctcacgggttctgtatccatggattcaaccaatgtggatagaaaacactttaaaatcaataagagcatacaacaaaaaatacagtacagtataacaactatttacctagcatttatattatattagatattataactaatctagagataatttaaagtatactgtagagtatgcattaggttatatgcaaatactacactatttcatataagggacttgagcaagcatgcattgtgctatgctgtcctgaaaccagtcttccatggatacagaaggcaactatacataagttcttattttatctcagttccatggaaataagtggagcattcacacactaggcactattcaggagctgaggattctgtattaatcaataacaaacattatatgggaggtatacgaatacaactgaagtaaagcactgtctttgagggtcagtcttacagaggaacatacatatagagatatggcaattgtaatgaaggaagtatgttcaggaagctgagtcaaaggtacacatcatccaacccgtggaagcagggcagacttcctaaaccaaatgttacctgtgcctactcttaaaacagagtaagttttgcagacaaagcagagagaggaagtacaaaagaaaaagactttacaggtagagggtgagcatgatgaaatatgggagatactgaagttttgtctactaaatcccaataataaataatgatcttatagttaaacttcatttaatatattactatagtaattctgtattaaagagggcttctcaaattccctatgagagttaagtaaatgaccatgattattcttggtttcaattatagcaaggtacatatacatagcaaaagtaaagttgccagatttttccaaattaaatccagggataaactatatcttgcttaacataagtatacgtgttttacataaatttagatgttgcttgaagctttctgtggtatagataaaatagaaattattacaactgtaacactcaatttttagggtcattgagataattccctgaggactgtatgattttttttcgtgaggctgcttgttattctaaaggcagttctaagaataaatgtacttcgggaaaacagggactaatatcagaacttctgcttcctttcacatttattctcatactaaacaataaatttttttaggacagggattatatctattttgccaaccactgccagcacctggcatcatgcctggcagatatatttgctaaacaaaatatatattaaataaaatgtttaattattatataaacaaatagaattgtatatccttatatatcagcacttttttatatccttattatctgctgaactacccaaccaaaaaataaaaatatatcaatgtcaggaaaaatgtgataactttgttcactttgcaaacacttaatggttacctgtaatgtgtacagcattaaccagagtatggttgaataagaccaggccagtgtcacccttttacatagagctgtttgtctattaacagatagatggacctttaaacaactatttaacatgataagctttatagtattcagatattatactgatgagagaaataaactcgaggagaaatttgacttaataaataggtatgtcattagcagaaaagcttgttcttacaattaatgtttaattgaattcaactaagctcattactaaaggttgttcaaccaactagcataagctaaggtaataatctgactgataatttttgaattaccttaaaatcaactctttttctttatataccttacacattctataaaaccaaagaatttactattttcaggcaaaattagataaaataatttagattgctttaccagtgaagatataacattactaacttgttcaaagacatcttaagaagcctcactaaaactaaaaaatactgcattttatcctttctaactactgatagccccataaataaatatattatatttacaaaatttgttttaaagtacctattaaatatagtgatagtatttcctaaaagcatttttgaaacctgtacttcaattgccattatttatcatttgcaagaaaagttaaatacttatggctttccccaaaataagggaccctgtgacatgctttgctcactgagctcgtcacatcactaatcattccaacagtctgctatggtgtctctggtgtttaaaattactgtagctctaccatgttaaactgcaaacatttcaatatcatatgacaatatcaaatgcttccatttgctttgtaaaataatcaggcaggagaatttaaagttcatttttgttgctaactttttttgggttttgcccacattgctgtttccaaccacatttagtctcataccaaaattctgactggaataactcattagtctgtctcatttttatattttaggcattgagatttaaatatttttagaggaaaaaactacatttaagtatcaatgaataccttttgctcatctgctgtaactataggaaaggaaataagaagttgttatcctaaatatatagaggtaagaattaaatatggtctctatcaattttcactacaaaataaaccttgcaaaaacctagtggcttcaaataaccatttatttagttcatgattctgtgggttggcaatgtgggttgggctcagccagagtacatctatgggtctcaccaagactcacgcatctgcaatcagctgcctatcaacttcaaggcattcatttcgggcatcatctggccattggctggggctgctggaggaagtgagccacatgtttctcatcatccaccaggctagcccaggcttgttcacattaaagatctcagggttctaagaccaagagcagtagtgctaagactccttaggcctagactcagaacttgctcaaagaaacttacatcacattttactggttaaaacaagccataaggccataccagatttaaagggtaaggaaataggctccacctctggttgggaagaactgcaaaattttgtggccatttttgcaacctaccaccatctgcccacaatttttacatttctccaacttgcaactttcataccagaatccacagaagtctcattcaatcatggctccaaatttactttccagttagcttttgctgcaaaacaaactgcccaaaatgtatgactcaaatctaatggtcagtggcttgatctggactcagttgagtgactgctggtggtctcagttggggtcataaatgcatctactgtcagcgatcaggtcaactgggagctgtttggtgaagggggcagctaggatggcttgtctctactctaagtggtcttctattctgcagcaggctagtccaagctatgtcgcgtggttatcacagaatttcaagacaggaatctccagtgcacgcacgcaatgcaattgtctgtttgctccatggtcacacatgtctcactgacctatccaagtcacttacagaagcacagagtgagtgtgagaggagattatataaggatgtggatccaggaccattactgtagcaatctaccacacaacctctaaatgatactttagctgtgatatcattttgatactaaactaaaatttagattttatgtgtggtgtgatgtggaggagagaggtgtaggagatagcctttcaaaaaataatcatttgtacaaccctaaaagtcaacatatattgtcactatcaacatgaactaggtaaactgctcttaccaaattaaccagccactatttgaatggatccttttttactgaattaagttcagccagacaaagcacttaatctggttaaagagagtcatttttccattttacatggttaacattctttttaacatgttagaaaattctaatcactttacttgttaatagaaaatcagcaacagttagaaattaacagggaaacattaatttctaatgaaaacataaatgggttaattggtttttcacaaaaatagcatgtctagaagacagtcataatatttgctacctcatctgtcctaaaataatccttgttaaatgtttctaccacatgttagttctagtgatctcagtgcctcagccacattttgataaaaacaaaagcaggtatatttattaataaactactataaagagactatgggcatatctgaagcaaaaataaagtatactgcatgttacatacacaaaatgaattcataggctcttttaaaccagcatgttccagttgtttcctcactaatgaataagggtattgttatttgtgttatcactgactttgctgcagagcttaactagtggagagaatgaaaatatttatgaacctgtagctaatctagaattacattaagcatttattatataaagctgtgataacagtaggttaatctaagaaaatagtagaggttaaaaaaatagtccagcctgcacacatggttcaagcctgaaatcccagcattttcagaggccggggccagtggatcacctgagcccaagagttcgagatcagcctgggcaacacagtgaaaacctgcctctatacaaaaaaaaaaaaaaaaaaatacaaaaaattatccaggcttgatggcatgtatctgtagtcccagctacaagggagacaggtgggaggatcgcttgagcccaggaggcagaggttgccgtgagccaagaacctgccactgcactccaacctgggtgacagggcgagactatctcaaaaaaaaaaaaaaaaaaaagtccagatttatattgttttcaacttctccaataattctgtttcctatgaaacttatttatatagattatatgggtggctttgaggtacaaaataggtatacacattttaggatgtgaatgtgtaactcaagtattagacttgataattcaaagatttaggagctttcaaaagatatttgaagataaaaacaaagatgactaatgtatattgattaatgcatttgagacttgacaaagtttataatgatgatagattacattaggcagttttgctgaatttcttgtattcaacagtaatgtttccatctgtgaacacaatgctagaaaatttgtttcccatgaggtaggtttttagctagtaataccaaaaaataatgtgaaccccatcaacgtccttcaagaaacctttcaagaatgtgtatgcagtcatgatgataatctcaatacataaaatcaaaaagactttggaaatcaacttaactatatggctcgatatgccaaaagataattcaaatatagattgtgtattcgtcttcacagaaacccaatgtgctgccaagataagtttgaagtaatataactatttctaggtagttgacacattgtacaatgtgctagattaagccaaaaataaaaactgtctgtagttagcttgagccatcctagttgcataaagctcgaatcaaacctttaagatccagagaccagttgtaaaatgtcatcctccatgtgtctagaagtccttgatcagccactgaggtttcatctatcattataagcattacatttactatgctattacaattacttttaacattaagaacttctggtgggtgatgcccaccagtagtaaaggtaacatgcttttgaggttttggaactcagttgccagcatttacgtatttctgctagcttgaaaaggtatgatgaatagttaatagcaggacaacatcgtagcagcttccccaagattaacaactaaaataagacttttgctaagcaactttaaaataatgtatgaagaacgatgtcaaatgaagaccaacggaattgagctatagattgtagcagacaaccacagtgctagatcagtctgatattgggaaaaaaaaaaagtggggatttttttttaccaatgtcttgggaaagaccataaatcatagaggcagaatcttaaacagactaagttctaaatagccatctgtagttataaatagaaggcaatcttcacttggacacaacttaagaagagctgcttatcaggtatggatcatgttagccatacaagttgattagtttataatctttagttgatggtaaacacttagctttgtacttctccatcataaccctagctttcagctctaagtcagtttgtttgtttttttaaccacaatgaaggtacatttaatttttctaacataaatttttaaaagtttattgtagatcatttgaacatattaaaacttgaaagaagaaaataaaaactacctggaaaattatgtggatatattcaccagtaatgtttgtaaccatgttttcatatgtcccttcaagcacatatagacacacactttacacaggtgagatcatatcatggatgtttaaaatgctttaaaaggatgactttccccctacttttatctccccataatggcatctatcacacccagtttagtttgctaatatcctcatgtatgtccttctgtattttactctgtcctactgtagtcctgggcagatttacatatgaatgggaatatttttataattgttttataaaaattaaatcatattttacattctttttctgaatctcataattatcactcaataataatcttgaaaattgttctatgtcaccttgtatagctctaatgcattcttttcaatagatccataataatccataatgtgactatacttcaatgtatttagccatttccctattaaataccaactttgtttcctttgttgagagatttctgaacaatgctacagaaaacatctttaaacatctgtatctttgtatatcaacaatttcctttctgtgggacagattaccaggaatagacgacagggtcaaagaacaaaactatttttaatttaaatgggtgctgccaaatttttgttattgcataaaaatatgcagcatctaattacattactgcattacagcattatgtggtaaaagttactagacagggggcaagagttctttgtgtaggcccaactttgtttctagttagctgtacgaccttggggaagtcatgtcccttgtctaggtctccatcttcaaagttaaaaggctagagtagatgattcctaatgactttatctagttctaaagtttggtgatttttttcatttatattcaaaaagtaaaatctcagcaactctccagatataatgtccaataacttgaaatcatgaaatgatctaaaaaaattttagtggacaccaaccatgttttaggagggattactgctagctctaaaatcatatttttctctcataaatattgcaaactttcttaatcttggaagatgtttcagtctcatggcacccttagtactgggaatttctcaatgcaggaggaacttcaaactggaaaaaaattcaagtcagaattattccccatggcagaaacaacatttgtatctgtaatatcttactaaataataaaagattcctgtaaagttaaagattttctctaaaagcaacgataagcttatagaatgaaaaaatgccattctctctgtataatagatcagcatcctttattttgtataactagttccctccaaatttcacatacaatgaaacaatcaagccctatcaatatgaaatcttggatcaaatatataagcatatatgataattggtgttgcaataaattcaaatgtgtacaactttgaaagtcttttaaatataattctaaatgcacctgtcaatgacttcagttccagcatttacatatttctgctagcttgaagacaataatctacagggtctcttgtaatactggaagctgtattatacagttagagaacaatgagcagtagtagaatatggtctcgatgatttttcagtatcaatctgacttgactttgatttttgaacattcaataaatggtgaatcctctttcataaaattcaatgcctagctaagacttgttatttaaaatgagttttctgtggctgtgtcttgactcactttcaaaatgtcagttaaatttgactgagtgtccttgaccttgaacttttcatagttggttttgattgacacatctattcaaattgacctttttttaaactgaactattcttctatttgaatgttcattggaagattgttgctgtactctacaatgtaagcattgctttgaatagttagctttttctgacattgatgtgttttaattgcctcaattctaagtatttttgaagttgatgagaatcttcctgattgtgaaagatagtgttaaaatggatgctatcacccattttcttcttttgcagtcaggtattttttcattcagaaacttgtttctaagcatcagaaactttcaaagcaagcttggcaaaagaatactcagtatttggtcttaaagcacatagttgaaataatacagctacttgttgaagactatgcttattaaaatatttactagtattgccaaaaaagatgacaaatatgtatctcataaacttgaattgtgaaaaagtttgaaagatccaaatattaatttactggaaaatagtctttagaaatgctgatataaaattaattatttcattagtaatattaagttttgtaaaaaaaaatgtatgaaagttcttctaccatttttgttcatttctttcttttaaaatgtctgccaatatgcgtattccatagaaaactgtgtatttccatagcaaaagcagttagcctaaaatatatccctgaagggtaggggcattaggagcaaaatggagctagtcgtgctaggccttctttccactgctacaattgtgcttgaaaaatgagtaattctgtctttacaactcatctccctaaatacacagttaaaccagttggcaccatcagtcttcttcctgaaaatctccttacataaacccaaagttcatccatgatgaataatgtgttgcccacatgacctcaggtgacaatgttgccaaactttccaacactacgtggaaggtcaccttttcttcaaccatgaatacccatgtcctcactgtccttcagtccctgttcaacagtctccttgaggcccttccagctttcactagtagtgtcatcatgacccttccaacctttgcacacctaaccccgaagccaacgtcaagtgttttggctttagttaacagcagtaccccacttgtaggtaccacattattttatggttattctctgctgtacaagtactccaaaacctagcagtataaaactacaaagattttactctgcttcccattttgtgggcaagtaaatcaggcagataacagcaaggatggcttgaatatgcttcacagttgctaagccttcagctggggtagccaaatggctggagatggctgggatggctcagggggtgctatatgccagaagcctcagttgtggatattggataggttcccgagatcttctccatgttgcttctgccaagtctagaatccccagtgtgattttgttattcacaagtatagctgggctagaatggttaaaataactggaaatgtctggccttctctctttatctatgtaatctcccacctcactagcttagcctttttcacatgacagtctgaatgtagtacaatttttcttacattccccagaatagatgtcccaatgggcttagaaagaagttacaagccttcttatgatccagccataggattttcagtacctcactttttccacatgatattggcataaaaagttaccaaggccagtccagattcaaggagtaggaaattagagtatacctcccagtaagtcaaatggcaaaacatatgtggacattcttaatctaccacagtgaacaagtagttatatcctaggccgaacagattctttgtacaacactgcatacaagtagtgttaccataaagcacagcaactaatgcagtgtaaaacagattgtgaatgattcattatgcaatagtgtcatgttcagccgtaataaaatagagtatatctcaccattggctctagagataaattttaaataccccataatgcaatgcttagtcactataatggaaacaggaaagaataagtaataggaaagaataagtatcagcaagcagaaatgaagagaagctggggatattaaatgtaattcatatggagcattgacattccattccaagtattggcaggtattgtactctagagagaggttgtggattacagggcaggggcagaatcaatgccctggaaggaataaaaggcaaaataatatgcaaattggtcattaatcaatgagaggaggaaagaaatggaagtagaatgaacaggtggagctcttctagttttatgggacttagcatcagcctccctcctctatgagaccagagatcgaaggtgaaaaagaaattgcttttatctgtgagaccaaaccacaaaggaggtacacaaacaaactggcctcattccatgctaattcttagagttccatacaaaaatcaatgaagcacagagtggtctactacaatcccaagattttggatttttcacaataccaggtcaatactcattttaactgatgagtgagatgaagctactcatactctccgtggctgggctctgcttatttcaaggaggagttagaaaacctacaggcaggtatctgagtattcttccacacagccaggaagagaccagatttgtgttaagacactgactattctgcaatgtaaaaatagcagcagaataaaatgtaatttatcctggaagccagtgtaacaaaataatattaatcttaaaagataaattggaaatatgacaaaacaatctctaaattagaataaaaaagatatatcagtaaaatatcaattcatctaaattatgcacttaggttaggaagtaaaatttggccaattctttttccactaaagctgtgttattataaattacacatgactaactgaggacacgtcagttgtgggtcacatattgaaaattttcttgatactagataagtgtcacaataaaagtaaatgatggcatgagcaaatgaactaaatgggtcttgggtgttatcggaaaggtgatactgacatttcatagagctatgcagccttttatgcctagatgcggttgatgaaaacagtcataaaagcatgagcttttcaaataaacctatggttcattgaaataatttctaataatagttttatggtcattactactcaatgaagccattttatattactacacttgccaaatttgaattaactagtgcaagtgaatgaaattacctataggttcaagcaaaacaaggaggggtttcctagatggcacaggagaatagaaggaatacctgatcaaaaatcagatgcccaaagctttactcctgcctccacacttagcttgcccatggacaagttacctaaactcttcagccccattttctcaactgctatgggaattggttaggctacataatttatttatctttccacactaaaatcatttttttctgcaatgactttttgtactattacctatttcaacaaaacacatcacattacagctggttgttacctctaacattgtgttgtgagtttctcaaagccataatttatcttttctctttatcttgtagcatgtgtagatcaagtatgataaaaagatagcatattttatgccagcttcttttaacacagtgacttttatgctagtcactgtgttaagaagaatctattggttgggtcacagtacagccatgcttgctatgataaagaagaacatagttgcaaaagtgtcacatatttgtgattttctgtctagacaaaatgacagtctaccaagttcttgttaaataattacataattgtgcatgtgctataagcatccataaaatgtatagctactgtagaatgttataattctagacctttcctggtggtcatgtattactagctatttacaaagcacaagctaatgcataaatgtacaatttttttctgactagttctatcgcctttgtgtaacttcaatgagaggtattttatggagcatagacttagtgaaagatagtaagattattctattactagacagtgggataattcactgcaagcaaaaatgtgtattgtctgtcacaattgctaaaatcttcttacctaccagcgttgcctcattgagccaacctatggaccagctgttattcagcttagaagatgttattactgaggagatttcaagagaaagttgatccatcatacaaacactagagaggaatttctcataactttaatgatgtgagtttaaatactactcctgcctagaattctcttaaactggtttgccattgtacttacaaaactgccaatttaaaagtgaggttgagagtcccaacatggtcccttctacctctaggactgtaaagtttagaggagtcctcacctccattctttcaactgagatactgtcctctttcctttgtcattaacaaaccagtataaagtgaacaggttgaatctaatgatatgcgtcaatgagctttgtatttgcattggaggtccaagaaaaaagtagaaagaatatttggagaaaataacacataaatataccaacgcctggatagccttacaccaaacattcagtataaaatgtaacatatatcactgtagtttctaacacaagccttaagaagatgtattctatttctgtatttacatatcagcatacgctaaaaaaagacttcaagtcaataaagcataaaagagaaagtataaacattaaagcaggaaaggataagtgttctataatttacaaagagatgcataccagctcctcgatatttatctcaaagaccaatgtttcatagaatgggctaatgtttcagaagaccacaggaaatatcaatgtggattggagtggtgagcaggaccaacctcatgggcatgtaacccactgggcaccatactgagaagggtctcatacttgatatagtgcttgactgttaccattttgaagtcttcattttaaaacaaagaatcctgcattttcttatgcacaggggcccacaaattacgtagccagtcctggtggtctgtgaaacctttctgaaagagataagacttgaacaaggtcttaacatatgagatataatttgtagattttggtggatcactggggaactgcttgaaggttcagagactgcattttccaccatggtgagagacaagataggttgagtctagcctcatatgctagattaagaacgtggaccatcttgtaggcaaaagggaaccagtgatgatttttgaggtggtaaataaaatcagttttaaaggattaacttagcattggcatagcagatggataagcatgtgagacagagagttgatcacaaagaggatataaagacctcatttcaaagctactattaaaaatataaatttaggaatcagtgctcatacaatgattgctaaaactatataaggcacacaaaaagagaaaatacttttctccggactaagcctgagtattgtgctatcaaataacagatccatctctccccatgtctcttcaaagctcagatgtaggtatgaggaaagctggtccacactccctgccaatgtgtcttctgtcaaagctgaattagacaggaaactccttgagcacagattctatgcctgtatccacaaatcttagcacagcacaaatgaataccttttgtaattagtaatatactgaataaacaataaagggagatgagttaaacagtctcatcatcaggtaacacaaacttttgccatcagattgaatggagctacaagtcagcccaggaaaacatgagattgataaattatgtgaccttatctatttcagccctctctttaccttggaagcactagattaatacagaaatgctaccagcccttttgcattactcacttgtgttaatgtcagataaagaacttcccatttaccttgtggctagggaaaacacaattgtttctcctctttaatctatgtcaacaaatagaactgtttctgcatttttcttaggacttaaattattagaatatggattgaaaattaaatatcaagatcccagtcttgggatgttacagccctatttactcattttgagtcttcaatgtgttgttggctatgtttaatacttcatcataatacacataaatgttttgtcaaatattattttgactattttcttcactagtagtgattaatagttttacttctgataacatgttcagttattcaagcatgtaggttaaatatcatctattttctaaaaacaatattaaaacccatatcatccttaaaccctattctatgagtagtaaagaaaaaactataaaaagactgtctatgtattatttccttatcatagtagggtactttaaacaaattaccagctgggcgtggtggctcatgcctgtaatctgagcactttgggaggctgaggtgggtggatcatgaggtcgagagatcgagaccatcctggctaacacagtgaatccctgtctctactaaaaatacaaaaaattagccgggcgtggtggcaggcacctgtggtcccagctactcgggaggctaaggcaggagaatggtgcgaacccgggaggcggagcttgcagtgagccaagattgcaccagtgcactccagcctgggtgacagagcgagactctgtctcaattaaaaaaaaaaaaaattatcctcttggaagaagaaatactgttactaggaaaatattttaactccaagtttttacgtcagtaacattaaacttatctaaaaatctctgtctcatggctgatacccagttatttatgctagataagatttagaaaactaaaaatgcttaatacataaaatgcttaatgcttttctacaataagacagaaaggatgtgaggaatatttatatctaaaataaagctaggtatttccatagcttactctagctatggaaaatattgatacccagtttgctaagagagtgaataccaatttaaaaaccttcctcttggctaagagtgcaattatagtgcccttcaacagataaattttatcagacacttactatatgccagacacactgctatgggctttactcacattatcatattgaaactctgagagaagctctgagcaatggagtgattttcccaaggtgaatatctaataagtggtagagcagggattcacacaattctgtcattctagaacccacatatactcttgaggtgttttttccactgtctttttccatagtctttttctcttttcctaacttactagagaggaaaaggggcagcagggccagaggtattgtcagctacacacaggaaaggaagcaagccttcatgcattcatcatctcgcttaatgatccttggctgcactagtgctagctcagctttgggaatgcccatcgtggaccttgggggagacatctacgaatagcaagtgctgattcagagacatgaacaaagtgacattggagcataaacagagggaaagctaaggaagcctagggagagagagtccagaaaaacctctgagctgtgtctaaaagaatctttccaggaaaagaaaaaagaaagagcacctgcaacagaacaaaaaagctatgcaaacaggctatgggaagtatgcctatgtctaggtgaatgtaaggttggtgttgtagaatgacaggattaagttgcaggaggtagaatcatgctctaaagagctacgtcaaaataagaagtttggactgtattctaaaggcaacaagagccagcagacactttgaacagcaatgctaaatgagctttcattatttaggaatataattggcagtcttacgttggatgagcaggatacttagtcaaaatgcgagctaagaaagaattcgacttgggtggaaagacagcattttcctgttttatttcagtcattagtaaatgtcacagtaatctagcagttgctctaatgaaacgatctgaccaagatatgtaaatgacatacccctgttgctgctctaacagagagtgaacatacatcctgtttcttaaaaagccttcctttatttactcattcaacaaatagttattaagctcccactatgtggcaggtactatgcaaggtttcggcgtgttgtgttaagcactggttgtggcaaaattcatttgaagcaacaagtagcaggatttgttcataaggtcaacgaaagcagaaaaaaaaaagacagaaaataaagcaagtgtcaaagaaagcaagaaaacaaagggtaattcctaagagacaaaaagtgaaaatgaggtttaagtttaagaaagcaagcatctgctttaagtaaccatttcattaaaagtgcactaaattgtggaggttctctctcaggaactgcatactgtgagctgagatttagtataatgggctcccacatgaattcctctcattacttctcttgaaagatcagtaaatctactgaaagggtaatttaggtttagtgttcacaatctattctttttaacttttaatctttcctgtttaggatgttaaaaatatgatgtagatagaatctaaaagagaagaattgggcccaaaatgagacgattttaactcctcaaatggtcttgatattgatagctatgccacaggctgtagagtttttgcttctgatagatggtgatgtaactttggccagtttatagagcactgcacactgttaatttcaagaaccaagtaaaggacaacatagaaaagataatctatatctcgctctcctgaattccttggacatttttgtaattttaattacatctcttctttatctgattaaacttatttttcactgtaattccatggaaacaaacaggtttgaggaattttgtccaggagatatataaataaattatttgggaagacaaaagtctggaaaatgagactatcagttattaattacaggaatgtgattttatgacatttttcaaaaatgtgagcctgaaaaatcacttataatcagtacttttctactaaactgccaccagtatggtttgtgatattaaaaaacaagcaagcaaataaaaaaaaaagccacaaaacaacatcaacaacaaaaggcactatctttcagacagtgctatttccaggaaaaaaaatcaaatcctccctgatttgtgaggcctcaccttagatttacctttagacataggtcctattctgggcctgtagtgtgcacagccattcctgattaactgagtaccccattaaaagacctaagaaatccagagagaaagaagctaaagtgggcccatcttacccacagtggcaaatataaaaaagctcattcatacagtattaaattatattgatttgaaactaaattattgtttattaacatttagagtttgcttttatttccccatttaaaaaaatcaaaggttttaaagttgctttttctgatttgagagaagtaagcacttagtctagtgaagaagagaagatgaattcagttaggatttaaaagtagcaatttatcccaaagaaattagcagtgtaggacatttactggacaaatatcacattccttgaaagaattcttatgacattttaatgcattctcactatgaagcatgtccttgtaaatgactaaaccagaccatgtcttaacaattatttcatgagagaaaacttcaataccctcagaagttcagattataagactaacaggaaggcaaaaagcaaaacacaacagaaattaaataccagaaagaaatgatctaaaacatagtatatagtaattcactgaaataaatatttatgatttgagtgataaaaagttcacaatgactttgcaccctttctatgaaagctaagagaaaaagaaaattcaaaagatatctggaaatttgtctagtttttatgattttcataaaacccattggtctatctcaaaataaaggcaaacaactaaattcttaaataattatcaggatactgactactaagaacaaacacatcactttttaaaggtctgtaatctgggatgcctctctatgactttcattacatattatttcatgtgctcaattactgttagagaaaatttttgagttctttgatgtcatttcaagcagcatgcatcttatcttattccagtcatcgttagattacaaaatggaaactgaagggaatattggagttttgctatgtcattacctgaaaaataaaaacctcctgagttattgtaaatatcaaccagatctttacatgatcacgataaaggaaatccatctttcctgatagagtaaattaaagacaacactaagtaatggaaggtttgtaccagccattttaaagtataggaacatcacctatcccatgaactaaaacatttaaaagatatcctccatggtactcattgatctccctaactgcagtttttcttcaactgtgttctaatcatcttgcccccaacaagaatcaggtatttggagcttcctttgtgttttgtaactgcactgattaacaaagattcaggctgaccctgatccatgatggtagtggttatgggaggaatatgtctttgttaagtaaagacacatggctttgggaccagcactctttcaactgagcactgtctcattctgttgcctacagtgttcttaggaaaagagctattcaataaagtcacgagataatattttgattgctatcttttcacaattcatttcccacaagttgctgttcctttcaatacgattttcttgccacaaaatacacctgtctctgaatagcaaagcaacatttttgctcacggattatttctcctatacttttaaatatatgagtttgtgcatacttaaatatttttaaatatcttagctgctaaatcattatatgcaatattaaatgttcaacccctttattagcaattgttaaaaacaaaacttctatgtgttccttaaaaaagggcatgtttgatttctgaattgttgttagataaactgtaaggccaaaaatgggcccttttactgaatatgcaaagttcccccttaagccaccttgaactaggcagatttgcaacattttaaactggcacttcatccctctttcagcaagcatcctctgcagatttaatgatcaggaacatccttctgatgcatgctgggagatatggctgcagggtacagaccacagcagacagtgtgtcagatgaggcagaacttcttgttaggggtgagtatgctaatagtgcagtctgaagacatgatcaccataaattatcatacaaaggaatttaaatgcatggactttgagcacatcagtactgtgcattttactttcaattttacaatatatgttattttcgcttaaccttttgcctttgaaaaaattacatggaaaactcctccttagtaacagatgaaaaccaccaaactaacttcagagtccaaaacacctttagtagtaagttgtcactaagtgtttaacctaatgccaaggaaataatctaaacagttgagctactaagtcacttggactacagagataaaatttgtgtgtgtgtatatatgttttgcaaatgaaaagctagtggaacccccaggcatttttttcttctactacttctaagttgggcttccaaaaacagaaaaactgcatgtgtaagatggtggcatttgcaattgttaagtgacaaggatttttttaaagtctgaaaatgtcaacatacaacctctctatgcagaaatgacagttaaatggtttccagttatgaaacagtacaccaaattctgcaatcctaggaagctacatcttaagcaaatgactagagcacccatttcctttagcacagtattccacagtatgggaaatagagatcatagcatgcatttccttccttctttccttccttctttcttccctgcctctttctttcctttcctccttccttctttccttttagctttgtttgaagtacaatatttctacattttcaccaatcataagcatacagatgtataacttaatgaacaatgacaaaataaacacaccatataactatcattcaaagtaaaaaccagaacattaccaagatcccaccaagtacctcttcatttttcatcttatacgattatattttgagtagtatgagtattgcatgcttagatcccttgtatggtctgtacagataaaaacattatcatctatagcaagaaactatattttagattaactggtcttttattcatctggactcttacaatttaaatattaaaaatcttgaacagtaaacataaggcatagagtgagcctcatcatctctatgttttagttatatatatcaccgaatgtatatgggttttggtagtgcatccatcattggttcaagtaaaatgttgtttttaaagaagtgtgttattgggtgattggtagtttgttcattttttgtgtgtttctgttcagaaggctacttgatcttttcttcaaatttatatctagcatgtatatctgtgttaccttattataaaacaccaactttttaaagtattcatcctttcaatacattctattccatttagctaaaaatttctctttgtgccttctgaagttacaagactcatggaactgcaaaccctacactcagtcaaattcatagaaatttgctttctcttgctatgatctgttttagattatgtatatttattgtctgcacttgcctagtaatttagaatgaagctcttaaaattggagctttccaaatcaatatcacaatttagagactgataagaaaccaggtatttttactggactatagggggtaaatttaagtggcaaactaacattctgctttgtaagtaaaattaaactcaacagggtttagaatataattcaggttcagctttcatgttctgctcttttagcctttggctttatgcctaggagatgataaaatgcataaattttcggattatacccaatagcaatttcaaacaggttgctattgtctgaatattcatgtaacattcagcccaagctttcacttgaagtgagtttgatcaagtcaccacttttctattatatatttgcattacttttctaaaattagtaaaaatatcttgtcatttcttcctggtgagttttagacagatttaaacactgaactaagagttctggttctcttttaaaaaattttgtaagtttacagctcctggtaattcaacaagctttgatgtttgaatattgctgtttttaatgttggcttgcgaaataaaatttgaaatagttttactctgccagtctcccttctcacactcctccatttgttggtctgtaaactcatggtattctaatagtatatgccacaggaccaaagttgagcattctagatggagcttttctgatgatggctacaattctggcagcagaatacttaaagcacaattattcaaatatgtgtcacagagagatgggaatattaaaaacaatttccccattcatcttttagtagaatactaaaagtagattggctgagcagttcactttgctcaatgtcttcatcacaaggaacgtacttggatggcaaggattatgttcttatgattctatttcagtggaaatttaagggaaaaaatctatgttctctttgatggacgggaacaacttttttattgtcttccttcccatgagagatagtctataaaattattttatacattttaccaaatcctgcaattcttcaaccttgccgctcatgaacactaaattggagcacaggtgtgtagccacatggcctcatcattgcctatttagaatctgagtgtttctgagtagtaatgttccctgatactctccccattcactactttaaggactattttttcctcaactgctcgtttgcactttctcctcattttgcttgtgaatgtcagtgccattattcacctctattccaccatgatcacctttctccaaagattgcttttttcgtaaataattacctgaagcataaagtcacttgctttcccaaatttaatattcagtgaaccagcattatcacagcaccatgcataatctggagaaccataatagaatgaatatgttagaaaaaattattttgctgaaatataaaaggaaattaaagccacacctggacatctgtgcaccattttagtcacttaagtgtgctataacaatagagaaagcatgactaaatactgctatagggaacctttttaaagatgagtagaactcgatcatgctattaaggaaagggaggtagatatgtaagagataatctcactgaggaggatatacaaattgttaagaaccagtattcccagacaatatcagaagtgatcaaacacaaagtaaaagactctggagaaaggaatattagttttttgttattttattttatagaaattaatgttagaagtatgttttctaaagtaattataagggtaggaaactaaagaataatatgtgcttagctaaactagggtaactaggagtgatagcactatctttctattcagaagaagtgataaaaattcactttctcatacaacttctctatttgtattactctgcttcttagtacaaaacagtaggtcaagaaactttgggaatagtcaaagaataatcaataatctctcgagtccttctgaatacacagcctttcctcaaacttgaacaattttcacttcctgaattacaacttacatgatgaatccaaagtgtattaatagttgaatttgaaacgaatgaattaagctcaggatgtcacttgttgggagacatctaactgctttcaaccatccaccttgaaccccaccctatcacttcctattgctaacagatttcaacctgtctttcaattgaacttccttcatctgtccaatcaattcagttccatttattatttccaataattatttatttccttgaatatctaactttactctctcccaactcaaccacttttcactgcaaaagtaaaatcattaaaattttggccgttttgtcaataaaataagtctacaggtatttgcttataatttgctattcatttgttcacccacctattcattcagcacctgctctgtgtcgggcactgaagtcggcactcagagtggagagatgaggaagctgaggtctcagccctcggctggctctacatcctctagtcctccagtgtgagatgcctttggaattagggtgaggtgtaccatggaagttcacctgcgtacattctcagtgtcacagaggaaatagtgagagactaagataaaacataagcagagctgtggggctggatatgtaatctgtgaagaacaatgccaaatggaaacacaggaccccttgttcaaaattattaataatttcaagacagtgacagaaaggcattaatctaagcacagggccccgaacttgcaagttcgcagatcttgaactacacagctcacacaccaaggaagctagcgctaactaattatatattcatctacagaaataaaagcatgttagcaaacagagggggcaaatcacaacaaagtaaggttttttcatctataaaattagaatatcaaagcctacatcagcagtttattagctttttacacacacacacaaaatatttattttaccccatgagtcatatgttgaaagattttgttcgttgtgttgatgtaatcactaatttatgtttctatttgaattccagccaaagccttctatcatcataagatagataatgttaccaaactatataatttaattccagccaacatcaaagctgacttaccttttagctagttgtaaagtattattggtttgtttgtttcaaatggttgaaagtaacctgaagacaccagtttttacctggatagaaactaatttaggaatctttgattaaatatctccaaattctgtccaagtgctaatctttagtgattctcactagcaagagagaaaagtttgacttttctgcctatacccttggaaaagatgcaagtactatcactttcccaaatgcaatgggaaaataaagctcagtgaaaaccttgagcatgtttctaatatattgttagtttatttgagagttaaagcagtattaatgtgctgtatcttcacatctctcactgcactacccttgtgatccaattagattctaaattgatgtaaatgtctatttttagcatatggccacttctgaatgtttccaagctttaaaatgcacaaatactcaacacaaacatctttggagcatagaggttgcgtagttttccttttccaccattgatctaatatgtaagagcctattgtgcttggagagtgcataagccttcacatggttgagtaatgatttgaacgcaagagagtctccagtgaaaaagacaaaatccagtagttatgaaaaacaaagcttgttttgctaatatgctggtatttggagtcaaaaagacaatgacaaatgttttcagtataactttttaatcctagttaatattaatactaaatacatttgcaaataatattttagagaagaataaaatttattcagctaacataattatttttcaatatttttgaaaactataaaacacagctataaaatgtccttcctcttaaagaaaagctaatttcattcacgctatctcttattggaatattctgcactattgtagaaatattagatcactattattgctattattgtatgggattatttaaatagcttataccaatcacttttctatcttagactttctctaattagtgtgattgacacttataaaatttcttttagacactgaaaagcagttgtttcttttctcttatgcttttcatatggttgcttgctaacctgtagaactcttaaactgacaaaaaagtaacatttttttgtcagtcagatgttcagattttctgcaccagctttagtttggctcattgaaataatagttacctgaagtgatctgactggccaaaatgattaaagcagtttgcatgcatgtacatatatatctgcaaatatgaaatgagcaaacagatgaattgtcattgcacacagacaaccaatcaatacaaactaaatctcttgtattttattcccccaaatactgagtgcctgccaaaagccagactcttttaggcactgatatctccgtcaactgactgagacattctcaggtttcttgatgggagtattttgccattttgaaacaaatattctgacttcactcttcaaatttgagaaaagttctaatcaactgagttttatgtaatacacatttggatttataaattgtaagatgaaattgtatttcactatattttgtcccacagacttaacctatgtttcttacacatccatcctaatataaaaatacagtcacttcacatctgtgtaagtttgtggagataaattcttagtgtgtgggcttgtattttaaaatccaatttcattcactatttagtgagtgcttaccacatgccaggacagttctagagtgcgagagggagacacggtgggacaggattggaataaatgctttctgatgctatgggaaggagtttaactcttatgctacaagtgatgcatatccatcaaaggatcacagcaggaaagggacaggataagatgtgtctttaaaaagaccattcaggaaaatgttgagtgttttagaggacactgtgactagtggcttgctaataaagcagatgggacaataacggtaatcttgacaagaaataagaagggtcttataaaaggcaataatagagacaggaaggggtgtgtatatattcaaaagataggaaggaggcaggatctatagaacttgatggcccactggttatgtaaaatgagaacgagaaggcaaagaagattgccaattgcaatgcttgagtggcccatcagagggacaccgtatactctagttagttagactaacagagttccaagttatacttagagtgtcaaagtagttattaatgaggcccctttatcctcaaaattgtcctggtttagaagataaattttgtggtcccctaatagagaatgatcatgcaatcatagtcattcatgatcacgtttatataatcagaaagatgtggagataagtggatttgtagtaaaggaataacatttagggttctccattctattctattctaagcaaatagttgtgtagctgtggagctcaggagagaaacactggccttgacatccagatttgagcattgttcacattttaaagtcgggtgggaattaaattaaagagcctgtgaaggccaggcacagtggctcacacctgtattcccagcattttggaaggcaaggtgggcagatcacttgaggtcaggagatcgagaccagcctggccaacatggggaaaccctgtctttactaaaaatacaaaaattatctgggcatggtggtgcacacctgtagtcccagctcctcagtaggctgaggcagtagaattgcttgaacctgggagggggaggttgcagtgagccgagattgcatcactgcactccagcctggccaacagagtgagactgtctcaaaaaaaacaaaaaacaaaacaaagagtctgtgaagcataggaaggggaaaatgctggaatggaatgctgagaaacattaactttgaagaggaagaggaatttgaaaaggagatgtgaagttgctgtcagagaccaagagctactgtgtgaaaacccaagtaaatataaatcatggggacaaagagacaagagaaatagaggaaggagaaaatggacaacagtgtcaaaaccaagtgaaatacgaaccaattcacatatcagtgaattaagaaacttggaagtaaatgatggccttggcaagggcaagttcagaggaatgatgggtgtaataaccaaattatggtagatggagagatgcaagcaattatgtgtgaaaggtagcgcagaatcttaagaaaatccttggcttttaagtccaacagactgggtcacatacccacaagctcttactagttgtgaaactttgtgtaagtcatttaatgttaaccttgttatcccttcgttcattcagtacttactcatcaaacatttatagagcacatagtatgtggcaggcatcgagctatgatctagctaaacatgaacaactttattttagggaaaaacacatctttttacagcataatgtgagatgtgctgttacccatgtatgagcagcacattttgctctctgaccatcagcttcattactaataataaacatagctaacatttatcaggttcttcctatatgtcgggcactgcactaaaggctccatattataataattatttcactttatttagcatatcacataaaaacaatatgaaaaacgtactatttttagttccattttgaagataaggaagtcatagagaggtttaagaatgtcacttaaacctctctatgttaaaccacaaaatgtttgaatgtcactaacaagtagaagaatagtgagtagactccaggcagaccagcattttaaattactatactgccttccactgtcaattgccagattgtttcaatttcattgatcatgatatcccctagaaccatttagtttctgatacactatagttcctgaaaaataatacatgtttgtggaagggaagaaaaaaaggaaaaagagagaggtagggaaagagtagggtaaaagggaggaagaaagaaaggagtactgtaagaaacaagagaatggcgtgacaaactttgcctaggagtcagagaatttctatcaagatgatatactcaccgcaacttaaggatttgttgtcatttggtagcccaagaaagaatgaagatattctacattagcttgtaaagacagcactttgtcattaccatctatctctaaggataggtctcacattcacaaatcctctaaaagtaactaatctttgaccacatgaccatgagacaatagtattagtaatgactttctatgttacaccttggcctaaatgaccacaaaccttactgaaaagtctgaacttcctctgatggcccatatcttgccatgcatccaaaatagtaaattctactgactacttcctcagaacatcttgtgggacttcttatctaggtgccatgggttttgctagaaaggaagaacttcgttgccattgcttttggtgttttagtcaaaaagtctttgcccatgcccagatgggatctaattaaactaaagagcttctgcaaagcaaaagaaactatcatcagagtgaacagacaacctacagaatgggataaaatttttgcaatctgtccatctgacaaagggctaatatccagaatctacaagaaacttaaacaaatttacaagaaaaaaacaaccccatcaaaaagtgggcaaaggatatggacgcttctcaaaagaagatatttatgcagccaacaaacatgaaaaaaagctcatcgtcactggtcaataaagaaatgcaaatcaaaaccacaatgagataccatctcatgccagttagaatggtggtcattaaaaagtcaggaaacaaaagatgctggagaggatatggagaaacagggacacttttacactgttggtgggagtgtaaattagttcaaccattgtagaagacagtgtggtgattctgcaaggatttagaaccagaaataccgtttgacccagcaatcccatcactgggtatatacccaaaggattataaatcattctactataaagacacatgcacatgtatgtttattgcagcactagtcacaattgcaaagacttggaaccaacccaaatgcccatcgatgatagacttgataaagaaaatgtggcatatatacaccatggaatactatacagccgtaaaaaaagatgagttcatgtctttgcagggacatggatgaagctggaaaccttattctcagctaactaacacaagaacagaaaaccaaacaccacatgttctcactcataagtgggaattgaacaatgagaacacatggacacagggaggggaacattcacacatcagggcctgccagcagggtgggggtggttgggggctaggggagggatagcattaggaaaaatacctaatgtagatgacaggttgacgggtgcagcaaaccaccatggcatgtgtatacctatgtaacaaacctacacattctgcacatgtatcccagaatttaaaaaaaaaaaaaaaaaaaaaaaaagaagaagaaggacttctaaataaaatgccaccaggaaaactgagcaccgatagacttctttctgcataatctcttctcattctctcatttttaaattttttgcaattgccccaattctggggcaaaaccaaaactcccacatgcctgaaaatgtgcctgaccattcccattgctaaaattctttaactctttgatatttgttgtttttgcctacttatctgtaaattataccaagtgtcatgaaaacaaaacaaaatggcctttaatgttaaaaaagatggtcttaaactcacaaatattaagcaaaatattggaagtacattgtatctgttcatttgtttgaattgtttggaaaaatcatcccatttatttatatattttgtacagacacatctaaaatcagacttttttttctgaacgcattctgtttcctgtgactgtcacctagactgctttggcgtgccttttgaatactgagtagtaatttactgtcatgtgatgtaggagatcagtcagagtgatggagaaactatagggaaaggagcaggccttctgaaaggttggaaggctctgcatagcttcagggagaatagctgaaggcagctgttctctgaccctgaggcagagggcgaggagtatgctgagggaggaggaggcggtaaggtagatgatggttcttcctcccctccctttttaggctcttccgtgtagagcagggccaaagcagccctaactaaggcccataatgttaaagatattactgggacccattgcccttgtacattatgtcttttaagatttcttcccacttgttcccagagctctaggtctagtgtgccttcttctgggaaccatgggttatggaaaaacaacagtttgcattaggtcgcttaattgggcttcagagaccaaggctctgctagctttaagcagctgtttcaatacttttatatactgttgtcccatgatgaatgccctcgaacttggaaatccccagtgggtaccaattacttactgcccactcacttcactttcgttttttgagggttccgtcacaatccattgcagcattcctcacatggggcaccacctgccaggtctgtcccacagaccctggcctacgaatgaaatgagtactcagacacaggtatgcagtgtaagagcagctaggtgattgcctgactctagtggccagagaggagccctgagaagctggagctgcttgcttttattcagtgcaggcacaatgccaaaaacctggagtccatataacctgtaggtaattaacatttatttttccctgttcagggaacatcacgtgcacggatgatcaaaggtcaattcctagtcaacataaataaacaaggctgtttaagataaattcccccacactcccttgtacctactccttctttaagcactcactcattggggcagcgttaagtccagtcctgcactcccagagctggctgctctgagagagaggactgtgggccttccatctgaccgaggaaagccgctggcattgccccagtttggaacaggacatggaggctggcccctcatgaagtttcccgcctgactgcttaggggattgccatttttatcaaattttgacttgcagagatttgcccaatgtttcccctttttacattgggggcatataaaagggggttcttttcctgagtgactttggtctttactattggggcattcctgcttcacatgacctggctctcagcatagaaaacaatttgggtttttctcccatttcactttaggaggctttaatgccacagccaatatctggctttgtgtgtttcagtctccactagctgacatgctcctataagttccccgactgtagctgcctttcctctgattgcctgcattgccttcagctattctcccccgaagctatgcagagccttctggcctttcagaaggcctgctcctttccctatagtttctctcacctctctcactgatctcctacaattgtaaagcctggaatgtacagccttttagggaatatacacttcatatggcctgtttttgacaacccaaatgtggtcaccaagaaagaactccgctgggcgcggtggctcacgcctgtaatcccagcactttgggaggccaaggcgggtggatcacgaggtcagaagatggagacaatcctggctaacacagtgaaaccccgtctctactaaaaatacaaaaaattagccaggtgtggtggtgggcgcctctagtcccagctactggggaggctgaggcaggagaatggcgtgaacccgggaggcagagcttgcagtgagccgagatcacagcactgcactccagcctgggcgacagagcaagactccgtctcaaaaaaaaaaaaaaaaaaaagaaaagaaagaattcaagttccaagtagaagttactctgaaaggcaacccactgactgactggtcacatctcctaagaagacaaaagtaaaattggtaagttcactctagtctctattccccaatcgtactttatttcagtctgtgttccaaaatactaaattcttaattattttcttgatttggtgtaacactacatacgatgtagtctggtcccagaatgcttcttcactgaacaatacaaaatccatgcagattgaacagaggaaggactagcgttaattggaagaaacttttgctgacttttactgcagattgaattttgtcctcccaaacacctggcaaaggtaatgtctccgtttcactaagtactccttaatttggaattacaaagacgattagctctctaatgagttacagcaagtgaggtgaaagagtaggggaaaaaaactgaacaccagatgattctttttaatgccaagaaaaaaaaggctttttcttggttaaaaatcttttaaataaatttctctcctctttcattttacaaaactaaaatatataaatattattgcttagtatgtatgggaaaaatctgatttcatagaacattacatgtaaagattggctgtcatgagtacataggtctctactctgtattattgattgagtatatcagtaaatttacctttagaaacttatgaatctgctggggtacctaacaaattaggaagatgggaaaaatagttcctagctttagaaaaaacagttcattatgaaagaaacctctacaagattcaaaatgggtaggcattgtaaagatgagatataaagggtaattctcaggttatttatgggagtggaaaagtaaaggtgcataaattcaaggtgagcaaaaagtagtggagaaaaggtctgcttgtatctttgctgcaaatgtagaatcaaggtctttggattaccagaacatttagcactgggtttagtctattgctgatacttacttagtaaatattagttgaatttcagtagtttaattaaaaaatgactcaaaatttttaaaatgcctgataatctgtttacccaaccaatcagtatagcattagaaaaataacccaggatgggattttattctcactctggcactaactaaataatcaggcaagtcatcctacctcttttggacttaatctcctcacttgtcaaaaaaaaaaaaaaaaaaaaaaggagaaagaagaaggagaaggcgaaagagaagagggaaaaggaggagaagcagaagcagcagcagcaggaggaggagaagggggaagaggaggagggggtagaagaggaggaggaggagggggaagaagaggaggaggaagaaagaggagaggaaaaagaagaagaagaagaggggaaaataatatttaattttctggtttacataaaagaatgaaatgaggttacaaacagtaaattggtttttggtaactggtagatattgttgatattctcaaatctaggaagaatttccatgtcccttatctttaagattaaatagctgaaccattgttctttatggtattcataggagggaaatagtctatatttctccaataggtgatctaagctcattatctattgacagaaatatccaataatattctgattgttgtgtccatcttatttaattacaatttgataatacattctaatggtgatagagtacattttgactacctctccttcctcaggcatttgaatactgaacatgtctcagattggcacgttgataggcttggcataattgggttctctgtcagtttgctgtcattaggatgagctgtgaatcaccattagggccatctcagtatattcagttaactgagctgatgaaatcttgcattcgtttcctgaagttggttgcacatattaacatctatttatattattaaatattccattgtgttgacatccatccttgagcaaaattgtaatggatatcttagtttacagaaggacttttcatgtgtgaagtaaacactgaagagcttcaagtgtagttaaacaaaatcaccaagaagatataattgagtaaaaagaaagttaaatatataaattatatttcattctagataatatgtgtagaccacgtcatatttagaggtcatagttcaagggtactgctttcatatcagtgataatcatcactatatgcctatgtaatagtcatcaggtttatatcacataaaataagaaataaatatttattataaaatggagctaaatcacagtattcaatatttataaaatgtaaatatgcattctgttaatgtttacataggactttgccataccttcagttgacagtaaagcaatgcaaaaattataataaagagtagaaagcctttcaaaacaccaccaatgacactaaaagatttgaaaataattgcaaagtagaataatcaaataaaatagtcagattttttaaacaataaaaccgaatagtgtgaatgactttcaagttattctagaattgtctttaactgtaaaacattctaggacaaacatacaaaatctcaagaaaaggaaatattttgcaagttacatagggtaattatactgaagtgtcagcattctcatttgtcagcactctgatttggttaatttaaatgttcattaatcacaaaaaaagaatggcataaaacaagcctgcttgaattatatgttttgctcaagaggttattgattcatataattatttctttcatactaactcaagaaatagaactgttattagtaaacttcatttgaaatacttaatcactgttgcaaagatgttttatcacctgatctgtatgaatcagtaaatcaaagctcacatatttgtttcaaaacttcagctcacagatgttaagtcaagataataagcagcatcaatcatacctcactgaacaagatagtctgcattacagacactctccctgtaatccatccattatatggaacatctgttacaaattatcaacaccccgccccacaccccccgacccccgccagggactgctctatttaagtgcttctgcaataacccactgtctccatttctccaaatgagttagatggtggcatcgggatagtaccaagttcactgtcaccgtatgacagcagtcatctttcagtctgtgctgaactccaatggcacactgcataatggtaaatgttcttcctacagttgtatagcagaaatcctcagagcataagctagtagccatcaggaaaccactgacagttctttctccactatatatcagtcattgcctaagttaagcacttagtgtgtaatattcattgtttttcaagtccttaggagaatattgatttgctcatttagttaaatataaaattaatgagcccagatacatgtttgtcaactttggcttatttccatgatcatgaaacatgtcttgtagaacatgttggtttccagaaaaatcatgagaatctaaataaataaagcaagtacaaatttatactgcagaagaagaatattttttaaagtgccctagagtttacccatatattgtcaaggttgcacctgtcttaaagagaatgactttataaatgtgttgtcctagtgtgtcattggaaataacaatttcaaatttactctgtgataggtttgtgaaaataagttacaaggatatctattaatcattaataagtgaatagtgagactgaacaaatgtaaaagtccatatagccacactttattttcttgatgttagtctgcattgcagaattctaatgacacatacacagtaaacccaatattggatttatagaaaactttgtacaaacatggtactttccatattttagcacctcatatggtattttcctacaggatttcattagctcatctgttcttagtgtttatgcaatagtagtttaataaataaatttcaggatagcatctaggttgcgtgaagttttaaataaacaagttacctatttgtaattattcgtaccagtttgtaaaaatacatcctaaaatatctgttttccatttcaggatcaccttcgatggatggacagcattacttttatagtggactatataaagtgtctacaagtgtctacaacttcaactcatgtaaaactacattaaatatttatgcctactttactgcctggaaatcttgattaatttacctttcacctgaagtttgtgataactgaccaggaagtgtttgtttttataaaaaggaaaaaacattattaaataaacttttaaacatagtgctctagggagtcttacgttggcaattaaaagcttcagccaaaaatgacacaagtccttttggctcacaactcactagtctgaacctattacagagctacatacaaaatgaaggcatcagagttcaagtcttcaaacgacaatcacatattcacaaattatacttatcaggatcaatgtcattaaatttctttgtataaggcttgtgtggggaaaggatggtttaatttttgcttttgcttacaatgcaaatggaaaaataatcatgctctaagtaagaccgcaagagaccagcatgcaaaggatcctcagaaactatcactgtcattgaaaccatgctgacagaatctactgaaaaagtaactgcctgaagcatcacaatttacatttgttacaaaaccttactgctaagaaaaaatactcatatgtttttaatgatttagattttccccaaaacagtcctacagcctttgagagctttcatcaaatgtttgccttatcgtttcaatggcttctttctttggacttctctcatatgctatccagtggcttctgattcacactcaaaataaaatccaagttccttgctattgccttctaatccctgtataaactggcacttgctaatctttctgacattatcacctccactctcctcttgctttgctatgctccaattgccatactcattaacacttacaaattttgccattgctgttctctgcctggaaaactcttgcccatattgtttatgtggctggctggctccttcttatttatttctcaactccctatcaaatgttgcctacctcttccccatccaattttcaccacttttttttcttcattgcgtttgttactatctgaaattatctttcacttgtttattgactttcttctctttaaaagtcataagcagtcaccttccctatcttgtttactaccttaacctgagaaaagtggtttaattggctcacagttccacaggctgtacaggaagtatggctgaggaggcctcaggaaacttacaatcatggtggaatgcaaaagggaagcaggcacatcttacatggccagagcaggagtaagagagtgatggcggtgctgctacacacttgtaaacaaccagatctcaggagaactcaccaccacgacagcaccaagggggatggtgttaaaccatgagaaattgcctgcatgatccagtcacctcctaccagaccctacgtccaacaatagggattacaatttgacatgagatttgggtgaggacacagatctaaaccagattaactatacaaatgaatgaatatgtaaccccttttccccaaagagactaattacatttttaaaaatcagacaaaggaggaaacatggaaagaacatggagcagtcattgaataaacaataatcataggcatttaatattaaatgtattgtcatgtctgataacttgtcaataagacagaccagcagataccgcgaaataaaagggtaagatacctgagaatggtgtggtaggagagggtttttaggaattccctttgaagcttggcacttccacctctgtaatccttcagaattttctcacgctgcatcctactttccacctcaccctgttctttgtagtgtgcacgtgcgtgtgcacacacagacacacacatatacactcactcccacaagaaacatgatccaaatattaaaaattaaatgcagatagcaaagaacgattcagatgctgaattctggctacagggagtgtatagcaaagaaattagaaaatctaaaccaaaggcttcagtgttcactgacattttatgtgcaagaggggagttgctatactatcagttgatacatcaaccagctgaagaccttaaaatcttgcccaatttgcagctacagtggccctaacttgtggcctagaagccctgccatgtataccttgatctccaccttgggacaggaaacctctgacaacagcttctttaatctacttcatcaggtgctgcttctcatttatggagccttgccctgagtgtcacatagattccatttaatttgtgtggtcaccagctacacctaattaaattcctacctgaaactgctgacttccatgatacctctcatgccaacttttaaactcaattacttctgtttctgcacatgagcaaaccataaggcataaagaatcaaatgaaacagcactgactcagcaccaataaaattgtgtttttcacttcatatagattttgatttctgttcatcaatatctcagttcatgactgattccccatcatgtagtcatcacaatgattcctgaccttttgaaccctcttcagtctccaaattagcatcttctcacccctgtacttcagtatgatcagaatgtatttcaataaaaattaattttattaaattgaaaataaaacttctgagatcctcctccagactctccctttattctgccaatattcttccaatttatccaagtatgaaattttggaataatgtttcattctcattatttacttttcctttattaagcctaatgtctcagtccacctccagttcaaaaaaaaatgtactggtttccactatctacataattaagtaccaactcattgctgtggtgtttaaggtcttcccttaaccaactttcctacacctttatggactcttggttctctgatcaaacttaagccatcagcttctcctctcttcaaaatgccttagatttttcagtcttttggaatatttgtttacttattccctttttctaccaacaaaatagtcatctttttcctctttaactgctagcccagagcaactgttttcttggaatcctcactgaaaaactcatccctccagcctcaatatctaacaaactttttgagtccaagagatatggagtgaattcctaagtcacttagctggaaaatggcaaggcctgaatgaaaacctatgtttcatggtagctactcagccttcatctttcaaaaccttcaagtttaactttttatttctatcttcacatgatagttcctacaatccttttaggccttttttaaaatgaaggtagcagtggggagcacacaaaatattcagtcatgatttgtgaaatggggatgtttttgctctaaaattctttttctggtttccaatactttgttgaactttgtggtcataggaatatattgctataataggatatctgtaatatgtcccaagtgtctatctaaaagtgataatttcattatcctattggaaaattttcaatcatttaagaaattttactgcatattttgtttacctatctggctgtttgtttcggctagcttttctgtcagttttcccagttgatttgtcacttttaaattctaatggatttatctggaataattagataattggagatctttctttcaggttacttatgctaatataaccagtcttagcaaatataagaaattaccacttttaatcctttatcaactaaaggatttctcagttatcctttatatcttagaatgtgtccacttgtagataatataaagcctaactcaaattgacttaaacaataaagaaatccactgattttcatgacaggaagttaagcaggtgtttgattaatctagtggctcaactttttatgcaagggcccacaggtttgttttgtctctccactccatcatctacaattttggccctacactaaggctggtttccactgtaatcacagattgacttccaggaataacagaggctaaatctttcttgttcacatacaacaggagaaggagctagtgtatttctcccaaacttcatacaaacttgcatcgaaccatctggttataccattttagagaatgtgcttactcctgaacaagtctctgtcacaagaagattgccgtgatctgattggcttaggcctagcttcctgaaccaatccttagcaggggcacatgagattggcaggactgatataggctaatcaaggccattcatataatgaggaggaggcagaggggttaagtccttataccacactgagacaagtagagtgaatattagggagtcaaccacaaagtctactttatctttagcaagcagaggtagaaaagctacctcgaaattcattttcaatcaataaaaatattatttgcccctgctcataatttttaatcttctgaaatctacatgtcctgtctgtgctgaactatgtaaagcagttttatgtagtaatgaaaatcatggagttaaagctcatattcatatgcaaataagaatcagaataaaaccccggagccacttaaggaatgttgtttgacattaccttaggtgagttatctgaactttctgaggctttgcttttcatttttggaaaaggggtatcagtaccaaattaactataaaaattagaaaatatataacacttagcacaatgccttctacttgatagatgagcattaagtcattattatttcagtattttcccccattccattataagctccccagatggtagagattattgaatattccaatgatagtacattttttcatttttgaatgtttcacatattttctattttgctaaaatcaaatgtgatacatgcgttcttgttttcattgatttaaaaaaagggagcagtttgagattgatattgtcaaagttacagactagtgagaggcccagtcagtgctaaaatagtatttgtcatttagaaagtactttgtacatacatcaccctatgtatttttcacaataatgatataaggttgacattatcattctctttataaaatgcaaggaaactgagacttaatgaggttcagaaattttcttaaaccttttgcatgaaatagtactgaaataaaattattctgactctttgtccaaatctcttttctttagatcattttttcttgaaatatagagtacataaacattttctaggcatcttgtacaaaatacaaatcctggggctctagtcatagaagttgaaattcagtagctcttgggtacagctcataaaatttacattctttttttaaaacataccagaaattctgttgctcatcacagtttgaaagttactaagagtctattcatttttgtttaggaaaacagcatagaaaggtggatatctaattagtaacatttaacaaatttgagaaagcagcataatataatcctatttttaacataaatttagagtcttctttcagaataatgctgtaattttgtaaagatgtattactttttctcagattttgattggccaaaagtaaaaacatgtataaaaattaagtcaacgactacactaatctgttaagctaataaaaattattaattcaatgacttattataaatctatttcataacatactacgtgccatgcactgtcccctaggacctgagaatacaatagtgagaaaaaaatacaagcacaattctagccttcttgtacctaaaatctaaagaggaaagccaccactagtaaaacagtcacacaaataaatagaaagttttcactgtgatttcaactactgtatgaatgagagggacatggtactatgaatgtatgcaatacaggaattttacttaggcaaggcagtcagagaagtctgctccaagtgaaccctgagcatagattcaaaatgtgaagcctaaataggtgttaaataggcaaagtaaggagggacaggagtttcatgccgaggaatcaggttatgtaggtgatagattagatacaggaatgggcagaaggatagataatgatgatggtaacagatgaatagacagataataaaagttgagctcgatcaaattaattgaaagcaaaattgcttttggaaaaaaaggaaagtataactgtttgtttctcatttccattcttgactacccctggtataaagggttggttactctcatgagactgaaaacagtaggaagaggtcacttagattagattagtaaatagcaaacaaatgtaagaaagccctctaggcttcatgagtaacgtaatggtggtcagaaagtatctgaggagaaggtaaagaaggaatgacccaatcccacgtgaagttgaactctgccagcccgggatgtcaagagtatatcaggagacatcatcttgtataaaaataaatattctatcaataataccatacttcctaaataagggtataccataattcttcataactttattataaaggtgaatacatcagctttgcaggtattaatagctaatgtactatgaaaagtctagtcacattattaaatattattttttattgaaatattttttcatgactatttctacatatccttttccattgagtcaacacaaactggtcctttgtactggatggttcattgtagatgagtaaaccgcatgataaaaataagaattagtcaccatggcctgagtttttcaatttatctctctgcattaatctaatcttccagacagtagctaaacctccttttcacttggtattaggatgtgtttaggacattgcttccatgattgattgccatgcctgcttcccttttctccagagcatattcctgcatgtgtttggaagtgtctgtcctcaaacagtatttatagggttaaaaataaaacaactggataacgagcatatttgggatcaaaattctcactttaattttaaatgatttaaaacaaagacctgtttaatgttttgaataccagcaaatttcacttttcatttaaaactactatatagcagaaacaacaggggtcaggtagggtggctcgtgcctgtaatcccagcactttgagaggccaagtttgggactgcttgaggccaggagtttgagaccacactggttaacatagagagaccccatctctataaaaaaattaaaaaattagctgggcatggtggcatgcgcctgtgtctctagctactcaggtggctgaggcaggaggatcgcttgagtccaggaggtcaaagcaagagtgagctaggatcatgccactgcactccaacctgggcaacagaatgagaccatgtctctaaaaaaagaaaaagaaaaacaaaaaagcaggaaagtccttaaaatcaaataaaaatgaaaacaaacaatagacgtataaagcaaacagtaatgtataacaataggtgtatttgttgaatcagcaagtctcagaatttcacagaaaatatgatgttatctatgtgagaaaaagccagaaaagttgcttggcacggagaattcatcttagcattgtgcagaggctctaagaagcactcctcatgaaggactgaacaatcacaccataaggactctacagcctggcaccactagttgctgtctacaaggagaatgagcaataatttcacaagaagtcaatacacaactttctgtttgttagcacatgaatttatcataattggacaaatttgacccgttatcaagactaaagcctgttcttgcttcaatgattttaccttcaaagcaagaagactctttttgcctctgtttctgagggaggaattttccactttcaagtactacttcctcatctgaaaaataatatggtcaaactagatgactccaattaatttaaaaattctatgactctgtaacactgctaaattagtatatgaaattgtaggtctttatttcatattaccagtattatagtaagagctttaaagattccaaggagatatatatatatgtacacatatacattttattcacttttcagctttaaaagacaattgcttctcgaaggaagattttctaactgaacattaaatcaacagaaagagttgatctggtatcagtctgcaatgctggggaaccctttattgaggctagattgaatccatgagaacatggcttctgctcagggcttttgatttgtcatttgctcagcagtcctccccatgaagaaatgaacacactgtgcccatttttcaaaattgactatttccaaatacagtatttaatttagtgatcctttataatagcattgtccctgaggaggaaaaaacagttgtcagattactggccatttgacactgaatcattataaccaagtataaaatttaatgagatttctactgaatgagtggcatttgtgtatcatctggactgtcacacatttgtcatcactgagacgtttgcttattaatctatcttcaatgatgccttatgtaaattagctgaaaaagccttttaggagaacctttcctccctgatttattttaaaaagtcaaaaaatagcaaaagtagaatcattaacaggccttaaaaaacaaagatactgactatatcaataggttgatgtaattcactcctaaatatatacaagaagcttatgccaggcagcattcagtatatgatgtataaaaatattttttcagaaataaagtatcgataagccaattctaatattataacagtaaatcttgttttcacctttttatggttaaaatttaatgtctcttagaaggtaaatcacgctgccaattattcagaatatctgtacgttaatatgttcataaaagtatttcagatttaccatcatttagaaaagttagctgtccagaggctataacgctctcagtttctaataaggatcatccttattattaaatcatatgaaaggattattttcttcattcatggagcttgtctgtcatttttattaccactctaaacttggatgaaaaaaaaccctgttaacccaaatatagtttgatttaacaaaaatgaaacttaaatcgcatctccgtctaatataattatattttaaaacattcttttacttgttaattgttatacaacattccacactcaaaatataactcctctatcctttcttcctttatttatttttccttctttttttccctttcttcatctttccttctacaaatatttattgagggtctaattgtatgtcaagtaccatgttggacgttcagataagtggaagttacagaaaaataaataggcagtttaatggctgcctaatatttcattataagaatttagaatttaaacattacgtgattattgggcaatttgttgtttacaatggtttataattataaataattacacagccacaatcagtaccttggttatataaatctttgtccctctcactaattattttctaagaaccatatttgggcaaatagacaaatatcaaaaagaataaagaggatttattatgttgtaaattatatcttttgttccagctgaaagtttaaaaattatttaattattacctattatgaaagcaatatacccttctttaagatggctaatttaaacattttcatagaactttaatactcagagaggcaaattattttatttaaattaacaaagagttgtcttccacagtgtctcccactgagccttgcacataggcggttgttaaatgctctttgaagagatgaataaatagaatggagggaatgaaacagaataaatgtaacaacatagaagagcttaataaatgagtttgttggcaattattcctatatggacacgttagctaaatttcaagtctttttcataatatttgagggtcctcctgacagagtttcatactgatgaaaacactctttaggcaagttccagttagccattgctgccccaaaacttattagcttaaaacatcaatctgttattttctgtcatgattttagcagctgacaggccaggcaattcttgctcgattttctcatgtagatgctggctgaagctggagtcatctgaaagcttcttttgtttatttttttaattcacaaataataattgtatgtatcccaggatgtacatagtgatgctttggtacatatactgtacagtgatcagatcaaggtaattagcatattcatcatcttaaacatttatcttttctttgtgttgggaacattcaatatcctcattcttgctatttaaaactatggatattgttaactatagtcatcctacagtggtctatagccctagaacttattccttctgtctagctgtacttttgtatcctttaacaaatctctccctatgctattctccccctttcccttcccagcttctaatgtcctctgtcctttctacttctatgagatccttttttttagctttcacatataagtgagaacatgtggtgtttaactttctcttcctggcttatttcacttaacataatgtcctccatttccatccatgttgccacaaatgacagaattacattctttttatggctgaatagtattccatggtgtatatatatcacattttctttatccattcatctgttgttggactcctaggttgattccatatcttggctattgtgaataatgctgcaataaacataagggtaaagaagtctctgatatactgacttccttttctttggatacatgcataatagtggaattgcgggatcacatggcagttctctttgtagttttttgaggatcctctgtactgttctccatagtggctatactagtttacgttcccaccaatagtgtgtaagacttcctttttctccacattctcaccaacaatcgttatttttgtcctgctgatgatagccgtcctaactggggtgagatgatacctcatggtggttttgatttgcatttccctgattatcagtgatgctgaccatttctttcatatatttgtggtcatttgtgtgtcttcttttgataaatgtcttttcagatgtgactgttttttaatagcgttgtttgtctatttgctgttgaaatgtttgagttcctcatatatgctgcacattaatcccctttcacgtgaatagtctgcaaatattttcttccattctgcgagttgtcctttcattctgttgattatttcttttgctgtgaggagctttttagtttggtataatcctatttgtttatttttgcttttgttgcctgtgcttttgagatcttattcataaaatcttttccaaaaccaaggtcctgaagcacttcctctatatttttttctagtagttttattgtttctggtcttatagttagctctttgatacattttgaattgatttttgtatgaggtgaggggtgagaagtctagtttcattcatctgcatgtgaacatccaatttttccagaaccatttattgaaaagactgttctttccctaatgaggtctgatctgaaggcctcttcactgacatgtctggtgcctggacttggatggctagaatagctggatgcaagttggatctctctctccacagacctctctaaatagctaatttggacttcttcacagaatggcaatttccatgtaattggactgacaactgtcttttcctataaaaagcattccaggaaacctgtggtaaagatgcaaagcttaacctcaactcaaaattcacacacagtcatttctaccattgtctactgagtcaaacagtcacaggccagctcagatttaaggaggtgaaaaaattgactccaccgttcaatggcagaatggcttgcatgttcagggagtaaaggaagtgatagtggccaccttacacacaggcagacacaaagtgattaatgctttcttcaaatgccatctctatctctacaacataaagtgtggctgtatgtgttccctaacacatactttttctctttctttcttcagttgaagatactttctaaattaacagtgaaaacagtaaaggtctctgtactccttgcttccttccacaaattaggatttacaatcacatccaaatttaaatctcagctgtgctgttccctagcagagtgatttgagcaaataacttctcattagaatgaactctctgatacccagtgcctaccataaaacttaacatataataaggttattgactaaataatttattattatttattaactaagtaatctctttgagattctattacctcctctatgaaatggggataacaatgcccacctcccagtgacgaagaagtaaatgaacaatttaatgtttgcaaacacttagtaagcaccttaatacagtacaatacagtgagattatcacagctattagtattattatagttaatattcttctcactattaaatcattataatgtattgtagatgctcctctacattcctgtcaccacagtctaaaaacttgttagacatcttcttcaacacctggatctcatttattttctttaccttatccttagtcgctattttagtggcttcaacattgatattgggtgatgcaatagacatattttttcataaatcctagaccttataaaccctgtaataatattctcaactttgctttagataaacaaaaaccaacttcttactcaaaaccaccctacctctaaaatcacaaatctgtcaattttctcttgcaacacaattcctactcttatattttcctcccataacaatccagtctccttgactccttttttttattctagtctgtcagccccattctggcttcctctgacttgactccatggttacccacagcattgtcatatttgatgataaacaatatcagaattacaaactcccaagcctgaatggaccctactgactgctttcctggtcttggtcctgactttcctatctttactgaattggtcagtttcacttcaaaatgataccgtctaaccaaatttgaactctagtactattctagaatatttgtattttctcttcattgcaccctttcacttttatcatgtgctattccaaaactttcctgttatatcctccagcccccaatctaatttcccgcaatcaccctaactcttgtagacagtattatattcttaagtttaaaaaatgagtaccttccaaaatgagttctctcaacgtttccccttaccatctcgaaaactttaattattttgcttccttcatttatcttagaggaaaaaattgtcatttcttctcaaggttgccctctagacctttgcccacgattccaactttcggtcaccttcctgatagaatagtctctatcttctatatctttagtctcttgcatctgctggtggttcttctcaggtaacaacgacaacaaaaaaagttcgttccttattttctaaaaatgtcatttgccccaatgaggcttttaaactttttctccatcttactgaagctgtattgttgatactctctattcaaaggtcttcaccaactcctccatctgttcagcatgcaaccatttcttagggtttagctcatgtctcttaatcaacaaatccagagagcatttgtacataaagaccaactcagaaaatacttaaaatacttaagtttttgaaattcaaaataaaacattattgtgactttaattgtccatactatggaatggaagaactggcattgctttgtagccactaaaatataaatacctgtgcatttttaaaatactattcaaaatcaccactagaaataaaaacacaatggcacatttctcctcaaatctggttataattcgttcttaaagatgaagtccatatgcacacagattagtcaataatattctataccattctttcataatcaaaagggaattaatcctcctttattcactacctccccactcctaccaaggaaaaaaggaagctaatcatagatcacagtctcctttgaactccctacagaactttatgtatgtctcaggtctggcatatgtccttaccttgtctatactatcattatttcagaaccttttgcacctcccctgttagagtctaagctatgtgtacttgatagtacacatcatagggcttgtacattgtatgttctctgaacatgaacattagctctagccacttgtagtattttagtaaggatgagattttttttttgtctctgtagcactgcctatcattttctgttgctgcctctgtaaactgattgatttcagcagctgcatttgatactggcattcacatctttgtgtttgtttctcattattttttctttttctataaaatataatgctaattggtaactgcctctgggcacaaagtagcagaaagaaatcaaatctacaattaagtttcccccagaaatcctagactccaacttgcatccatgactttttgttgtcaattttaattactaaattcatatttcattaaggtgattacatagttggatgtgctacatattggaaatataatttctcatggctcctgataataatttgtgcttaactttatccattgcctttgacctataggacccccaggcccacctgggatagtaattgttgaggaaataaccgaaagtacggccacactgtcctggagcccagcagctgacaaccacagcccaatctcctcctacaaccttcaagctcgcagcccattttccctgggctggcaaacagtaaagacaggtaagaggcactaaagcaacatcagatataaccagagtggccttctatctcataagctatatttggctaaggtcttactatgatttttttggattctgaaatctctttgttatttcttacaatattgacaattctttgcttctttttatgaacctgagaagagcaaggtaccttgctttcctcttttcagttcccaaagaggaactatatcatgttggcttatttgtttgttgaaataaccttaaactcacatataagttgcaaaaatagtacagagttcctgtggacccactccccagcttcctgccatgataaaatcttacataaccatagtacaattaccaaatcaggagatgatgttggtgaattgatgttaactaagattcagaccttattaggatctcactagttttgatatgcaattgttttagtgtgtacttatatgagattctatgaaattttattatgtagactcaagtaaccatcaagacaatcaggatatagatcagtttcattagctcagttccttttgctactcctttctagtcatacatctcttttatttataaaaagaaaatctattcagctggcaagatggctgaataggaatagctctggtctgcagttcccaatgagatcaacgcagaaggtgggtgatttctgcatttccaattgaggtactaagctcatctcattgggactggttagacagtgggtgcagcccatggagggcaagctgaagcagcatggggcattgcctcacccaggaagcatagggggtcggagaattccctcccctagccaagggaagctgtgagagactgtgtcatgaggaacagtgcacaccagcccagatactacacttttctcagagtcttcacaacccacagaccaggagattccctcaggtgcctatggcaccagggccctgggtttcaagcagaaaactgggaagccatttgggcagacatccagctagctgcaggagtgttttttcataccctagctgtgcctggaatgccagtgagacagaaccattcactcccctagaaagggggctgaagccagagagccaagtggtctagctcagcagatcccacccccatggagcccagcaagctataagattcacgaaattctcaacagtctgaagttgacctgggatgcttgagcttggtcaggggaggggtgtccaccattactgaggattgagtcggtggtttacccttatagtgtaaacaaagccacctggaagtctgcaatgggcagagcccaccgcagctcagcaaagctgctgtagccagactgcctctctagattcttcctctctgggcagggcatctctgaaagaaagacaacagccccagtcaggagcttatagataaaactcccatctccctgggacagagcaccagggggaaggggcagctgtgggcacagcttcatcagacttaaacgttcccgcctgccagctctgaagagagcagcagatctcccagcgcagcgctcaagccctgctaagggacagactgcctcctcaagtgggtccctgacccccatgcctcctgactgggacacaactcccagcagggagttgtcaccgacacctcataaaggagagctctggctggcatctggtgggtgcacctatgggactaagcttcaaggaggaaacaggcagcaatctttgctgtcctgcaccctctgctggtgatacccaggcaaaatgggtctgaagtggacctccagcaaactccagcagacctgcagcagagggacctgactattagaaggaaaactaacaaacagaaaggaatagcatcaacattaacaaaaagaatgtccacacagaaaccccatccaaaggtcaccaacatcgaagaccaaagatagataaatccacaaagatgaggaaaaaacagcacaaaaaggctgaaaattccaaaaaccagaacacctcttctcctccaaaggatcacaactcctcgccagcaagggaacaaaactggacggagaatgaatatgatgaattgacagaagcaggcatcagaaggtgggtaataactcctccaagctaaaggagcatgttctaacccaatgcaaggaagctaagaaccttgaaaaaaggttagatgaattactaactaaaataaccagtttagagaagaacataaatgacctgatggaactgaaaaacacagcacgaggactttgtgaagcatacagaagtatcaatagccaaatcaatcaagctgaagaaaggatatcagaaattgaagatcaacttaatgaaataaagtgtgaagacaagattagagaaaaaagaatgaaaaggaacaaacaaagcctccagcaaatatggcactatgtgaaaagaccaaatatacgtttgactggtgtacctgaaagtgacagggagatgggaaccaagttgtaaaacactcttagggatattatccaggagaacttccccaacctaggaagacaggccaacattcaaattcaggaaatagagagaacaccacaaagatactcctcaagaagagaaaccccaagacacataatcatcagattcaccaaggttgaaatgaaggaaaaaatgttatgggcagccagagagaaatgtcaggttacccacaaagggaagcccatcagactaacagtggatctctcagcagaaactctacaagccagaagagagtgggggccaacattcaacattcaacattcttaaagacaagaattttcaacccagaatttcatatccagccaaactaagctttataagcaaaggagaagtaaaatcctttacagataagcaaatgctgagagatgttgtcaccaccaggcctgccttacaagagatcctgaaggaagcactcaatatggaaaggaaaaaacccatacagcctctgcaaaaacataccaaattgtaaagaccatcaacactatgaagaagctgcatcaactgacaggcaaaataaccagctagcatcataataacaggatcaaatttacacataacaatattaaccttaaatataaatgggctaaatgccccagttaaaagacacagactggcaaattggataaagagtcaagacccatcagtgtgctgtattcaggagacccatctcacttgcaaagtcacacataggctcaaaataaagggatggagaaagatttaccaagcaaatgaagagcaaaaaaaagcaggggttgcaatcctagtctctgataagacagactttaaaccaacaaagatcaaaaaagacaaagaagggtattacataatggtaaagggatcaatgcaaaaagaagagctaactatcctaaatatatatgcacccaatacaggagcacccatattcataaagcaagtccttagagatctacaaagagacttagactcccacacaataatagtgggagactttaacaccccactatcaatattggacaaaggaacaagacagagaattaacaaggatattcaggacttaaactcagctctggaccaagcagacctaataaacatctacagaactctccaccccaaatcaacaaatgtacatttttctcagcatcacatcacacttattctaaaactgaccacataattggaagtaaaacgctcctcaacaaatgcaaaataatggaagtaataacaaacagtctctcacaccacagtgcaatcaaactagaactcaggattgagaaactcactcgaaaccacacaactacatggaaactgaaaaacctgctcctgaatgactactgggtaaataatgaaattaaggcagaaataaataagttctttgaaatcaatgagaacaaagagacaacatactagaacctctgggacacatttaaagcagtgtttagaaggaaatttatagcactaaatgcccaccggagaaagcgggaaagatctaaattcaacaccataaaatcacaattaaaagaactagagaagtcagagcaaacaaattcaaaagctagcagaagacaagaaataactaagaccacaatagaaatgaaggagatagagaaacaaaaacccttcaaaaaatcaatgaatccaggagctggtgttttgaaaagattaacaaaatagataaaccactagccagactaataaagaagaaaagagagaagaatcaaatagacacaataaaaaatgataaaggggatatcactactgatcccacagaaatacaaactaccaccagagaatactgtaaacacctctttgcaaataaactagaaaatctagaagaaatggataaactccaggacatctataccctcccaagaataaaccaagaagaatttgaatccctgaataaaccaataacaagttctgaaactgaggaagtaattaatagcctaccaaccaaaagaagcccaggaccagacagattcacagccgaattctaccagaggtacaaagaggagatggtaccattccttctgaaactattccaaacattagagaaagagggactcctccctaactcattttaagaggccaacatcatcctgataccaaaacctgacagaggcacaacaaaaaaagaaaatttcaggccaatatccctggtgaatatcactgggagaatcctcaataaaatactggcaattcaaatccagcagcacatcaaaaagcttatccaaaatgatcaagtcagcttcatccctgggattcaaggctggttcaacatatgcagatcaataaacataatccatcacataaacagaatcaatgacaaaaaccacatgattatctcaatatatgcagaaaaggagtttaataaaattcaacaacgcttcatgctaaaaactctcaatgaaataggtactgatggaacatatctcaaaatagtaagagttatttaggataaacacacagctaatatcatactaaatgggcaaaaactggaagcatcccctttgaaaactggcacaagacaaggatgccctccatcaccatttctattaaaaatagtatcggaagttttggccagggcaatcaggcaagagaaagaaataaatggtattcaaataggaagagaggaagtaaaattgtctctgtttgcacatgacatgactgtatatttagaaaaccccattgtctcagcccaaaacctccttaagctgataagcaacttcagcaaagtttcaggatacaaaaatcaatgggcaaaaattacaagcattcatatataccaataatagacaaacagagagccaaatcatgagtgaactcccattcacaattgccacaaacagaataaaatacctaggaatagaacttacaagggatgtgaaggacctcctcaaagagaactacaaactactgctccaggaaataagagaggacacaaacaaatggaaaaacattccatgctcttggataggaagaatcaatatcatgaaaactgccatactgcccaaagtaattaatagattcaatgctctcctcatcaagctgtcattgactttcttcacagaattataaaaaactactttaaatttcatgtggaaccaaaaaagagcccgcatagccaagacaatcctaagcaaaaagaacaaacctggaggcatcacgctacctgaactcaaattctactataaggctacagtaaccaaaacagcatggtactggtaccaaaacagagataccgaccaatggagcagaacagagacctcagaaataacaccacacatgtaaaaccatctgatctttgacaaacctgacaaaaacaagaaatggggaaaggattccctatttaataaatggtattgggaaaactgactagctatatgcagaaaacagcaactggaccccttccttacaccttatacaaaaattaactcaagatggatttaagacttaaacgtaagacctaaaaccataaaaaccctggaagaaaacctaggcaataccattcaggacataggcatgggcaaaaacttcattactaaaacaccaaaagcaatggcaacaaaagccaaaattggaaaatgggatctaattaaactaaagatcttctgcacagtgaaagaaactatcatcatagtgaacagccaacctacagaatgggagaaaatgtttgcaatctatccatctgacaaagggctaatatccagaatctacaaagaacttaaacaaatttacaagaaaaaaacaaccccatcaaaaagtgggcaaaggatatgaacagacacttccccaaaagaagacatttatgcagccaacaaatgtatgaaaaaaagctcatcatcactggtcattagggaaatgtaaatcaaaaccacaaaaccatctcatgccagttagaatggcgatcattaaaagtcaggaaacaacagatgctggagaggatgtggagaaataggaatacttttacactgttgatgggagtgtaaattagttcaacctttgtggaggacagtgtggtgattcctcaaggatatagaactggaaatatcatttaacccagcaatcctattactgggtatatatccagaggattataaatcactgtactataaagacacatgaacatgtatgtttactgcagcactattcacaatagcaaagacttggaaccaacccaaatgcccatcaatgatagcctggatgaagaaaatgtggcacatatatgccatggaatactatgcagccataaaaaaggatgagttcatgtcctttgcagggacatggatgaagctggaaaccatcattctcagcaaactaacacaggaacagaaaccaaacaccacatgttctcactcataagtggaagttgaacaaggaaaacacatggacacagggaggggagcattacacactggggcctgccagggagtggggtcctaggggaggaatagcattaggagaaatacctaatgtagatgacgggttgatgggtgcagcaaaccaccatggcatgtgtattcctatgtaacaaacctgcacgttctacacatgtatcccagaacttaaagtataataaaaaaaagaaaatctgatataaaattacactgcacagcattttaatgcctacttccaagatgtttgcattatagttgcattattttaaaaattttttcatctctaatcattttcttttcattttacaacttcccatctctctccaaatgtggctgtccagcagggatatgtaaaatcacacttactggatagttactagacacttatttaacatactggtatttgaaaagtgtacagtaagtctacagaagagaatctttagaagcaattgtccatactgagtaacaactgtgtttttgttttaaactctaatgacctctattgacctgttttgaaatatagaaatcagtaaaatatttgcacgcagtaaccttaaaactcaaccagaatattatgagggtaaagtggttcattttattgtgtaggtaaatgaaatttgagtttttgtatgaaacactgtaatatcagaaggagaaaatttgtttatctatatgcagaatttaattcagaatttatttgatatttaggctcctgcattgttagacctcagtttgatcattatagtgtctataaacatatttattatgcatatatacatatttattttgtattatagataattgctcatatcagcctcattcctggatccattataaccctgtgatacctttaaagacctcaaaattggagaatttctaggtatggtagttaattcaggaaggacacatttaaaccacatgagcagatttactcaaaaattcttataaccttcaaccctgtgcttcaatcttattcttagtatgacagcttaaatctttggctctgcagccaggagatgacctcaccttcagatctggtgttgtgcactcatctaattcatcctcttgcctacagccatgctccctgtctgctcttgccacactatccatgcagcttacttttggagaggttttccttgtggatacattgcaatacatgtgtgttttactactcatcctatgcccatagcaatccagtacctatcttctacctgctacatccatgcttcgctagttacacttatgttctgattctcacctatggttttctttctcagttcacctgtttttactttttgtttatatatatacatatgtgtgtatatatatatgtatataaaaacatacataatcatgtatgtggaggatttaggcatttgaattatttttgtgtttgttttagaagtccctactgtaaagttgcatctttatctttctaatattatttgaatgctagaaatatttttaaatttttattttactttaagttctgcaatacatgagcagaacgtgcaggtttgttacacaggtatatgggtgccatggtggtttgctgtgcctatcaacctgtcatctaggttttaagccccacatgcattaggtgtttgtcctgatgctctctcctcccctcatcccctgacagaccccagtatgtgttgtttctctccctgtgtccatgtgtcctcatttttcagttcccacttatcagggagaacatgtggcatttggttttctgttcctgtgttagtttgtcgaggatgatggcttccagtttcatccacgtcctggcaaaggatgtgaactcattcttttttcatgactacataatactccgtggtgtatatgtgccacatttcctttatccagtctattatttatgggcatttgggttgcttccatgtctctgctaatgtcaatagtgctgcaataaacatatgtgtacatgtatctttatagtagaatgatttgtattcctttgggtatgtacccagtaatgcgattgctgggtcaaatggtatttctggttctagatccttgagaaatcaccacactgtcttccccaagggtcgagctaatttacattcccaccaacagtataaaagtgttcctatttctccacagcctcaccaacatctgttttttcttgactttttagtaatcgccattctgactggcatgagatggtatctcattgtaattctgatttgcatttctctaatgataagtgatgttgtggggtttttttatatgtttgttggccacataaatgtctttttttgagaagtgtttgctcatatcctttgcccactttttgatggtgatatttttcagagttcttttttaattcaattcagcaagaacaacacttctaaaaacccaagaattgtgctgtacttatacaaaagttttccttcagaaaacgatttctgcaagtgatcaattgtatttacccttcatggtgctagggctatcactagatgtgtcctcttctaactcatttctccaaaacgcaccattaattgcagctattggcagaggcatgctgtcctcagggaaagcctgatgaggagctgtccacaaggtttgcatgctccaaaatagctcttttagatgcttcctggttttagtaccatgctcattctcacaatttctttcatgcctgtgatggggaaataagtctctctggagccacaccagctccactaggtcatgggccttttggtttcatagttgctccctcattctaaattaatttcaatcaaaattaactctaatttaacaatatccattagaaaaaaaatgaatctggagtttaaactcgctgacacagttaatgcaattgataatctactacttgaaaagcatttaaaatataccaaaatgagcataaaaaataatgtctcatttttggcaaatgaagtgagaggttccacatgaaccctctagctgagcacatcttggatttaacgtatgaataccgcctcctgcaaatgagactaaaatgtaaatgggaataacttgtttattttgaaaaaagtatgcaaacagccataacatctcacttgcagacctcttttccactcaagcaaatggcttttgacttagaaacctgactttcttttttatattactgagaagcattagctgacatagtttttgattatgtctacttaggaatataaaattgcctataatcatagaattcattggtctttgtttacttaactcagatatgcttcttaaatattctatcagtggatatgtcttctatctgtggatatgttttgcacagattggttacatttttcaactgaacagatttatttggtattttattaattaaattggtggctggatttgggtggctcatacttgtggtctcagcactttgggacatcctgaggtgggaggatcacttagggccaggagattgagacgagcctggacaacagaaggagatcttgtctcaaaataaacagtcttagatgtgattcttttgcttggaaaggcagttcaaaaagatgctttccctgagtcactataaggtcttccactgtctttcgttgctgtcatgttctctctgatgcacaatgttttctttgaaaccaagttgtccctaaagttctggaaataataactttataaaaagatgctgcaagacttttaaaatacttactttggtataaatcctccattatccttaatctccataatattgcatttcaaatcaaaaccctaattgtataaaagagaaagtttttactttctttcatattgcattatatttcaccaaaaataataataccttcaattaatacttataattattttatatctcttacaagcaacagggaatttagaatttccaaatctttttttttttttttcactttaaagagaggaatgaagggtggtggaaaggatatggacttggaaagggagtctttaaaatctctagttatgaccaagaggatataaatatgcataactttggaaggaagattatttttatatgtattttacataaagcttataataattacatcaagattcaagcagaattaattaatattgccaattctgatcacactaggcaatttgaactctcattcatttaataaaagtttaccaagcgccttttaggaagtgttctaggcacatgcagtgtatcaatgaacaacaccaaataaataaatccttgcccttgtgaagactgtattcttacaggtgaagacaaacaataaacagagaacataataagaaagtaaattatatagtatcttagaagttgatgagtactatgggggaaaataaattaaatggagtaagaggaatcagaagtactatggcagggtcagtgtatcagtcaactcaggctgctataacaaaattccatggactgagtggattaaacaacagaaatttactttattacagttctagaggttgggagttccaacatcaagtggccttctttgttttcacatgaatcaaccacacacacacacacacacacacacacagagagagagagaaagagagagtgagcaagctcaagtgtcccatcctataaggacactaagatcacagccccactcttatgacatcatttaactttaattacttccttagaagctctatcaccaaatgcaaccacattaggggttaggactttaatagatgaatttcaggaggacacattagtccatagcaggaaggttgtaatttgaaatagagtggtcagggtatgccttaccgagaaggtatatttgcatgaattttataagaggtatgaacttagctatcccaatatctaggggaaggcagcccaggtataaggagcaactagagcaaaagtattaggaacatgatatgcaagagcattagaggatcagtgaggcaggagcagaatgaggtttagggagaaatgtagatgagttttgagagatattggcaagaccagatcatacagtacttgggttttcaccgtcagagaaataagacgtcggaggattgcttttctaagtcttatgttttaatacagtcattcaagctatgtgaaaaaatagacttatgggaggggtaagtgaagagtgactaaactatttaggaagctgttattatgattgagagatgatggtgcttcaatgtgacagaagcttggtgacgcaggtcactgatgcttttatgacagaggtcataaaaatggtcagaatttgaaactatttgggtggtaaaaccaacagcatttgctgaaaaactggatgtaaacagtatgagagaaaaagaattcaaggatgactgtaagatttttgacctaaccaacttaagaatggagttactgttaagtgacatggagaagcctgagaaaccttcataattggaacagattgggtaggaatgagataaagagttccatttgagacacattaagttgatgtatctgttagacatccaaatgggatttcaggtaggcatttggatatataagtatggtgtttaagtgagaggtttagcgtaaagttattggcatataaataatttaaaatatgagactgtatgtcaactccaagaaagtaagtataaaataaagaataaaaattatgaaaataacaccctggagcattgtaacagtaagaagttgtggagaagagaaccagccaaaggcggcagaatgaaagcaatcattgaggtaaaaggaaaaccaaaataatgtcatgccatggaaaataaaggaataaagcctatcaaagaaaagggcctaatgagctgtgtcaaatgctactgagatgtcaagtaaaatgaagactgagaattgatcattagttttagctatatggaggtcattggtaaccttgacaatagcagtttttatgtaatggtaggcatcagcatcaaagtccatcaagaatgagttccagagacaataggagaaaaattaatatagacaactcttccaagaaatctttctgccaagataagtggagatatcaacatagtttgaagtcatagatgccataattttctaatggattggagtgagacaggggagaaagaaaggagtccaggacggcccgaagatttgggatacaacatctgtaagaaagcaattgtcattccccgtataagaataccgcagaaatctattcaaatagtaatgtctattaataatatgccactgaacatatgagtctgaaatctagggaagaggttcattaaaaatattagttaacagcatagagagtatctaaaaccatgaggctggataaatcaccatggaataagaaaatggaaaacagtagagccatttgcatcaggaagacaaaacgaaatcagcaatggagactgataaggcgtagtcaggtgggagagaaacagaagttaagttttgaaaagtgtttcaaaggatgatcaactgtgtcaaaggatgatgatagttcaagtgagatgagtaatagagatctggccttaaggtttcagtaacagagaccattcactggtaatcttgacagaagccagtatgatggaaaactggaggtaagagtctgaatagcatgggttcaaaagagaatggaagaaaaataattgcagacagtaagtaatagcacaaacagttctcaaaagagtcagagaaactgagcgaaggctggaaggagaggaaatgttaagagaccttagttttgtttttcagagaaaaacacctgcatgcttgtatgctgatgggaaacatccattagagatgtgggagagagaggaaaaaagggctggttctttttctccgtgatatcttaagaggtccaccccttaataagggtaaaatttctttagtttctattggagtaaaaagttgtaggaatgcccagagaggagattaagtatataggggattttgctaatgacagatcataaattccaactgtcacagtggaagaacttcaagaatgagggagagatatgtgctgggcagaagaggaaattggcagaattctcaggaggttagaataaaagggctgagcatggtccagatgtctggagttacttgagatgacttatataagtaaatgaaacagtgatgttaagtcctggtgctcccaatgcaagtgttggtgatacagtgtaggttctgggctagagaaggctgagcatgatctgggaatgccttcttctcttttgtatgtttgtcaagcatagctcggcatttcaccaagctgtggtctgacagtggcctttccctcacccacctcttagactccaagcgtactgctcagttgccagtgcagcaagagggaacagagttgttttttgtttgtttgtttttttccatgtcttcatgtcactgctttaaaaaaacacatcagccctgcagtgctgtgagatttgtcgggcagctcacactgcctatgctctgagcattcacctttcacagagctacttatttggtaacattcttttggtacctttcagaagagattttcatggaaaatccaaggcgatttcattccaccttgctgtggtaaaaacagaattgagtcctcaaatcaaaatccccaactcccaccccggctctactgccatgcctacaaagaaatccaagaatgatataaatccagaggatctttgcatgctgtaagggagattctccacattctgccttttcactcctgtaacaaatgtttagaaacatttcctagacagcagagatgagtgaacaagaaaagcagtcccaaataaagcatgcatgccatgtaaaaatacttcactaatggtaattgtattgacaaacaatgttatgccctgacaaaaatttaaatgtagtacaaaaatgtaaaggtagtacaaaaatcactctaagaattcaatgtttctactcagatatcacaaactgtgtttttaaattagagagatatattcttaatttgctgcttggaattaccaagtgactaaacatgtttgccagaactgggagagcaaactgctcaagaaatttcctagaaaatgaaagaaaactgtttaaattatagttctaattggccccttatctggggctgagggattgatgaaataattattagtgtacataatggtgaggtttgtgtaaagataaaatgaaagagtcctaattaactccaacaaactttgacatatgtaagtgcttactccctgaagattgattttcattttactaatgacactggaggtgacaccatgaccacgtgtcgtgaggaaatatgcattagccttctgattctgtcagtagcattaatattcttgattgccatttgtagcatttttctagtcctcataatgacatgaaatttccttcctttctatagtcccagaaatcataacaggggacatggagtcagccatggctgtggacctaaatccctgggtggaatatgaatttcgagtggtagccaccaaccctattgggacaggagatccaagcaccccatctcgaatgatccgcacaaatgaagcaggtaaaaatttggaagagtcagattggatttggtatgcttctaatcgtcttgaaagtgagttgaattaaccatgattgctccattgcttgctttagcataatttgtcctgattcatttacctaaacatcataaaattattttctttaaaataattatttcattttatttgttctcagaactttttctccctgtttccacaaatacagtcatctaaatgcttcaattttctcccaatccttgtactcatcttcaggttaccatgaaattaaagcagttcatttattcttctaataatatactcattcaatatagcatacacttaagatttagaataaatcggttcaccttctttttttccagtgatactttacttgaattacagtgtacttccttagaactcttttatgttacccttcaccacaaaacccatataaattacactttgcaaatagtaaacattgcccttccttgacctactgccttcctgaagtctatatgtaaaataaataccaatctgctccttgactttgaaaacattacattattctcagcttttagaaaaagcatatctgataaaaggtttctaatgactgaggaattaacagctctatttgaattttaagatatcttgcctatcacctggaaggtgcagaaaaataaagaaataaggaatacagaaattttctgagtagatttttatgactttggacaaagtctcattgaggtcttttatgtccctctaatgttgtatattaagaaagtatctggttagacatttacttaggggaacacaaacatgaatgttgataagaacaatatgaaaacaatagaaagaggaggatcagggataggtatagggaggaagaaataacaaatgctaatgtttttatgctcaatgataatatatgagtctcaaataaaagtgcactgaaaatgaaggtttgtcatatatgttcactgccctatactgaaacctagaacagtgtttggtactggtactcagcatgtcatatttttaaagggaacaattttttcctttatgtccccctacacacaccagtacataggtcagatacacatatacatacaagactaagaattaactgtgtccattgtgtattatagttatagaactgaaccaaaaatatgacttttgacctctaacaaattaaacaaagcttataatcattaaaataaactctcaaaacagttgactttttctctaaaacatattatggccctctcagaaggaaggaaggaaggaaggagaatggaggaagggagggagggaaaagaaagaaaaaaaaatcccaagatggcccactagactcaagacaaatggaacagctcctactgagggacccagaggactagagtgctcctaacagatcttcacagggaaggcactgagagtggacagagggaaaacacagaggttgggctgattgggggaaaacgttgggacccctacgcggggctacagcacacccggatttatttctggcccccaacagctctgggggaattggtgagttgaactggcaaggagcaacccactcttgccacaggcctctggaaccccagcagaaggagaccccctagaccaccacggactctggacttggcagggagagctgcatacagaagtggtaggagctgcaagccagctgatgtggagcccagagggtttggtgcaagagcatctgtagtgaagcatggtcagggatggccatccccctaggttcgatttgctccataggagactttagccctaggggaactttctgtctgtcctgaactctgtaaggcagttttgcccatcagatggggccagtcccacctaagcaacaccttagtctgctggcctctccccgagcctcagtatggccacacctgcttgcagggcgccctcgggagccttgagaggcctcacaatagcttctcctctggcagaccctgactgaaaggcagagagcttaagcagggcggctcctatggccactcaccagcctgcacagtctttccccacactgcagccgcagcgtccccgacatccctccatgggacaactcccacatgagtttgctgggcgtgtctgcttaggggtaggggtggggatttgggtttgctttccttgccctgacagcgcctggtagtacagtctgctccccttcccctgccaaccaccgttgcagacagagtcttagtgggtacagagccagcaagccctgtcccaacaagtaccccacccttgctttaagaatgcgcagatgacagcggatcctcccccaccttgagtgacccctccagcttgcagagcagagaaggcacccagacctgcacctgtcagtgccctgcccccagccaacaccacctccagtgcaagcaggcacacagttgtcatcaggcacccgctaccaccaccatcgctccaggcccaacctcaactgcattgcctccgccactgtggtgaatgtccccagggagacaggcacccaggaacccgctagcactcaaaaatagaaagattcaatatcattaaaatgaacatactgcccaaagcaatttatagagttcatggtatttctattaaactaccattgacattcttcactgaactactaaaactattttaaaattcatatgaaccaaaaaagagtcaaaatagagaaggcaatgctaagcaaaaagaagaaagctggaggcaacatgttacccaacttcaaactatactacagcgctacagtaaccaaaacagcatggtactggtactaaaacagacatacagatgagcggaacagaatagagagtgcagaaatatgaactaactcctacaaccatctgattttcgacaaatctgacaaaaacaagcactggggaaaggataccctattcaataaatggtgctgagataactggctagccatatgcagaagattgaaactggaccacttcctttcactgtatacaaaaattaactcaagatggattaaagacttaaatgtaagatacaaaactatcaaaatgctagaaaacaacctaggtaatactgttctggtcataggaacaggcaaagatttcatgatgaagatgacaaaagcaattacaacaaaaacaaaaattgacaaatgggttctaattaaacttaagagcttctgcacagtgaaagaaactgtcaacagagtaaacagataacccacagaatatgataaaatttttgcaaactctatatctgataaaggtctaatatccagcatctataaggaacttaaacaaatttacaagaaaaaaacaaacagccccattaaaaagtgagcaaaggacatgtgtagacacttttcaaaagaagacatacacgtggccaacaatcatgtgagaaaaagctcaacatcactgatcctcagagaaatacaaaatgcaataacattaaaaccgcaaatgagataccatctcatgcctgtcacaatggctattactaaaaagtcaaaaaataacagatgctggcaaggttgcagagaaaaaagaacacttatacactgttggtgggagtataaattaggtcaaccattgtggaagaaagtgtgacgacaactcaaagacctaaaaacagaaaaaacattcgacccgatactcccattactgggtatgtgctcaaaggcttaatacctgggtgatgaaataatctgtacaacaaacccccatgtcacaagtttacctatgtaacaaacctgcacatgtacccgtgaacttaaaagtttaattgccaaaaaaatccacatgatcaaattatcacattaaaagtaaataacaatacaaaagatgttcagtttttttccatataaaaattaaacaaccaaaaaaaaaaggtaaaatggcttaaatatgttggaaaaggttcatccacagaaaatccaacttctccacttttgtgatttgcctattataagttgtttttttctgctaccttttcaatagcatgaattttaaattaaacattaattgcctggttagattttcatgcatccataaaaccagccatgctttcattgtgtacaggtgttcattaattaagagcataacaggttagttgttcttcattttatgtactcactgtgcagctactgaaatgactgccaatagtagtacttatgctcacatattttctaaaaagcgctgccttactttgcatattgttaattgtgtttaaacaaaggcaaagattactgactaattcagaggctctctataaatattcatttcaaaaataaataatccatttgggatgaataatccttttcaactttttatggtatgaatctccttgtgctattaaaaagcattttagcaagatcacttttacatttcaagctaaagtgtattcagattgtgcattttaaaagaatttctatttctgcagctacctcaatcatgtattgcctgtctctattttatcatgagttctatatacatgacatactttagtccattaaaatcttatggaagagaagtagcatgaaaaatgcacgaagtactctcctttgaaagtgagttgaggaaggtttgtattgcatcctttatgcttcctgtactgtggtactacatagggttagagctactaatggtgttgagccaagtgttgagttatgtgcctgttttgtcaggcagcacagatttaaagagacaccaatgtctggagacatcctctcaaatgatgcactctgcctctattaagtacatatccagtattttaaaagataatgctgctctaaagagccaactaaactttgaaaatagagctgcttgggagaaaaaaggtctcacattagggatgttgaattgaaagtggtatgcctctttaaggttcacttatttaatagaatattctaaattccaaagcagtgcagtgaactattctgtcatagaattgccccttttctgcatgccaaaaaacagaatttttctttacaatttttctgaagagtatattttgaattttccggtcatcaagaaatactcggtcaggcacggtggctcatgcctataatctcagcactttgggacgctgaagcataggtatcatctgagcccaggaattcaagaccagcctggccaacatggcaaaaaccatctctgctaaacatataaaaatcagccaggcatggtggcacacacctgtaattttagctattcagatgactgaggcatgagaacccgggaggcagaggttgcactgagcagacattgcaccactgcactccagcctgggtgacagagtgagactctctcaaaaaaaaaaaaaaaaaaaaaaaaaggaaagaaacactcttgatagtcagcaaagctaagataaattggttcagtccaatttcttagtattaggatgtcaaaatcataatacaaatatatatttttatgcacacatttcacttttaatttatgtgggtatacagtaggtatatatattttggggttacatgagatattttgatacaggcatacaatgcttagtaatcatatcaggataaatagggtattcatcccctcaagcatctatcctttgtgtttcaaacaatccaataatacacttctggtcagtttaaaatgtacaattaattttttttttttactatagtcaccctgttatgctagcaaatactaggtcttatttattctttctaatttttttttatatccattaaccatcttcccttccccccaacccccactaccaactacacttcccagcctctggtaaccaaccttctactctctatttacatgagttcgattgttttaatttttagctcttaccaatgagtgagaacatgtgatgtttgtctttctgtgcctggcttatttcacttaacatgatgatctccagatccatccatgttgttgcaaatgacaggatttcattcttttgtatggctcaataatactacgttgtgtacaagtaccacattttctttatccattcatctgctgatggacatttaagttgcttccagatattggctatggtgaatattactgcaataaatgtgggagtgcagatatcacttcaataaactaatttcctttctttggatatatacctaggagtgggattgctagatcatatggtagctctatttttagttttctgagaaacctccaaactgttctccgtagtgttgtactaatttatgttcccaccaacagtgtatgagtgtttccttttctctagatcctcactagcatttgttattgcctgtcttttgaatataagccatgtaaactggggtgaaattacatcttattgaagttttgatttgcattcccctgatgatcaattatgctgagcacattttcatatgctcagacttatatgtcttcttttgagaaatgtcttttcaaatcttttgcccattttatgaattgggttttttttattttttttcctacataattgacttctttatatattctgtttatcaatcctttggcagacaggtagtttgcaaatattttctcccattctgtgggttgtctcttcacttgtttactgtttcctttgctgtgtagaagctttttaaattatcctatttgtctatttttgctttagttttctgtgcttgtggtatattgctcaagaagtctttgcctactccgttgtcttgcacagtttccccaatgttttcctgtagtagtttcatattttgaggtcttagatttgaatctttaatacattttgatttgatttttatatggcaaggtataagagtctagtttcacttttctacatgtagctatccagttttcccagaactatttagtgaagagactgtcctttctttgatgtatgttctgagaatttttattggaaataagttcattgcagatgtatggatttatgttggaggtcctctattctgttccattggtcaatgtgtctgtttttatgccagggccatgctgtttttatcactgtagctctcaagtataatttaaagtctggtaatgtgattccaccagttttgttctttttgcttaggatagttttggctattctagctcttttgtgatctgatataaacttaagaattgttttttctatttctgtgaagaatatcattgttattttgatagggattgcattaaatctctagattgctttggatagtatggacattttaacaatattgtttcttacaattcatgaacagggaatatctttctattattttgtgtccttttcaatgtattgcatcagttttacagttttcattatagagatatttcatttatttggttaattcctaagtgttgtattttatttgtagctattgtaaataagataagtttcttgatttctttttcagattgttcacagtttgcatataaaaatgctactgatttttgtatgttgattttgtatcctgaaaatttactaaatttgttcatcagttctaattgttttttgatggggtctttagattttcccaaacataagattatatcatctgcaaacaagaaaaagttgatgtcttcctttccaatttggatgccttttatatatttctcctgtctgattgctctagctaggacttccagtactatgctgaaaaatagtggtgaaactgggcattcttgtcatgttccagatctaggaggaaagactttcagtctttccccatttaatataatactagctgtgagttcatcatatgatttttatgatgttgagttatattccttctatacccagtttgttgagaatttttatcatgaagagatgctaaattttatcaaatgctttttcaacatcaattgaaatggtcataggtgttttgtccttcattctgttggtataatgtatcacattgacttatttgtgtatgttgaatttgccttgcatcccagggataaattccacttggtcatgatgaatgaactttttaatgtgttattgaattcagtttgctggtattttgttgagaaattttgcattgatacttaccagtgataccagtctataggttttttttttcttttttgatacgtctttgtctatttttggtaccaggataatactggcctcatagaatgaatttggaagtgttccctccttctctattttttgaaatagtttgagtaggattggttttagttcttctttaaatgtttggcagaattcagcagtgaagccattgagtctgaggcttctttttttttccctctggatgcccatttattacagcttcaatcacacattatcgatctgcttaagttttgaatttattcatagttcaatcttgataggttgtatgtgtctagaaatttgtccatttcttctagatattccaatttattggcacatagttgctcatagtagcctctaatgatcctttgaatttctgcagtgtgagatgtaatgtctcctttttatgtctgattttgcttatttgtgtactctctttttttcttagtctggctaaagatttgttcattttaactttaaaaaaacctttttgttctattgatcttttgtattgttttcttcatttcatttatttctgctctgatctttattgtatttttcttctactaattttgggtttggtttactcttgcttttctagttccttaggatgcctcattaggttgtttatttgaagtttttctttttcttttttttttttttttaatgatttaggcacttatagctatgaagtttcctcttaggattgcttttgctgtatcccataggtcttggtatgctgtgattccattatcatttgtttcaagaaatttttcaattcccttcttaatttcttcattgacccatgggtcattcaggagcattttttttgtgacctaacatatggcctatccttgagaataacctatgtgctgaggaaaagaatgtgtattcagtcattggataaaatgttttgaaaatattaggtcgatttggtccacattgtaaattaaatccagtgtttctttgttgattttctgtctggaaggtctgtctagtgctgaaagtgaggtgttaaagtctccagctattattgcagtgaggcgtatctctctttccttacctctcataatatttcctgtgtatatctgggtactcaagcattgagtgcacatgtatttcaaattgttatatcctcttgctgaattcacccctttatctttatatggtgaacttctttatgtcttcttatagtttttgtcttaaaatttatttttttctcatatgaatatagctactactgctcttttgtgatttccactggcatgaaatatgtttttctatccctgtgttttcaatctatgagtgtctttataggtgaagtgtgttgcttgtaggaaacaggttattgcgtattatttttttgaccattcagccactctgtcttttgattagagaggttagtccatttacatgcagtgttactattgataagtaaggacttactcctgccattttattatttgttttctggttgttttgtggtctattcttccttctttcctttcttcctgccttcctattagtgaaggtgtttttctctagtgatatggtgtaattttcattttttgtgtatcccttgtaagttttttgctttgaggttaccacgaggtttgcaaatactggcttataaccaattattttaagccggtaataacttatcactgtttgcaaacaaaacaaacaagtaaaaagaaaactagtaaaaaatctacatcttaaatttaatcacctcctttttaactttctgctgtttctatttatatcttattgtactgtctatgtatttgaatgttgttgtagttattattttttattggttcatcatttagtctttctgcttaggataagagtagtttatactccacagttacagtgttataatattctgtgttttcctgtgtacttactattaccaatgagttttttacattcaaatgattatttattcctcattaatgtccttttctttctgattgaagtattctctttagcatttcttgtgggacaggtctggtgttgatgaaatccctcagctttctttgtctgggaagcctttatttctccttatgtttgaaggatattttcaccagatataatactctatggtaaaagttttttttcattagcactttaaatatgtcataccgctctctcctggcctgtaaagtttccactgaaaagtctgctgccagacatattggagctcctttgtatgttatttgtttctttctcttactgtttttaggatcttttctttatccttgagctttggaagtttgattattaactgtcttgaggcattgttctttgggttgaatctgcttggtgttctataaccttcttgtacttaaatgttaatatttttctctaggtttgggaagttctctgatattatccatttgaataaacttcatacccctatctctttctaccttgtctttaaggccaaaactcttagatttgcccttttgaggctattttctaaatcttgtaggtgtgcttcattattcttttttcttttgtctagtctgacgtatattttcaaatagcctatcttaaagtttactaattctttcttctgctagatcaattctactattaaaagactcatgctttctccactgtgtcagttgcatttttcagctccagagtttgtgttggattctctttattatttcaatctctttgttaaatttgtctgatagaattctgaattctttcttggcattctatttttttttttttttttttactttcctcataacagctattttgatttatctgtctgaaaggtcacatatctccgtttctccaggattggtccccggtggcatatttggttcatttgctgaagtcgtgttttcctggatggtcttgatacttgtggatatttatctgtgtctggccattgaagagttaggcatttattgtagtttttgcaggctgggcttgtttgtaacctgcctttcgtgggcaggcttttccaggtatttgaaaggacttgcgtattgttatctagctgtatctgctttaggggacaccccaagcccagtaatgtagttcttggagactagtagaggtactgccttgataatcttgaagaaggtctgaaagaattctctggattaccaggcagagactcttgttctctttccttactttctcccaaacaaatggagtctctctgttctgagccacctggagctggggatgaagtgacataagtaccctggtggccaccaccactggaactgtgctgggtcagacctgaagccagtccagcagtcgatctcacctatggcctgctataaccacttgctggtgactgcctatgtttgctcaaggccctggggctctacaattagcatgtggcaaagtgagccaggccagtgtccttcctttcagggtggtgagttcccctagggcctaggcggatccagaggtgccattcaggagccagggactacagtcaaaatccttagaagtctacttggtgttctattgtactgcagctgagttgacactcaaaccacaaggcacagtccttcccattcttccctctcctttccaaaggcagaggagcctcaccacgtggccactgccaccacaagcccacaggtagtactgccagtctactgccagtgttcccttaaggcccaaggtctcttaagttagcttttggcgaatggtgcctggcctagaactcacccttcagggcaatgggctcccttctgtccctgggcaggtccagaaatgctgtcaaagagtcaactcctgggatcagggaccccaagagccctcttagttctctacacctctgtggctgagctggtacctaaggttcaagacaaagtctcctttacttttcatagcagatgattaatcctgccaagactgggtctttcccttcaaggtagtgggttcctttcttgcccaggatgtgtctagaaatgtcatacaggagctagggtctgaaaagagggcttcacaactatgaccagtgccctattctcctgtggctgagctggtatccaagaagcaagaaaaagttctccccactcttcctccttctctcctaaagtgggaggaaggtatctcttatggatctgcaagctgtgcagcctggacttaggaaaggggtggcatcaacactcccctagcactctaccccagctcacattttagatgccacatattctccaagtccactatctctgagcccagttcaacacaggacttgcctaggagttacagtccttgtggcctagactacctttcaagtttatttagggccccagagcacttgagcctgtggtggtgaggctttcaggaattcaagttctgaccactgatatggaagatttccctctggctagggatggtttaaatattccctccgggccgggcgctgtggctcacacctgtaatcccagcactttgggaggccgaggtgggtgaataacctgaggtcaggagttcgagaccagcctgaccaacatggtgaaacatcgtctctactgaaaatacaaaaattagccgggcgcggtagcgggcacctgtaatcccagctactcgagaggctgaggcacaagaatcacttgaacccaggaggcagagattgcagtgagccaagatcgggccattgcactccatcctgggtgacatagcgagactctgtctcaaaaaaataaaaaatttaaataaataaataaataaattccctctgtgggtgggcatcagctgaatttggtctggttttgctttcttctataaccaagcgacactgaatttaatgtctcacaattgttgcactctccctctcccaagcaaacagattttctcttctgtgttgtggggccactgctggggaatggaggagcggtggtctcagtgattcaagactgtttttcctacctcttcagtgcatctttcagcaatatgaagtttaaaccaaatactgtgagtgctcacctgatttttggttcttacaaaagtgagttttatgtgtagcagtgtccttgccaaggggacaatcagtggagccttctattctgccatcttgctctgccaccatctcctatatttaagctatattttcttacaagttttagttagagattagatagattgataaataaagatagacagccctgtgtttaatttttgaaatctgttaatatcatcaaaccaatatataaatttgggatagcataatgtaaatactttctctattatttaaaaagatgacactcaggacaaaaaaaatcacatttggggaaatgaatctgaaatacacactgtgggtgaaatggaaaaatacataaagtaaatacagcattgtcaattttgtcatttaattgaattttaatattctatacgttacatgttcttaatacggttgaaaaataaatgaaagggagaaaagatatagttaactacgtaacttgtcattcagaaaggtctgatcttctctgtagtataaaatttcaattatcttcaaagctactggtataaatctcaatatttgcagtttatttcaaattttaatgaattatatatacacacatgaataaatatacatatatgcttatgtgtgtatgtatcttttaaagaaaaagaaattgcacctataatgaaaggttggagtttcaacctggattaacgttctactgtgccacttaatagcagggtggacataggcaggaagtatgtcatttaaggcttgaatttctcactcataaaatggggataccacaacctactccttttgaccattctattaaataagattttttaaatgcatgtaaagagcttagcatagtgcctggcacatgataaatgctcaatattattggaagatattttattgtatcacctccatcattaatttaaatgagttattactttattaaatggaaatttacaaactagtaatcatgaaaaagtatattttttcatattgagaaaacattttcagagttaaacacgtttgttgatacagtaagaaccctacggtctcttgacttgcagctctgcagtcaacttcccaagataccctcactgtgagaagtctccactgcagacagccagcgttccatcatgccctatcatccagcccactagaacaacaggagagtcaagagaatgttttagcacatggcacactccacagagcatgcatgccttctaaatcatccttgcaaacccgtggctggccttcccatgatgccttttcatcttatctaattagtactatttctcaatatgtagccattttctttggttcttgtagcacagacaaggcgaaaggagtagaggaaaagaagtgttgaatgaaagactatgctaacacatttttccacacattcaaatgtctttgctttctagttatttttttcctacactgtattccgtcccttcattctcttctgactcaaatggaaaattatacacatatttctggccacaaaaggaaaaatactgaggagccaagatggccgaataggaacagctccggtctacagctcccagcgtgagcgacgcagaagacgggtgatttctgcatttccatctgaggtaccgggttcatctcactagggagtgccagacagtgggcgcaggtcagtgggtgcgcgcaccgtgcgcgagccgaagcagggcgaggcgttgcctcacttgggaagcgcaaggggtcagggagctccctttccgagtcaaagaaaggggtgacagacgcacctggaaaatcgggtcactcccaccctaatactgcgcttttccgataggcttaaaaaacggcccaacacgagattatatcccgcacctggctgggagggtcctacgcccacggagtctcgctgattgctagcacagcagtctgagatcaaactgcaaggtggcagccaggctgggggaggggcgcccgccattgcccaggcttgcttaggtaaacaaagcagcagggaagctccaactgggtggagcccaccacagctcaaggaggccagcctgcctctgtaggctccacctctgggggcagggcacagacaaacaaaaagacagcaggaacctctgcagacttaaatgtccctgtctgacagctttgaagagagcagtggttctcccagcacgcagctggagatctgagaacgggcagactgcctcctcaagtgggtccctgacccctgacccccaagcagcctaactgggaggcaccccccagcaggggcacactgacacctcacacggcagggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacacaacagaaaaactggaaactctaaaaagcagagtgcctctcctcctccaaaggaacgcagttcctcaccagcaacggaacaaagctggatggagaatgactttgatgagctgagagaagaaggcttcagatgatcaaattactctgagctacgggaggacattcaaaccaaaggcaaggaagttgaaaactttgaaaaaaatttagaagaatgtataactagaataaccaatacagagaagtgcttaaaggagctgatggagctgaaaaccaaagctcgagaactacgtgaagaatgcagaagcctcaggagccgatgtgatcaactggaagaaagggtatcagcaatggaagatgaaatgaatgaaatgaagcgagaagggaagtttagagaaaaaagaataaaaagaaatgagcaaagcctccaagaaaatatgggactatgtgaaaagaccaaatctacgtctgattggtgtacctgaaagtgttggggagaatggaaccaagttggaaaacactctgcagaatattatccaggagaacttccccaatctagcaaggcaggccaacattcaaattcaggaaatacagagaatgccataaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaaggaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactaaacatggaaaggaacaaccggtaccagccgctgcaaaatcatgccaaaatgtaaagaccttcgagactaggaagaaactgcatcaactaatgagcaaaataaccagctaacatcataatgacaggatcaaattcacacataacaatattaactttagatgtaaatggactaaatgctccaatttaaagacacagactggcaaattagataaagagtcaagacccatcagtgtgctatattcaggaaacccatctcacgtgcagaaacacacacaggctcaaaataaaaggatggaggaagatctaccaagcaaatggaaaacaaaaaaaggcaggggttgcaatcccagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtgcttagtgacctacaaagagacttagactcccacacattaataatgggagactttaacaacccactgtcaacattagacagatcaacgagacagaaagtcaacaaggatacccaggaattgaactcagctctgtaccaagtggacctaatagacatctacagaactctccaccccaaatcaacagaatatacattttttttcagcaccacaccacacctattcgaaaattgaccacatacttggaagtaaagctctcctcagcaaatgtgaaagaacagaaattataacaaactatctctcagaccacagtgcaatcaaactagaactcaggattaagaacctcacccaaaccgctcaactacatggaaactgaacaacctgctcctgaatgactactgggtacacaaagaaatgaaggcagaaataaagatgttctttgaaaccaacgagaacaaagacacaacataccagaatctctgggacacattcaaagcagtgtgtacagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttccaaaaattaatgaatccaggagctggttttttgaaaggatcaacaaaattgatagaccgctagcaagactaataaagaaaaaaagagagaagaatcaaatagacacaataaaaaatgataaaggagatatcaccaccgatcccacagaaatacaaactaccatcagagaatactacaaacacctctacgcaaataaactagaaaatctagaagaaatggataaattcctcgaaacatacactctccaaagactaagccagggagaggttgaatctctgaacagaccaataacaggatctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgagggcagcatcatcctgataccaaagccgggcagagacacaacgaacaaagagaattttagaccaatatccttgatgaacattgatacaaaaatcctcaataaaatactggcaaaccgaatccagcagcacatcaaaaagcttatccaccatgatcacgtgggcttcacccctgggatgcaaggctggttcaatatacgcaaatcaataaatgtaatccagcatataaacagagccaaagacaaaaaccacatgattatctcaatagcagcagaaaaagcctttgacaaaattcaacaacgcttcatgctaaaaactctcaataaattaggtgttgatgggacgtatctcaaaataataagagctatctatgacaaacccacagccaatatcataccgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtgcaaaaatcacaagcattcttatacaccaacaacagacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacagacaaatggaagaacattccatgctcctgggtaggaagaatctttatcgtgaaaatggccatactgcccaaggtaatttacagattcaatgccatccccatcaagctaccaatgcctttcttcacagaattggaaaaaactactttcaagttcatatggaaccaaaaaagagcctgcattgctaagtcaatcctaagccaaaagaacaaagctagaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgacaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctataacaccaaaagcaatggcaacaaaagccaaaattgacaaatgggatctaattaaactaaagagcttctgcacagcaaaagaaactaccatcagagtgaacaagcaacctacaaaatgggagaaaattttcacaacctactcatctgacaaagggctaatatccagaatctacaatgaactcaaacaaatttacaagaaaaaaacaaacaaccccatcaaacagtgggcaaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggaatgtaaactagttcaaccattgtggaagtcagtgtggcgattcctcagggatctagaactagaaataccatttgacccagccatcccattactgggtatatacccaatggactataaatcatgctgctataaagacacatgcacacgtatgtttattgcagcactattcacaatagcgaagacttggaaccaacccaaatgtccaacaatgatagactggattaagaaaatgtggcacatatacaccatggaatactatgcagccataaaatatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggaagggggagggatagcattgggagatatacctaatgctagatgacgagttagtgggtgcagcgcaccagcatggcacatgtatacatatgtaactaacctgcacaatgtgcacatgtaccctaaaacgtaaagtataataataaataaataaataaataaataaataaataaataaaaaatataaataaataaaaaattaaaaaaaggaaaaatattttttctacatttgaaaactcaaacgccaataaatagctgtagaggttaaaacaaacaaacaaacaacaacaaaaaaaaggttttttcttctcccgccattgctctccactatgctcaatgtgatcccaaacctcagcctcaaataaatcctaagcacttttacgtactagagcagtcgcattttcaggtatttaaaaattccagtttaatttaattaaaaaaatttaatctcacatctaattccatggtctctcattccttcccagcacagacctgacccaacagctatgatctgtcttttctttcttctttccactttattttgtactttccagcggtgctctggtactttccaggtcagacaagaaggagaaaagcttccacttagatggtacaatttgtggttctcacatgggtgttaaatgttcaacatgatggcgtttatccacatactgctgctttctctcatggggtgcattgagttctttgaagacatcttgccccctagcaggcagccttattgggtgtgatcctaacaaccctattcaaacctatcttcatgaccacttggttcacagtaaccatttcacattcctgggctgccaaaatctagaattataggatattctcaggaactattatttattgttcttcatttgaagtttcctcaagtagctcagtatgaaattgaggtattctagaaaactccgaaactcagtacaaggtgtgataggtaagcatctgaacttctctatagtggttgtcttgctcctgtccttatttaccttgatgaagaaataatatccccacttctctattgacagctggggttggagggagatgccatagcaaatccatcttctaaactgacaaccttgttttaagacagcattacttgtgcatgtatgtatatgagttggaggcaggcaatgagaaagagtcataaaattggtttccctaattcgtagcgagactagttttcttcagccactctcaattcagcatctgagattacatgtgactcattccaagttcagaaaacagtcgtttaatgtcctcttacaatttcttaagttgtacattaccttctgacacctacaaaggatcctgctctgttgacatttgtattttcacagttcttgtccatgatggtgacttagaaaattcccttgagttcaaaaattatggaagagacacaatggaatattattataagatgggctggattagttttatctgggggtatgtgaataggctttgtatatatttcttcttgccttttctttctcccctttttagcaacaaatcttatacaaagattattttacctattctttgcatttagttcattgtggatccatataaacaaagggaatatgagttgagataaataccattcattttgtacactcacctcctatcttcttgactattgccacttacaaggaggtttataaatcagaaaattcttacatttcctgaaatatcctagcaatctctttcagaaattcaaataggtattttgcctagatttccagattgaaacaaactatggcaaaactgaaagcataattcctttggtactaccaaaacaatattattggaatatccaagaaggatattctgtttcaagattgcgtgtgtatagactcacgatgaactttcagcacttctcatagaagacttcaccactttctctttttcgaatctaaacagaaaataatattaagtaatatttattgattataattccgggtactgtgatgaataatcatgaaaataaccttaagaaacaggtataattagtatctccatgagacaatggaaatacacgttaaaaaatattttcagccaagcaattagaggggtagaactaggattcaaacccagatctttcttactcccacttctcactcccacaagaaaacctttaccgtttgtacataccactttatctaccctaataagaataaaagcattatgtaaactcttaaggaaataacactggtttttctgggcgggttgggggatggtgggcaaggggaactccttcaatttaactctttctgtaaactaagcctgagttagaatcaattaattgaaattttcctgtgctacatacttcaatttgagtagaaaaaaaaattattttttaaatgttcctcttgacttctacctttgctatataaactccctcccttccctcttttcattcttcagcacctttctttccaaaccaattgccagataaccattaagctccaaaattgtatggcctgtcccaggtctcgaaaagagctgtattttttaatgagtggggtaagcgcttactgtaatataaattggaaatttttcaggtaaaaaaagattggtaaatgatttcattacattttattttagttaaacgctaattaaagcatattattagtgtgactcactttgttcaacctactgagaagtcctttgatattctgccgtggctaaactaaggtagtacactatatttttttcattctgtgtttacaagaatgctttcaatgtttaagaggaaaagagacatgagtttatatttcaacatgccaggtaagacttaaaacagctaggcatttgtagcttgtggataaagtatcaattacattatccactaatggatgagctttgctcagaaagaaattcagaagaatcagacttaaacctgctaaccatatgtataaacttgattctctaagctaatatgctcaagacatttatcagtagttgactgaggaagaagagtctagctgcttaatcctggattcaaattttattaattatatttaaaatatattttgttttaaagtaaatatgtatttctctggactcagcaaaagcatttattagatatttgattatattaattttgtgcttctagcaagaattatagaacttttacaccataagcgctccgaaagattaagtcaaatcccttcagatcaggaatatgttgttttataaagggatataattaaaaccagtggactccatcagtgcagagataataactgtgtgccaccaacttgaaaagaaaatgaatgtacatgggtttcgctgattagctgcatgtaattaggaaatttaagccaattggaattagagtacccaattcaaacactgtgcccatgacaacaaaacactgcgtgagctgcagctattacagcctaaagttttccattagtgaatccgattatatctagtaaactttttttaaaatttgagtagctgttacttatacacatatgctattaaaacatggtgagccataatgcctctcttgtcagttattgttcattaaaattggaggtaaggtaagagaaggatgatcttatttctttacattaagttgaagatgggctatcttgtcttgaaaataaattagcagcagtaagaaaacctcacggagctgatttcaagtagtaaaacaaatgtttttaaaacttagatcattagttgaaatttgaaatcacatactttcaaaaaatgaattaaatagaagtgaatcaaatcatagaagaaagccctcttttgctttcttagtttctcaaaatggaaattttccccaaaatgttcacttgtttttttttaattttttactcacaaagttaaaacttttaaaaatctaaattggtaaattgtttttttaaaaataaaagtatcaatggatgtgaaacaatactaccaaagcttcaacagttttgatttcaaatagttactttgttttattctattaatatcttttaaataggcttctagatgttgactagagagcctagagcctactctaaaactgtaatctagagtttctgagcatcctttttttttagatgatgttttagggttgaacaaagtagaaaaggatcttcaatgcctagtctttccacagaaacttatgatcataggaatgatgtcctcaaagaagaggattcaaagccctaaatttagagtacagatttagtccaatttaatagacaaagtactgggtctggtatacattacccataatgttatttaaatgtgagttttcagagataaatgtgaggagtgtatgtgtgtatgtatgtgtgtgtatatacatttaaaaaaacaaaaatactaagagaagcagtaatggcatgatatcactaaattattaatatattttatccactatttatttgactatgctttgatggtcacaatattcagaagtctgagattagcaaaaaaggcaatgtttgaaaatttggatccctgtccttttacatatacagttaaactagctccattcttgtgtgtcttacccgtaacattgagcagaaaataaatttagactaatactacataacagtggtttttcagacatggttataaggcatactgatatctcacagtctgttacatgtggcaacaactatgactactaatacgtaactcaataaatgatttgtttgctgttcatataaattaggtcatatttacagttattgctctaattgcatcatttttctcagttgaattccatgtgatttcttgaatgagagaaaaaaagggtatccaattccatgcaattctgagggaatccgtgagatgaactccacatatgaataatcctcagtatgtatgtaacagtgaaagaataaagattggtaactgctgctgcataatcctatattggtagcagctgcatgtgcctgagcaagagaattgtgttcatggagaaaagggccaaacgatactgaaacgtagaccctgacaaaggaaggttatttatttcaatggagccaattatatattcacaggttttgctcaccctcttttctggcccaaggagaatttgttttcttcctttccaggagtatataaattccacttcagtttttctggtgtataaaaggctgtgtgaatacctaccagtaattaatagcctttcattccaagtaagtaatatataggagtgaatttattgtttatgagtatatcaatatcgtttaaaaatgatatgccggaatagaaaggcaacactgaagtgtaaaattgttaatgcaggctcatagcctgtaaaatgatttcttttaatagttttcttcatttaaaagttcttcatttgaaaatgttccctttcaactgcagatttcatggtttggtgcaatgaaggggaaatttattcctttgacacatttattcttttaatagttattcatttgaaaaagtttcactggttgcctataaattttgcagtttgcagagagattcattcttgacagattttttaaaatgtttattcatttaagtagtttctcactccatggaattgttgctaaggtttaacaacaacaaaagaaatgtactgaagcttcctgggggttctggtaaggcagtaatgctaatcttgacctgtggatttttcagtggctctgcaagccccgggataacaaaaaagagtcacgtcattagcaaagaggataacagtgagcaattttaaggacaaaatttacctaatcattattagatgttcttagctatagtgttaattattatttagaaatcactaccacagagcattttcaagaggcatggtgcaataagtggtcatgaaaaaaaaagtgtatcaaaatctgccacatagatttgaaagcagggtgtttctgtcaccaatattttgttttaatctttaatatgaccattctgacttcaaacaaacttctgacttatctcaggattttatccaacgtaggttgggagtttttttctcctcactctccacccatttttatccacagttccgaagacagcacccaccaatgtaagcggaagaagtggaagaaggcatgagttagtcattgcctgggaggtaagaaaaacacatcctctcacaaattactccacgtgtttgtttggcttagtgtgatatttaattattttatgattaagcagtccacttgattcatttagaggctaaaaacagtgggaggaaggaatgaaccactgctgaataaatgccacgttaccctggttatctcatttaacccatacaacaatcttatcagttggaatgattttcttcattttacaaatcatgaaactgaggcactgttacatattttcctaataaacagaattgtgactttgattacaaaatttgtgtcattttatctatctcatcatatgcctccaaagtatcatttgtcaaggaaaaagagtggagatgaagggggagggggtgtgaagaatacatttattttccatgaagccaccttccttttttgatgttaaataaccttattattaaatgtaaatagctcacagagatcttagaatatatagaaatggaaatgcctgttagagtaaatagagcaactccttgacaatctctaagaacaatgagaaagtatacagagatctctttttccagtaagaattattccatgagcacataatctgtcctattttttttgtccattcccccttttcttcgataaaacttcatatatttttttgatgtctacagaggtattaactttccaatagctgaccttcactgagaccagatctctctaaatggaattgcctttccatgtaagctttaatataacgggctttgtttctttgccaccactcaatacatggcttttcttcatatcaaaattcaaggaaaaaaactacttagcaaatatttattgagtatctagtgtgtgtgaagcactgtgctagacagtggctggtaacttttccacattgactggtcaatcacaattactcctttctatggtgtgcagttgaagcccatgtaaccaatttaaatctaagccatatagcacaagaagcttcttgaataccatagtccaactttttcatgtcagtaaccataaaagcaattgcaaagcacactacaaaaaaggttttaacatcattatatcttacttttgtggtctaaagggttctgcagagcattaccagtgacaagatattcccgaccaccagaccataggacaattttccccaacatgttaatccaaagatcttcatttcatatacatgactaattggagcaaatttgtttcacttcaaaagttttcaattctcttgagagtttttgtacatttcaactgatacaatttttcttcttttacctttaaagctttttaactttcaaagaagtgccaaagtgattgtactattttggcttccaatgtagtataaagatttgagattctccctttctctagctatctataattttttttaattaagaatttggagaaagtggatttttaatcaatcattttgctgataattaattatatttttcttctttagccagtatctgaagagtttcagaatggggaaggcttcggctatattgtggctttcagacccaatggaacacgtggctggaaggaaaaaatggtgacatcctctgaagcttccaaattcatttatcgagatgaaagtgtccctcctcttactccctttgaagtgaaagttggcgtttataacaataaaggagatgggccttttagtcaaattgtggtcatctgttcagctgaaggaggtcagtttttttattcctattatttttatttaacattttactttgttatacaaataatcagacacctttgtacacatattagaaaatacaaataaggcaaaataaactcattcataatctcactaaactttttggatatatatttcccaaactttttttaattttttaaattaaaagttgattattccacatatgttgctttaagtttttcacatcctaacaatatatggcaaacatatatccatgaaaacaacaatatcagtaatccctgcagtgtattcctttctctgggtggacattaagccaatcctctttggtttgaaatttagatacttttatatttttcaatatatatgtaaagtagatttaaataaatgcttcatttatgtgacaaataaatatttatttctaaccctatgcataaagcactgtactaataaggaagtttcagacagggctttttcttggaaccttttcaaacacatcattaaatcctatggaaatcttatgaaatagacattattgcctccgttatgtagaaagagaaattgactttcggaaaagttaaagaacgtgctaaaggttacactgcttgtaactgagaattaaatccaggtttgtctaaccactaactccttgatttttgtataacttgctgccttcatatgcatgaccatgtttaattcacaagatagaactcataggtaggcagtaccgagtagacaatatacctattttacagatgagtaaactgtaaagtggttatactcaatacatgatagagctacagtggaaaccctgcttcctacatcaaagatactgaattatttcaagttttaatataaaaatgcaattttctgggtgaaagtataataatagatctagccccctaaagttagcttttcctcttagtccttcttttattcaaattcaggatttcagttaaccttacaagtgggggaaaaaaatgagaaaaggaaaagacagccttatgtttcttaaatttacaaatgactgagaaaatgttctaccaaaggcagcattcactttccccataccaataagtgtggtaaatataaactaacccttatacttcctctgtgcccacatgtaggacttgaacagctcaagagtattattcataattaattattatatccccccatgaagctatgagcttcacgggggatataaatatagtcatgtgaatatttaaaaacaaagataatgtttgatttaaggaagatgtagtttttcaatagtaagctgcctcatatttttataatatagagccaaattttaaagcagaatcagaaagtttatcttagcataagaataaccagggaagtgaaaaatcaagtaatggcaaggaactagaggtattctgatgagataccaattgcacttagcatctcagatttctgatgtgttttcagataaagtccatataccatgttacttatgttatctaatgtaaaggttaaaaccaaatatgaaattggaatctcaaaccttaatctacatttcaggaaactgagtctcagagaggttaagtaacatgctcaaattcacaccagtaagtgacagttacaagaaatgatagtaagtgacagagctaggattttaaccaggtctatatgactggaaagcacattttttaactactacactatactgcctcatcaggaatgtacacaatagtgatattttctattatttattgctcaaaagatctattttgaagtatatgtgttattcagaaagtacatattctttttccttttaaaatgttggaaactaattatcaattacatagcaccaaaggtcgcatgagagattaattggagaagtttttgaacacgctttgtatagtaacaacagtgctgcctttaagaaattcagctttgtaatttctttgtcaatctttgctttgaaattaatttatagcagccaccatgggtttttttacattgtgttttcttaaacttgaaatggcttgcctttggaaatttctctttcaagctagatagaaaatatgcatattttcttttaaagacactgaggttattcctgtaacatatttcatagtaatgtaacacttcatttattttaatcaactgaaatatgaaatatattaggcaaattaaatctggatagagtcctttgttctgacactgaaattcaagcatatatttggcattcgcttactaattaagtttacaaatgtggaactttatatgtaaatatgagtaaagtgttagcatcattagagtgtgtcaaccaagaaaggcaggacaagggaaaagaaaagcattaacctgagctcaaatctgatcacactaactagaccatcttgggcagtttattcacctctctgaggcttagcttcctccactttaaaaatgaaggtctcaaaatagaacatctctggaatcctatacaaatctaaaattaaaaccctgtcaatttattctatattctaaaacattattttagctggagcagtggcttatgcctataatcccaacacattgggaggttgaggcaggaggattgcttgagcccaggaatttgaggctgcagtgggctatggcaatgatggcttcactacattgcaaactgagtgaaagagtgagaccttgtctcaaaaaataataataataataagtggattaaaataaaacattctttgtaacaattgtcctaacatagatagcaataatagatcaacttttgctatacaataaaaagggaaaatcaacattcttttttagtcacttcgcaatttgctttacttaaaaaggagtgagcatttcaaaaattaaaccattttaaaaaagagtaaaggcctgaaataaacttgtaaaataatatattatactcttgccagtgcaggtttctcccctcagtgtctatggatgttcatacagcttcacagtgtgtcttttatcattatactcttgcccaaagcccaactaatctgagcgaaattgtatttctccaaaagacaaatcctgcttccttattcttccattaacccaatccacttgtttatcaccttgaaattcctccacattcttagatacagtaaagaacaagaggagtgagactgccttactatttctgtttatgggcttagttcctcctcttcctttcaagcttaccagatacatgccttaagcactgtgaaaaagccaccttttcacagccgacaccaagctgggaagaaaaatgtcaaatgcagctaccagaatttatgttattgggagggaagcagagaacagaaaaacttacaaggcacaccttacagtactacttctcaacctatttcccaatggaacatggataatagatgacattcatacccagaacatgcttttataagtgtgtatgtgcattctccactctatccctttcttttcctcccaataaagcgtatcagaatgcaaataaaattaattattttagagaaaaccttgaattgacatgtttttcaaagaaaaaatcatttgcaaatgttgatgcttgatcaataaatcacttgggatatgaccttaactctcacaactctgaggtttactattgccctagagtactgtcagaaaaagtttcaaatggtttttctgctaacacccgtaagcctttgaaacctttcaatgttgccacaagagaagcaaaccttaatgactctgtcagtgccaagcagcatctgacataagccctggaaaaagagatatttgcctgccaagatatccatgtaccctgtacatgtgtcaaatatctttgtcctttaaaccgagcaaggtttatgtgcattcctaatcctgacttcagacctctagggtatgatataattctatacaacacgctaattttggaaacaattccatttttaaaaaaaaagaatagtgaagtttcaaaataagttctcaaaatgcatggtaaaactgataaaaattaatttttttccaagataaaaaattaaattggctttttcttccacatttcaagaaataatgaatactcaaacataccattttccacttagttcttctcaccataacttcggaaatgaaaagaactggagcattcaattaaacctaatagaaaaacagaagaaaaattgatacagttaattataggttgaaagatttatttacttgtgatgcgctttatcctttatcctttatcctttctagttttcttggcttttgccttatctgtaaaaaaatgtcctgctcatatatttattaaacctaaaaagcctgtcctcatttgcagaatataatagacaattatctcattgcaagtggagctaccacagctcaaattaaaacctaatattcctaaggtgttattctccagatccatccttagctgaaactgagctcactgggatttatgtgaacttgaaaattaataaattgacatgttagttgtaaaatacaagaaataatttcctgtcttttccagatgatctatttggattagtgcctataaaagttcaactacagctgtcttcactgaatttttaaataatgaaaccataccctttctctcaaggagtttattaaagtctcttttgattaatgctgttgctctaagggtctcttgggaagggatctcttggaaagtcagatgtataatcaatattacaagcacatacccccatattacatgaagaactccagctgctaggtcacttaatacaaatgtatcatcgaaattcatgaacacggtaatgctgttcaacatttttaatctatcagaaacaaacgtatcaatcaacctgtccactacatatcccaagattacagtgaaggagttagccatggcctaattaatatcatcacaagtaacagaaaaaaaaagaggtttccctctaagtctttgattccactagatataatgctagtacagtctcagaaataagtttctaaacttttattaaattaccccagtgtaatagatgggagtgagagtggcagaaaacatactgtgatttagagatcagaagagttttagagatgcctgaatgtgacatgactgagaaggagctgtgcagctatggttcaaaattaccaaggagtcagtgaaacaggaatcaaaggagttaatagtgagcctgtggcagggttaagtgggtgatgacgggggtctagatggtttctggcaagatctagaaatagcccaaatggggagcccaacacaaacattcttgagagaagttagatgtggagtggcaaggggaaagagagaaatagaaaaggaaaaagcatcaggtaagtgtaacatagacataggcacagaagcagaacagtgtagtgctcagggcctgactacctgtattcaaatcctccctccacatttaagcagctgtgggatcttgagtaagtagcttaacctctcttctgcttgatttcttcatctgaaaaatgctagtagtagtaatatggttgttgggaagactaagacatggaaagaattaagaacagggtttggaacacagcagagcctcaataaatggcaattattagtatttcgagttatccccacatctattttgcctcttttttgtttacttctaatcttattctatccattcctctgtcagttatttggaagcaaccaggcaacaaaagagggaactatctatgttttctgtaaaacttattctgtgacttaaaatggaccctaggagatgaagaatgagccagcctctttctttatgccaatttaaaaacagaggaaagagcatttgagacccaagttctagctttttcacagctgaaagtagagtctggataaattaacctctgtacgttttacttttctaatctgcaaaatgagagcatggatttaaaacaggtccattactccaaagcacataggagtgaggtaagaaataaaaacaataaagtactccttgtgtgagacaattgtgagtgggaggaactctggcatatgtagaagcacatgcccagactgagggagtccaccactaaccctcatcggccaacactcaagaattcaggcttcatactgtctccttttatcccccaaaagaagccagaaattcttattttcaaatgttggcttaaattaatctaacacatgatgtagacaaacaaaatatgactaaagacccactgcccctgcatttgtgactttggagccaagtgacttctagagtcctttccatttgcaactttccatcattcagttacaatgggatgcccaaagcgaatggccagtttcaatgcaagccagatgttctgtgatccagttagctacttgtgtctgcagaccaatttttgacccagttgaaaatgttcacttgggtataaatagtacatactaaaatttctgggaaaatctgacagaggtcactatttttacatgctgaaatgtctaattcaggtcaacatagatcaacttctgataccattcagggatgttcaatctttggcttccctgggccacactggaagaagaagaattgttttggaccacacataaaatacactaatactaacgatagctgattagctaaaaaaaaaaaaaaaaattacaaaaaaaatctcgtaacgctttaagaagttcacaaattttggggggggcacattcaaagctgtcctgggccaaggctggacacacttgattagattaagagggtgaaaaaaaattaaaatgattcttcagttcttgtttgattgattcactgtcattcagttatatgaaattataacatgcagctccccaaaatgcaaatgtgaaatgtaggtgtggtatgaccctgatttaaaatccttagagcttttaaataaaagttaaggtgcttgtttgagaggcaggttcctgaacatttttatttactttaacatttttttaaactttctatttgagaaatacttaaacttgtacagtactactgaaagttgatagagaaataattcctttctttggagataaagagatatggaaaggttgctaccccaccacatgttttgtgcttctgaaattatttatccccctgcaatcttctttgacaaagatgtaattgcttcagcaatataaaagctgaaagaaggcatttggcacacaaatctctgtaatgcatttattctgaagagaagtaaaactgctacggaatagcaaacgatattcaaagtgtggtttcctttcaaataaactgtatcctaaatcccagagatcaagttgtacacacctcagaaacatcaacattctttcatttacttgcaaaatcaagaattttaactcccactaaatagcatggggaaaatgtccattgcaagtctggtaatcagaattctagaataagatagaagatttttccagaatgcatgttttaaattggacagatgcacaaataatagggagttggaaagtgagatgagggaaaccacggagcaaaagaaaataataaaaaatattcaaaaggtgacagaatgagaaatttcaacttataccatggcaggaattaatgtcagcttctgtgtaaaaattaatgtgaatttgccaaagcactttgagatgacacaattatagcaagtgtttttaacaaaggtttggccaaaagaaaatcattgcttggtgcaaaggtggaccaaccaagtcttttgcaggctccttttgcagtaacagggtagatatttttgactgatatatttcaattaataatatataaaagcgttccagacacatgtatgactagcttctttcagaaaaggaaagacctcagaaaatgattatgtcttcaatgttcgcctcttaacatttttatttagaactcaatctttgctatatggttccataaattgaaaaaaaaaattcatagatgaagctcaactctaatcagtgataaagggttagtaccaaaatctgtaccatttttatggggtagaattttaatagactttgtacagaactgtttgaactaatgtatggcctttattctgccatttcatttaacttgtgtttgtgacacagtatttatgattcagccatgtcaacactagaaatattttgttcctcacatcaagtgcagcctcgaataaagtacaccttttgatggatgccagtcagaaattgtgtatttcaaaaaaaaaaaatagtgtgaaaggtcactgaatgtagaaacaaatgaaaaggtggttttgagccacggcactgaacccttcggggacttttctttcccacctgcacctgtcttaaaagtcaatgcatgccttttaaatatcatgattcataacatattccttatataatcatgaaaatgtagtcttgtggttggaacaacaaaaagtatctaatgaaatttagatacacagaataaaaatttagatgcacagaataaaaaataaaataataataatatggtattttgtgaatgaacatttttaacgccaagcacagtactaaatattttatatatacattctaattaaagccaacctttaaatctatgagataaatactctcattatagtcatgttatagatgagggaactagggcttagaaagagataaaacaacttacccaaaggtaaataaatagctaaataaatgttttaaggccaaaagcaacagcagtgcaacaacaaaaaaaagcaaacactgactccatagtccatttttataggaattatgctagactggcagaaaatttaagttccccagaaatgtcttagctaatccaaggattaatgtctttgcctgtcttgctagatttgtcatttgtcattggtaaggtattgatgagatttgacccaagtatagaaatccaaaaggatcacctttatattttgttgtgttttttataactaccacagcacttcatttcaaaaataaggtaagaggaatttaacacctgacagactcaggcgcaatactttgatggacataaactttttataattgtggtttattttccttcatacagaacccagtgctgctcccacagatgtcaaggcgacaagtgtgtctgtgtcagagattcttgttgcatggaaacacattaaagagagtctaggaagaccacagggatttgaggtatgaacagaatgattgaaaataagccttattgtttcttctgacatcacattctcctaaagagaggttttggtgacacctcagaatttcaacagaatttcttagaaattttgctctatgttaaagaaactaagaaatactattttactgggatgtgttatgttgctcattaactggtttatttttcagtacagtagcttccgtagcactatgcaaagatgtttttaaaagatgaaatagagttttagacaaaagcaggagctacaggtagatatttaattgtatccaatttactggtcattttaaaagtttttgtgtcttcctttctaataatttaatgtataaatacaagttttccttttgtactttattggtatctcttaccctcagtgctgaattatcaaattttgcttggaatttaatgatctgtattgtatctatgtattcagatagtttttttggtcccttaaatgttgctatttttaaacatagttattccagccttataatggtgaacatttcatatcaaatgaataacatcaatgaaattttagcctccgcagagaatagcagattgtgagtagtctgtgaacatgaatattttatgataacaaggtttggcttctcacacagctcttgttcttgttcttgccttgcttggccagtcatggagaggaattagggggataatgtctaaaagaaaaaaagaattagcatctgacccaagactttagttgcatttaaaaaaatttattcttacttttcctctgcttcagttcccattaagagaaaatcatcttgtgtcttgaacaatgatcaagtataggacttgtatactaacatggtttccaggctgaaacatatttttaattctatttgagttttcaaataatgcccaacaattatttgattaacatacagctggcattaaataatgatttctatgataaaaaaatttatacaatctttctaagagttacagcaagaacaatttatgggaaaccattacctacttatacaatatcatggacttatttctacaatcttgcttcaattaattatttggaatgataatttagtatctcattatgattgcatgtttaatgtgatgaatatttctgtttctcccaatccatgcttcagggaccatgtttgttcatcattaaatctcagcaaatgataatatatatatttggcccataactgaccacaataaatatgttgaatgaataaatgtttgtgtggcacaattagcccctttctatccaaccgtagaagacactgtggtggtttgtccagtttcccttctctatggaggagggacacgtgcctcctccaactgctgtgagtgttgactgctaatggttctcagctcccactatagataattgccctccactgaggagagctacattgcttggaaagtgacctcgccacacttagtcagcctaagatcaatgactgactgatacttgtctcttacctcaaggaggaaagaactttatggtgtagtttatgatacagagccttgctgcgtgcatcaggccaaagccagatttcctggaaccacattcttgctcagctccccattctgagttcctccctttttaaacctgtaagcatcctcacagtaaataatatgcaccaaaatccctatctcaagctctgcttttggggacttcaactgaaaagaactacattagtgtgaattcactctaaacctctgaatcggaacatctggggcagacgtctggtgtgcatacctttcagaaagccacaaagtatattctggtgcacggaagagtgacaacccaggctcctatatctcaaagggatgttccccttatatagccagtcaccctcaagctttttttatacctgccctaatagcatgacactcagataaccattatgattcaccgtgttgacatctctctgtgaggtcctgcaaagatcacatgtgcacaattcttctcttcctaaatataaatcattcattctttaattcaataaatatttatgtagacctattaagtaccagacaatgagctaaatgccaggaacaaaccaatgagcaaaacaaagtccctgctcttctgaagcttgtattgtagtagggaaggcacacaatcaacaagctaagaaataagcgcatgattttttaaaaaaaatatgagatacaatttcagttgatgatacagactatgtagaaaaaatagggcaagaaggtaaagagagagagtctgatattttatagaggtttgagaaatcaacctttctgtggttgcgacatgtgagtagagacatgatgtaatgagagacggcagagagaacggcaagcccaggagctctgaagtactagcgtgctggacttcttcaaagaataggaagtgaatgattttggtgagagtagggagcacagggagagtgggagcaggatgatgatgaagagattagcaggacaaggaacaggtttctggggccttaggaaccatagaaagaagttcagatttcatccaaagtataagaagtcataaagtatttcaaactgggagggacaagtcaagatctgacatatttaaagcctctctcaatctggaaggtagataatagaccctggggagggcctcagacagaagagcagaggggcagctgttccaacctcagtgacaatgaggttgctttcaactagagtggtagcagtggagttgataagaagtggaccttttaaaatatattttgaattgaggtgagacagaatttgacaataaattacatgtaggctatgaaaaagatgagacaaagataattgcagagatatttgacccaagaaactaggtaaatggcattgtcattcacagagatgaggaactcacaaagaagagtgggttttagagtgaaaatcaaggattctgtttcgggtgttttaaattttaggaactttttttatttctaaaaagagttctcaagcaggtcttaagttaagaggaagactggggatggaactataactatgggaaatcataaggttataaatagtttgtatgcatataccagctaagatcactgaatatttggtaaagaaggtgcctgagaattgagctctggggtggcccacaatttggaactcaataaaggagaggagagggtctggctgaagaaactaaggaggagacactgaagaaattcagaagccaagagaagaatttcaaaatggagagaatgttccatgctgtcaaatgctgctggggaattcagaaagatgagacctgagattgccagatggattcagcaatgtggagaccataagtaaccttgatgagagagattttatggaatgctgataatgaaggcttaactggaggttaagatcaagattactcaagagtgacagtcaagaccatcagagcacaatgttttcactagatcagcttcattcaaaataacttattgcaagcaaaaatggaatatatttgaaaacagaaagttaacaaggatgaatcaaattctgaaataatcatcacaatgacatttttgaattaaaataaatcaacgaaaattctgacaatgactttatacaaacaaaccgggacagaattcatggacatagtaactattctatttcatagcgcattataaattgtagtttcaaaatatggcatcttgttaccagaaaataaaaatcaacatctcattaattgtgaaattctttactttttataaacagaacataatgaaaactttggctaaacatgacattaactgttattttaagtatattcagtgaagactatttttgatttatactgtttcataactgaatagctgcatgtagatttaacactaaatatgatataggtgaagctatcaggatctctcttttcctctcttttctgtattctttttccctcgaaagagagttctgcctctgtccttcaccaaacacatctggaacttactgctctcctcttctccccacttatttttctctatcaaaaatgtcacttagtaaaagatttccctaattattactaaaatataatgaacccataaagcttaacaattttgtttacttttatccctctttttcactctatccctaccacaattctacctatatttactgatggtcgaattcagagcatggtgacaataaaacaaatattgaaacaagggcatttgtcatcaaaaccaaaatgatcaatttcacattttatgtacttataatatcagtcctatgagtcacttttctagccataattttaacttcacatgcaaaatctaaaacagcaagctactacaaaagcattaactatgaaccactttgaaactagagaagacagtgttttcagctgcccctcttatttttcctgaatcagaacatcaataagatagataaggttctgatcttatgaatgttacatcctaatgggggaaaacattttttttaaaaatcaaggaaacacataagtaataagataaactctgataacaatacacatagagggtcaaaggtatagcaaacctggttcctgtgagaacagaaagaaagtgaagcactgggaaattaaaatagtttgagggttgggtagagacaagatatgtatagatatatgggttatgaaaaaaagtttgtcttttatttgaagtgcagtagaaagccattgagacaatttaaggagggaagtcacaatgtccgatttatgtttttcttttttttaatcactctggctgctcttatatgaagaatgaaagggagaggaaagaaaggtcagagaattgaagttaagagttatcacaataatccaagcaagaaatgatggtgacctagacttcagccaaagcagtggagtgggagagaagcagatgtattttagaggcagggctggcaggatttgctgattgatctgatgtggaggaaagagaaatgatgattcctgcatatctggcttggacacataggtaaattgtgccatttacaaaaaaaaaaaaaaatgaaggaaactgaacaaagaacagatttgaagctaggaaatcaagagttctatttaatcacattgaatttttgatgcctattagaggcatctaagagggtaagtcagataggcagtagaacatgccagtttggagtcaaattgagagaacagggctgaaaacatagagatggccattatagaagtggtatttaaatccatgctaccataggaaagcatctgaggacaaaatttcaagagaagaggagagaacaagagcagaggggaatgaggagggtcctgctgtgtcctggcacactcagcatttagaagttgagctgaagaggaagaatcagcaaggaggctggcaagaataaatcagttttgtagcaggaataccacgtatgaataaaaaaagttaaaggagttgaccaaaaagagggaactggtcaactatgcttaatgctgccaagagatcaagtgagataaagagggaaaagtgcctgtttggtttacaggttattggtgataacttccacaatcaaataaataatcaatatcccttatgttgtcaattagtaacttcaagttgtagacatttagtaaccttaataatgccactgcttctaaagaatggttggtggaaatagtttgagggcaagggaacgtcatttcagagctctcagcccatcagcaccttacttgatgtggaatttcctgtattttgtcaggacaccaacaggttttggtattcattcttgtgttgagaatcacagctctccagtgttggtatcagaaatggttaagagcaaaattcaacatctgaatatatttttgcaccacatattataatgtgagtataattagccactgcagaaaactcttttagcctcaaaaagagtgaaaagaagtcaaattgagactttaacatggtgtttcccttgatgtaccaggtattatagagcaggtaaattagaaacaagatatcatttctgaagtcatgtacacagatttatttccttctagaatatgttttctgtcaagtccatacccatgttccactttgaaattgatgactgtatccctggaatacatagcgtggtgttaactagtaacacctcaatgcattttccttaataaataatcaaactggaacctatttgtgattcacttgtctctgaaatctttgtattttcttctctactaattgagggaagctacacttgagcaagagtcatttggagagaagacggcatcattaagggcagtaaaggccttaaatctctaacagccttacctgatctccctcctgcaagttgctatcattaggctctcccttcccacttctgactgcaggttctcctgatttggctgcagcctgactctgattctgaccctaagttggcagtcaaatttcatctcacatttccctgacctggctttctgtatgtttcatttgaatctcatttattatttatttaactagtatttattaaatacctgctatgttttgatgcaatattcaggctgaaacaataaatacaactgagttcctgaccttatgaagtttgcagtctagcaagggagactatttctgctttcttgaatttttgtattttgcttcaatcctcaactagggtcttgatcctaacttctggtagctccttttgctgataacttggttttgataatcttttccctgatgcagtcctgcagaacagcagtaaggatctcagtcagaggcttcccctggtagcatttgtcagtaatctacttacacttggcattttggcctttcgcaaggaagcttccattacatcttaattggtttaagaaataataaaccaagcattttgacttaaacttttcatttttaactaacccaacactttcaagtacatgaaacaattcaaatcaaatagtgattgatttttgttattaaattgatgaattgctttatctaatagaatggtcatggcaattaagatgctaagaatagttttgcaaaagacaaggtcagaatgatgacagccagacaaagtgatcaatggtaaggggcttgaggacaatttagcaattttatccctttctgtttctgagtggatccatctttagacattttaaaaggtaacaattaggctacatgagaactctactgtacaaagaaaaatggtggtcttttcctttcaaccagctgcctcctgaaagaatggcagtacctcacaaaaatgaccatctgaagaaataagaaaaaaaaatatgaaattccaaatgtagacattaatccatctatttgtatctttcaaatatttgagaaattttgtcaacatccgcttagaaccacccatttgtaaattttggttacctacatggcattagcttgaaattttatggtagcagggactaaatgtagaaagcactgacactgagatatgtgaaatgtctagcttatgatatgcagcatgattgaaaattgaaagtgggctgtatttactgaacaactttgattcatgaataaccatgactgtcccatctggattgccatctctgtcactagcccatacaagtaaattattaggttcagttttgaatttatgaacccaccagcattaagtgtcctgtgtatggtaatctctgaatcctagagcagagtccctcaagcttttcagaacataaaaggatttttatgtgcatacaaattcagagaagatgccagtctggcaagaagggagggtaaaggataaggccaaatttcataatcatttctgtgattttcccagatcagcaaaacagacaaagtaaattgtgataatggaatgttggatgattcatttttttcactccttcactcatcaagcatttattcagtatcgggcactatgctgggcaatgggaatgtacatataaataagatctagtccttaccctcaaaaagctcacagtctaatattgagggaggtttatgggaagttgaagtaaacaaaaaagaaatacgttggaacaatataattctcgtgtctataattaccccaggatttcttagcatcctgatcctctgaagaaacagtgtgaataaatctgtgccaatgccttacatgggtgtaagcttctctgttttcatgagaatatgcttctgtcctgaaattttcctttattttctaaataagtcaacaataaaatagttatattaactgaataaaataaaaatgaaacttttttcactagaggtaatttttaaaacattcatatttcatattctgcctgtggaacaaagtcttccatgattgccaagtttatggtgcttgtattcattcatcccttcttgtaagataattattaactgtatttttatctttttaatagctggactcattttaacaataagcaacaatgtattttgtagcaggagtttaagtgcacactgtcctggtttcagttctgaacattttagtgcttattatcaagaaaaaacaaaagacaaaacagcttgtcccattttacaatactcactaaaaggcacctctagcaacttctttgtttgggctacgtgcaaggttcacatgtgttcattttaaaccttccagaggatatgcaactcagaagttcattttagacatgtcactaaagccatttccacttattgattgcactgaaaggacagcaattgtgttttgctctataaaagatgtcgtggtggggattccttcaggggagaagcgacaaggctgttgttctttattttatgatctgactctaatcattagagaaggagacaaaataaatgggcctccctgttctctgacaataactcatgctgggcagattgtatttactttgtatgggggggaggaaatgtatatgtgtgaagatggactttaagatacaagtaaaaggggaaaaagaagctaaaatgaagctagttaccagaaagctaacaaaggttgttttattttccatatgctgtgtgggtagccgccattttacagagcctctttggctttttattaatactacattaaagtaagaatataagaaactaaacaataagaaaaaataaaatgccaattttatcctttcttttctgaaattctgaggactctcatttaaatcaaagagcttttatgtcactatcattagatttctttcttggcttattttcatagactctgaggccaactaaaaattacgttttctgaaaatcatcaaatcaaaagcaaattgaagtaatatttcaattgtttaacctgttcttttcttgtcctattgaaacacaactctataatttttatcaaaaatagttactcactttactgtgtttttgtttcatttgattctagatgcatggcttcatggttgaaattctgtaactaaaacaactttaaaattttcttttctactgaaattttgacacaaaccattttaagactcttaggatattttcctgaacatattgttgaaacacaaatggaaccaaaaaagtattgatgatatgttttatcatatttagaagtatttctcggctgggcgcgatggctgaagcctgtaatcccaacactttgggaggcccagatgggcggatcatgaggtcaggagatcgagagcatcctggctaacacagtgaaaccccgtctctactaaaaatacaaaaaattagccgggcgcggtggtgggcgcctgtagtcccagctactcggtaggctgaggcaggagaatggcgtgaacccgggaggccgaacttgcagtgagccgagatcgcgccactgcactccagcctgggcaatagagcgagactctgtctcagaaaaaaaaaaaaaaaaaaaaaagtctcatttttttcactcttcaacatgaatgtgaatttattgcaccacctctaaacaggggtttctcatccctaaacccagccatccatgagttcatcaaatgtccatcctcagtttcactgtattatataatgcacatttgcacaagcagagcatccacgcaaaaatatgaaatcacaaatgtagagagcaatttatttataattgacattgtcaattactaattgactaattgccaattagtaaagtgctgagacattattttccaaagggcaaagctttttaacaaatctgcacacagaaaagtgcaaaaattattttattttacaaatatttgaacatttttggtgaaattttctgagaacagcccatttaaaaatttctaaattgtgaaaaaatcttcttcctcttgagggctgggtttataccttaagcacctgacaatgtacttgtgatagaggagtactaaatctatgagtgttgcacagatacatacagacatgggcttgcttaataaactaggaaatgaagaaattgtataaagtgtttaaacacaaaaagaaaaaggtttacaaaatctatatttagcattgtaagaattctaattgctaattgactaaatgccaattactaaatagccgagactttattttccaaagggcaaggcttttttctttaaatctgcatacagacaagtgtacaaatcataaacatatagtaatagctgaatgaattactatgaagtaaatacacttgtctaaccataatccagtccatgaagcagaacattactaaaccccagagacccagtttgggtctcctatagtcattatccttattcttacccccaaaaaaacactatcctgacttctgttttctttttcttttctttttttttttttttttgagatggagtctcgctctattgcccaggctggagtgccatggcgcaatctcagctcactgcaacctccgcctcctgggctcaagcaattctcctgcctcagcctcccaagtagctgggattacaggcacgcaccactgtgcccaggtgatttttgtatttttagtagggatcgggtttcaccatgttgcccaggctggtcttgaactcctgacctcaggtgatccacctgcctcagcctctgaaagtgctgggattacaggcatgagccactgtgcccagctgacttcccttttttctgacagatgaaattatatggatttatcatgtacatgctttgaagtatatatacatcatacaatgactaaatctagctaattagcatatgcattattgcacatagttatcatttttaggtgagaaaatccactctcagcatttttagagaatgcaatatattaattagagtcacaatgttgagcttattgatcttacctgaaattttgtattctttgaccaactgctccctagtcccagccctcccaatcattctcaccctgataaacaccattttgctctccacttttatgagatcaactttcttagagtccacatatgggtaagaccatgtggtatttgtctttctgtgcctggcttatttcacttaacataatggtctccagattcatttatgttgttgcaaatggcaggatttctttcttttttatagttgaatggtgaatagaatttcgctgtgtctatataacacattttctttatctgttcatctgttgatggacaagatatgattccatatgttggctatcgtgaatagtgttgcaatgaacatgagagtgcagatgtctttttgacatactgatttcattttattcgaatatataccaagtagtgagattgccagattatatagtagttccatttttaattttggggggagcctccatactgttttcaataatggtggtaccaatttacattcctatcaatggagtgcaagggttcccttttctctatttgttatcttttgactttttgataaaagttattctaatgtgtatgcagtgatatctcattgtggttttccttttcatttccctgatgattagtgagattgagcatttttccatatacctgttggccatttgtatctctacttttaagaaatgtccattcaagtcctttgcccattttttaatcggttaatttgttttcttgctattgagttgagttgcatatatattttgaatgttaatcccttatcaaatgtagagtttgcagatatttttgcccattctgtaggattttttttcactctgttgattgtggcttttgctgtgcaaaaactttgtagtttgatgtaatcccatttggtttttttgtttgtttgtttttgcttttgttgcctgtggttttttttgggtcatatccaaaaactcattgcccagaccaaggtcatagagcttttctctacattttcttctagtagttttacagttttatatcttatgtttacatctttcatacagtttgcattgatttttttacatggtggaagctgaaggtctaatttcagtcttctgcatgtggatatccagtttttgcagaaccatttattaaagagactatcctttccccattgtgtgttcttggcacctttgtcaaaaatcaattgatcataaatatgtggattaatttcccggtgttttattctgtttcattgatctatgtatctgtttttataccaatagcatgctgtttttgttactatagctttgcagtaaattttgaagtcgggtagtttgatacctccaattttattctttttgctcaagattgctttggctatttggggacttttgtagttctctatgaattttatgattgtgttttctatttctgtaaaaaatgtcattagaattttgatagtacaatgactctataggtccttttagatactatggacattttaacattaatttttccagtccatgaacataggatttttttccatttatttatgtcttctttgatttttttaatcaatgttttatagtgtttaatttagaaatccttcaccttcttgcttaacttattcctaagtatttttttttttttttggtagctattttaaataggattggtttcctgatttctttttcaggtagttcactactggtgtataaaaacactactaaattttgtatgttgatttttttatcttgtaattttcatgaatttgcttatcattcctaagagttttttggcaaagtcatcagggtttcctatatgttagattatgtcacctgcaaacagggacaattaacttcatccttttcaattctaaagctttttctttcccttgtgtatttgctctggctaggacttccagtactatattgaagagaagtggcaagagtatgcatccttgtctttttccagaccttaaaggaaaagccttcggcttttccctgtttagaatgatgttagttgtgtgtttgttatttacggcctttattgtgttgaggtacttttcttctatacctaatttgttgagaatttttaccatgaaaaaatgttgaatttgtcaaatgcttttttgcatttactgaaatgatcatatggtttttgtctttcattccagtgagatgatgtattacatttattgatttgcaaatattaaaccatccttacatccccacacttgataataatgaatgattatttaaatgtgctgttgaatttgccttgctagtattttcttgagggtttttgcatgtatattaatcagggatattggcatatagatatttttgtgtgtgtgtgtccttgcctggctttggtatcagggtgatgctgtgcttgtaaaatgagtccgacagtattcccttctctttcactatcctgacttctaacaacactagttggtttttaccagtttttgaaatcatctggagctttttatgtcttgttatttttcactcaacactatgttggtaagagtcacccatattgttacatgcaactgtaggtaatgccgtctttttttttttttagacggagtctcgctctgtcgcccaggctggagtgcagtggcgcgatctcagctcactgcaagctccgcctcctgggttcacgccattttcctgcctcagcctcccgaatagctgggactacaggcgcccgccactacgcccggctaattttttgtatttttagtagagacatggtttcaccatgttagccaggatggtctcgatctcctgacctcatgatccggccgtcttggcctcccaaagtgctgggattacaggcatgagccactgcgcccggcctcgtaatgctgtcttctaaactacatcgtaagagtaccccacaagtaatttatcattctaccattgacatacattaaggttgtttccagttgggtctgttatgaataacactatataaagcaatttcaggagaattatctattttaccatattgagtctcctaattcataatcatggtatattccacttttttttaagccttctttgagctttgtcagtatacaggtcttgatagtcttttcttagatttttctctgttttactatttggtgccattttaacttatcctgtatttaatttagatttaactttgtgttatgaaaatttttaaaaatatctgatatataatatacagaagagtatagtgaatttctataaacttagcacttaccttaatctattatgaatcaatgaataatctgttttgtgtataatgccacttagtcaatctcctatattattttgaagcaactgtcagccattatattgtttcacagaacatatctcattaaaaatctctaaagtatatgctttttaaaaattgccacctctctgcttcctgagaacatgcaggttagaaaatgtcctcagtgtaaaaagctgcgaactaaaaaagcatacctaatgtaactctgtcttcaatgtttctcttggtctctgcctacattactaggttctccaatgtttatctctgagcaagcatagtttatcattcagccaaggatttaacaggctttatactcagattgtggctcttatcctttctcgcttcttgaatttctattttgtgttttcaacggctctttctgattaacttcctttgctactccaactgatcaagctgcaatcttttgccaccattgccagagggattgaagaacattcacaaacaaaataagccacaaactcacaattcttactgttgcagtttcagactttcaagagtaaactctcctctagcttctgtctgcttttggatgcttgccatgattttaaaattctcatttgggtcggggtttgtataatcatttcactcatccacatttccatcattttcttaatatctgtaagatctgtgggatattttctttctgtcagtatttatatgtcctcctcccccccccttcttttcatcactcttgattaaaagagatttacaaaatatgtgatcttttcaaagcattaactttgtctttattcattttcttaatgtttctttttccaattcattttgttgttcctgtcatttttatatccttctttctactttatttaggtttaaaatttattgctctattttgaacatcttaagatggatattcactgacttttggcttttatttttttccagtatatatattaaggctatacatctccaaaattctctcttcccagcatctcatacagactatgtcatataatatcattaactagttagtaaattttaaagattaatattcttctacctgaaagtatttcagatcaaaacttttgttctttcattaaattaagatatattaaacaatattgtaatatgtcaacctaaaaggaagaagcttaggaaaacgaatatagataaagtgttcatttgggccaagtttgaggactgcaacccaggagtatagattcaagttgccctgaatatacactctgattagtagcagtaacaaatagatttttaaaggcaaagaaagggcagcggtgggaagggagtgggctgatacaaagtcctttctcaggaattctcatttatttacagaaatagcattgattagtgaatggctatacattgtgaagctatagggttatagtgtctgatgtggcattattaattagtagctacttgtagcaatagcaagcagtttcaaaagataaatacattgctcaaaggggaagtggggcatggttgcagtctcattttaatgtttctctggctataataatcaaaaggacttgcgttcctcaaataaaatttcttttctcaatttacaggtcatctcacaaaacatattcaagtacatcagttataattaaatgctcttagaattttttctattcaatattctctctttcaaaatgtttcaataaagaatatgaagaaggcaactaatatttgtaaaagacatacactgaactacatgtgttaggaaaatatttaattatatttatagctaatcttcagtatattttctttatgcagcaataacagcttctaggaaaaataaatacaaatttattcagtaactaatatccattattatgtttcttctgcattttaaactttctcacctcatatcatctaatcactgttgaactgcctcataaatattcaaaagtttaactaagcatcatttatttattttatgtaactcattaaattgcatcctttatggtaaaattacctctgggcacaaagtaactaatatgcatgcaatttaataatactgactgccagcatatctcaaagtattgattgtgaatagccaatttaataactatatctagtactaaattcaagagtttgggaaactggagatgaactaaattgacgcaagcagggactttgccaatcaaaacaaattcaactttcatggaaaatgtgctccccacatataggattttgaaactcttagtagaaggacatgcctgatcttagatgctgtataagacaggaagaatgtaaaaagcaatctaaccactaacaggaaaaaggtcatgatattccaaaatatatctgaaggtaaggaattagtagtgaaactatgctatcagtgaaatatctgtcctctaaccctcaatttaaattagttgcaacttttgtgttagaaatgacagtaaattgaacgaaagcatgtaaaaccaactttccttaattcccccttaaagcacccatgaaaccatcagaaaagacagtcctcactgcaatcacagtgagtggtataaaacaaagttatcagagtgttttctaggtttttctttcctttcatctttgtgcagtgacccagcctcaaaatcccattttctaggttcaagcaagcaatgaaatagcctctggccctttatcttttcttcaacaaaacaacttcactcatacatatgaagctgtggttttcagcccaaacctggttagatttctttgggttgtttgaaaatacgagtagaggcttataccaacaaccaataatctggcatctccctgcacagcatagactactggtctgggagataaagtctagaaatggatgtctcaccattcaaataatccttaaactcatttttagaacagttgaagatcagtcagataagacacaaaggtgatgagactgaaggaaaatctttgaaagagaaaaacatatagaagaaaaaccttagaaagaaggaaatgaatgattagctttagtatgaattccttttcctagaaaagattttcttgtaaatcagaagaaaaattttaaatatatagttctaacctcaatgagataaacgagaatagttcttttatatttaaagaacaattcagaataggaagagaatacaataaaatcaaaatcaaagtgactaaaatattcattggaagcaataagatgtaaacttgatagtattaactatttaaaccaatgcttcagagtacaaacttgagaaataattgtagaatgcaaagtaaatcaataagaaaattttatttttaagatgtgagagaaaatggtagacgtgaaagacagaatagatttggctcatacataataggtatctgcgaagaagatagaatatatggaacaaaaggaataacagaaaaaaagtgaacaaaactccaaaaacaaagcaacaaggaaaaaattctgacatttaagatagagaaattccaatgtttcaagaaatattaaaatcttaacagccccatctttgtcactcccataattaatccatcaccaaagactattgattttatcttctaaatatttattcatccatacacatccctatatcttccaccatgcccctagtttaagctacgctcatttctgaccaagactccagcaacatctcctaaaagctcttgatgtatccacactaacccgtttccaatctgccctttatatttcaactgtttattcagtaagacaaattattgagtgcctccatctgctaccataaagcaatcatgaataaattaggataatttcacatgtgatagttgtaataataattatattaaaaattaaaatgatgtgagagagagtgactaagggaggggtggtttctttaaagaagtggccaaggaggcttcttggttaagctgaaacctatctgaaaagaaggagatagccatttggagaactgtgaaaagagctttcagtcactgggcaccaaaagctcaaaaactctaaattgagaatgtgattgaacgtttgaggcccattttgctagaaggcagtggacaaagtgagatgcagaagtatagagactatatcaggtagagccttgaagccatggtgagaagtttggaatttattctaagtgcaaaaggaagcctttttaacaaaaggaagtttttaacaaaagaaggatctaatttatgtagtttaaaacaaaaactaacttgataccgctgtgtgtatcttttcaaaacacaaacctaattgtgccacaggcacactcccagcctcatcctgcttaaaagcattccatgtgttacacttgcacataggacatttttggtttttactaatcctagctccttaacatggccaactacaagatctggctccatctatgactccagcatcaagtgcaccacacacggatcaccctccacatctgcctaactgtactttcttcagccccacatccccctctttccagactgcacacaggatgcctctgccttccctctccctttgcctgctgaactcccaatcatctctcagccttcaatgtaactgtctctgccttagtgaagacttccctgaccagcccctgcccacggagtcctatccctcaagttagatctgtatcaatatatagcttcccataaacctctgatcaaaacccgagttttacatttgtgggtgtgatcatttattcaacagatcgtgccctaagtagactgtaactccaagagggcagggacttcatctattttgactcaccattgattctcagttggccctaggcacagtgtttggtaaataacactgagtcaaaaaataccttcgaatggatagttgaattaacaagtttttagaactcaagacctggtaaaatatcaaatttcaatatgcattttcattaaaaataaaactgattaatagaaagacaaaatttgattattaataaaaccaattagtagaaagacaaaattactctcaaagatgcaaaaatcaaaaagatttttcttctacatttaataaaagcagaaaatagagtggtgtctactaaatgcagggagtacaacattgagttagcagtgatcactgagtacaattaaaggtatagaagtaacagaatacaagtgctaagagttgtatttttaaaacctaacaagcaggccaggcatgatagctcacacctgcaatcccaacactttgggaggccaaggcagtaggaccgtttaaggccaggagtcctagaccagcctaggcaacatagcgagaccatgtcgctaccaaaaaaaaaaattaaaaattagctgggtgtgttggcgcacacctgtagtcctacctactagggaggctgaggtgggaggatcactctagcctaggagatccaggctgcagtaagctcagatcatgccactgcactccagcctaggactaatacaggacaaataaaatgagaccgtgtctcaaatgagaccgtcccttcttgcaatcctatgaagaactacctgagactgggtaattgataaagaaaaaaggtttaattgacttacagttcaacaagctgtacaggaagtccggctgaggaggcctcagcaaacttacaataatggcaggaaggcaaaggagaagcaggcacatcttacatagccagagaagaaggaagagacaggtgggaggtgccacagacttttaagcaaccacatctcccgagaacttattcactatcaaaagaacagcaagggggaaatctgtccccatgatctgatcaactcctactaagcctcacctccaaattggggattacaatttgacatgatatttggatggggacataaatccaaaccatatcagaccttgcaaaaaagaaaaaaaagaaaaagaaaaacctgaagatggcagataggtggcagaactagcttgcagctcctgctcagatggacagagcagcatgtgaaaactcacatggtgaacttgtgctccaagaactaccaaaggaacataccaggaaagccaagagaatccacagtccctttgaaggaactggatcaccactgaaagctccttgagatgctaaaaaactgagtcggcttggtttttcaacgaggaggcatgcagtctgggataagttctcagtcttgatcactggctgcccggaaataaactcagtgctattggaggggggcgtggtgggagtgagaccagcctttaggactgcaggctgtgtaagagcaggttgaggcttgttactgctgggttttccctacttccctggtgacctgtatgactcagcagaggcagctctaatccccttgggaatataactccactggactgggaaccacacccccattctccacagcagccacagcaagccccactcaaagagaggctgagctcagaaatggctatccctgcccctacctggtagtctttttctatccaccctggtagccaaagacaaaggtcttaatttcttgaaaactctaaggccccagccactgcctgagaaacctgaatacttaaacagctgtgcttagggcaagtttgcatcctccctataggactgcagctggtgtgctcttgaaagtgccaccacttggctggaggccaactaacccaaaaactgcacactaaacaaaagcacaaccaaggaccttcacagtgtccacttcactccccaactaacaccactggagcaggtgctgatatccaggctgcaagacctgaagatgactcacatcacaggactctttgcagacagcctccaatgccagccagaataccagtagccctgctgggtggctggacccagaagagcaaaaacaataactatggttcagttctcaggaacccttattgctagggaaagggagagaacaccacatcaagggagcaccccataggacaaaagaacctgaatagcaacgctttaatcccagatcttccctctaacatagtctacccaaatgagaaagacccggaaaaaacaattctggtaatatgacaaaacaaggttctttaacacccccaaaagatcataccagctcaccagcaatggatccaaaccaagatgaaatctctgcattgccacaaaaagaattcagaaggtcaattactaagacaatcaaggaggcaccagagaaaggtgaaggccaacttaaagtattcaaaaacatgatacagaatgtgaaggagaaattcttcagtgaaatacacagcacaaatttaaaaaaatcacaacttctggaaatcaaagacacacttagaaaaatgcaaaatgcactggaaaatctcagcaatagaatcaaaaagcagaggaaagaactctggagctcaaagacaaggcttttgaattaactcaatccatcaaagacaaacagaaaggaatttttaaaaagaacaaagccttcaagaagtttgggactatgttaaatggataaacctaagaatacttgatgttcctgaagaagaagagaaatctaaaagttttgaaaacatacttgagggaataatcaaagataacttcccaagcattcctagaactctagacatccaaatataagaaactcaaagaacacctgggaaattcatcacaaaaagatcatcacctaggcacatagtcatcatgttatctaaagtcaagacgaaggaaattttaagagctgtgaggcaaaagcatcaggtaacctatgaaggaaaacctatcagagcaacagcaaatttatcagcagaaaccttacaagctagaaggaattggagtcttatttttagcctccttaaacaaaacaattatcccccaagaatttcatatccagtgaaactaagcttcataaacaaaggaaagatacagtctcttccagacaaacaaatgctgagagaattcaccactaccaagccagcgctacaagaactgctaaaaggagctctaaatcttgaaacaaattttcaaaacacaccaaaatagaacctcctcaaagcataaatctcacaggacctgtaaaacaataacacaatggaaacaaaaaacaaggtattcaggcaacaaatagcatgatgaatagaacagtacctcatatctcaataataacattgaatgtaaatggcctaaatgctccacctaaaatatacagaatggcagaatagataaaaattcaccaactaagtttctgctgtcctcaggagacttgcctaacacatgaggactcatataaacttaaggtaaaaaggtggaaaaagatattcaatgcaaatggatatcaaaagtgagcaggagtagatattcttatatcagacaaaacaaactttaaagcaacagcagtttaaaaagacaaagagggatattatataatgataaaaggactagtccaacaggaaaatatcacaattctaaatatatatgcacctaacattggagctcccaagtttataaaacaattaatactagacctaaggaatgagatacatgacaacacaataacagtgggatactttaatactccactgacagtgctagataggtcatcaagacagaaagtcaacaaagaaacaatggacttaaactaaaacctagaacaaatggacctaacagatatctacagagcattctacccaacaactccagaatgtacattctgttcatcagcacacagaacatcctccaagatagactatatgataggccacaaaacaagtctcagtaaatttaagaaaatcaaaattatgtcaattagtctctcagaccacagtggaataaaattggagatgagttcaaaaaggaatcctcaaaaccatgcaaatacatggaaatcaaaaaacctgctcctgaatgattgctggctcaacaacgaaatcaagatggaaatttaaaaattctttgaactaaatgatagtagtgacacaacctatcaaaacctctgagatacagaaaaaactaagagataagaagaaagttcatagtattaaatgactagattaaaaagtctgaaagagcacaaatagacaatcttaggtcacacttcagagaactgaagaaacaaaaacaatccaaacccacatccagcagaagaaaagaaataacaaagaggagaactaaataaaattgaaacaaaaaaagaaaaatacaaaagataaatgaaacaaaatgctggttctttgaaaatataagtaaaatcgatagaccattagcatgattaaacaagaaaagaagagagaagatccaaataagttcaattagaaacaaaacaggagatattacaactgataccacagaaatacaaaagaccattcaaggctatgatgaacacctttacatgcataaactagaaaatctagaggagagggataaattcctggaaatatgcaaccctcctagagtaaaccaagaaatatagaacgtctgaacagaccaataatgagcagcgagattaaaatggttatttaaaaattgccaacaaaaaaaaagtcgaggatcacatggattcacagctgaattctatcagacatttaaagaagaattggtaccaattctactgacactactcaaaaagacagagaaagagggaatcctccctaaatccttcaatgaagccagtatcatcctaataccaaaaccaggaaatgacataacaaaaatagaaaactacagatcaatatccctgatcatcatagatgcaaaaatccttatgtcaaaaagataatacaccatgatcaactgggtttcataccagggatacagggatagtttaacacgtaagtcagtaaatgtgatacaccacataagcagaattaaaaatcacatgatcatctcaatagacacagaaaaagcatttgacaaaatccagcatctctttatgattaaaatcctcaacaaaattggcatacaagggacatactttaaggtaataaaacctgtctatgacaaacccacagccaatattataaatggggaaaactcgaaaccatttcccctgagaactggaacaaggcaaggatgcccactctcaccacttctattcagcatagtactggaagtcctacccagagcaatcagacaacagaaagaaataaagggcatccaaattggtaaggaggaagtcaaactgtcactgtttgctgatgatatgattgtatacatgaagacaaaaaagctcctagaacggataaatgaattcatcatagtttcaggttacaaaattaatatgcaaaagtcagtagctctgctatatgccaacagcagccaagctgagaatcaaatcaagagctcaatgccttttacaatagctgaaaaaaataaaaataaaatacttaggaatatacctaaccatcgatgtggaagacctctacaacaaaacactgctgaaagaaatcatagacaacacaaattgaaacacatcatgctcatggatgggtagaatcaatattgtcaaaatgaccatactgccaaaagcaatctagcaattcaatgcaatttccatcaaaataccaccatcattcttcactgaattagaaaaaaaaaaaaaaaaaaaaaaaacacctaaaatccacatggaaccgaaaaagagcccatgtagccaaagcaagactaagcaacaagaacaaatctggaggcatcacatttgcctgacttcaaactattctataaggccatcatcaccaaaacagcatggtactgatataaaaataggcacatagcccattggaacagaatagagaacccagaaataaagccaaatacttacagccaactgatctttgacaaatcaaacaaaaacataaagtgggaaaggacacccatttcaacaaatggtgctgggataattggctagccacatgttgaaaatgaaactggatcctcatctctcaccttatacaaaaatcaactcaagatggatcaaagacttaaatctaagacctgaaaccataaagattctagactatcacctcagaaaaacccttctagacatcagcttaggcaaatacttcatgaccaagaaaccaaaagcaaatgcaacaaaaacaaagataaatagatgggacttaattaaactaaaaagcttctgcacagcgatagaaataatcagcagagttaacagacaacccacagagtgggagagaatcttcacagtctatacatccaacaaaggactaatatcagaatctacagagaactcaagtcagcaagaagaaaataaacgatcccatcaaaaagtgggcaaagaacatgaataaacaattctcaaaagaagatatgcaaactgccaacaaacatatggaaaaatgctcaacatcactaatgatcagggaaatacaaatcaaaaccacaaagagataccacctcactcctgcaacaatgaccataatgaaaaaatcaaaaaataatagatgttggcgtggatgtggtgaaaaagttacacttttacactgttggtgggaatgtaaactagtacaaccactatggaaaacagtgtggagattccttaaaggactaaaagtagatctaccatttgatccagctatcccactactaggtatctacccagaggaaaagaagtcgttatacgaaaaagatacttgcacacacgtttatagcagcacaatttgagattgcaaaaatatggaacgagcccaaatgttcatcaatcaatgagtggataaagaaaatgtggtatatacaccatggaatcctgctcagccatattaaaaaaaagaatgaaataatggcttcacagcaacctgggtggaaatggagactattattctaagtgaagtaactcaggaatggaaaaccaaaaattgtatgttctcactcatatacgaactaagctatgaagatgcaaagttataagaatgacatgttagactttggggattcaggaggaatggtaatgggtggcaagggataaaagttctcgcattgggtgcagtatacactgcttgggtgataggtgcaccaaaatctcagaaatcaccactaaagaacctatctatataatcaaacagcactggttccccaaaaacctgttgaaataaaaaaaatggaaaactaaaaattagacaatttttttttaaaacttgataagtaaaaaaaaaaaaaaaaggttgataagatgatgtgttgttgtacattcatccattatagcaaatgtactattctggtgaaggattttgataacatgggaggctgcgcatgtgtagtgggcagggagattcaggagatctctgtaccttcctttcaattttgctgtgactctaaaatggctccaaaaaaaattttaacaagtgtgaaaaattggacaagcaaagacaaaatattaggaagaactactcaatggttttatatgactgaatgaaaatgtaaaagtaggggaaagttcacaactcacccagtaatcaacagctgcatatggcagaactcatgagttttagattttataacttcatgtaaggaaactgcattgtgcatgacatgaatatcatagaatcgtcacaccagaaaatcaaatacactacctgcacagttaaaataatcattatcttggagaatcagctttgggaaaaatagagtgtctactaagaagaaccatccttggtcaggcacggtggctcacgcctgtccagcactttgggaagccgaggcaggtggatcacttgaggtcaggagtttaagaccagcccggccaacatggtgaaacctcgtctctattaaaaatacaaaaattagccaggcgtggtggtaggcacctgtaatcccagctacttgggaggctgaagcaggagaatcgcttgaacccaggagctggaggttgcagtgagctgagattatgcaattacactccagcctgggcaatagcgtgagactccatctcaaaaaaaaaaagccattctctttatttaggtttgtctctatactctcctacaggtattatatgagtcagaattcatacttcctgtctgccactaatattatgtacattataattttaaataaaaataatatttgagagacaaaaatcagaaaaccaaaataatatgaaggattaaaaaacatatacttacaaataataaaaatcagaaatattaaaatatcaagaaacaatggctcaagcagttgaacagcaggggagctctctaaaaatcattcacaaacctaagagaagtactattttctctgttatataaataaagatgcagagattcactggtgaactaacttgtcccattatatgtggcttaaaataccaaaagtaaaattcacatatagaccttctggctttacaactttggaacccataatcttctttctggggtctattctgggaaattaatctaatatgtggaaaacagggtatatgaagatttccatggcagcattttaattaaaggagcaatatgaatatttgcacggcagcattttaattaaaagagcaataattagaagctatccaaatgttttacagtaggaccatggttaaataatatgtggtacataggcatatgatacaatgttatttttaaaataagaaaatatttctatataagagaatgaaagcaggacataaaaagtataattattttaaatacataaaataggaagtgatacacaaagaaaataattgtatgaagatattaaaatgataagctgtctgtgctctaattttaattattgatatctttttaatgactttaatttggtttcaagtgattttacatagagagttcaaagttcatgagctgttgaaatctacatctgaggaaacaaactaaataaagagaagtttcaaccttagaaagtgcatgtgacttgtgaatattgtgtaacctcaattccagcttaagaatcactaaaggagagaaaagtagctagagcggtacggcagcctccggattctgaggtgttctgcgacttccccagaccctaaccttcccggcctcttccccagagaatcacaatctagatgtggaacagtggatttgaaagctatagcagcaactcatagggcagccggtgaatacatgcagtccccggtaggctttggatcgcgggcaccttcttaggcagaaaagaaatcaagagccagagcacagcacattgaacccacacacatctcagctgctttctgccactttgattgatgaagtgttcaaaattggcaatgctgagatttcacaaatcactcttgtagggatcatcagacatgcagagaagacttcaaccaacattgtttacaaaatagatgacatgacagctgcacccatgaatgttcaccagtgggttgacacagatgacaccagcagtgaaaacactgtagttcctccagaaacatatgtgaaagtggcaggccacctgagatcttttcagaacaaaaagagcctggtagcctttataaatcatgctcctggaggatatgaatgagttcaccatacatattctggaagtgatcgatgcacacatgatcacaaagcgaacagccagccctcagcagagagagcacctatcagcaatccagggaagagtgaagcagcctccctgtggcccaaaatcaggtgttgaatgtgattaagtcttacccaagacctgagggactgaactttcaggatctcaagaaccagctcaaacgcatgtctgtatccccagtcaagcaagctgtggattttctgagcaatgaggggcacgtctattctactgtggaggatgatcattttaaatccacagatgcagaataacgggaactaattgggtacctgagattttttacagctggacctagcttcacaatctgttttctccagctgtgcatatgtttagccaggtggcttctagaagtcagtttcatctataaaaggtctccaccgacatccttttgaaacttactgctcttctgttttgtttgaagctcagagggagatgggcaattgacagggatacaatcccaggtggaattgcttgaggaagttacaaataagcttgtttcatactaacataatgcaaataactcttttataaatgaaaacatgctcatgctctccacaacagggagaaccaaagaaagtcccataagtcaatttgtcccagtcatcgtgaaaccttgccccttctctagggaactacatcagaaagttacctaccaataacacgctccatataaaatatcagaagaaatgaagaggctaaagtaatttaacatttataaaaacatacaaaagacgaggaagaaaatgtggctaattactgtggtcctcacttcataaaggtgtagttgcaatttgtaacttccttcttcctccttccatttcttgttccttttgctttcagccagcactgaggttggttaaggttcttaatatgtcgtggtagttaaaatgttcattcttgagatcagagcctataatggcttcctatggtcaccactggaagaggcaatcctagacatgttccagaatgtctccaaattccaattaaacttctcactggccacagagtatagcagcacccttagcacccttagctgaaagagaatctggaaaatatgtttttggctttctagactccacagtacacaaaacatgaaggaggatgaaatgggtgcagtaatctactatttccaccacagtaattaagttgggggaaaaaaaaagaattactctcttatgaccttcgccgcagtaatgcaggatttttctcggccccttcatcagacttgtgacaggagtgaccccatttactcggcctgccgcattcaagcctttgtgggagggagcacatgaacaagctccatgtggggcccacagccagaacaggcacatgtggataaatgtaagatcctgccagccagttcagctgctggcaggaaaaatctccatgtgggacccatggcagtgcccaggtggtgctaggtgcctgtgacccctaagccccagagggaatgttaacagtgctctcttagctctgctgtccccggacagctgtgtgttagcagctcagctgacagaagcaagctctgtgtggggcctgcactggttcccaggtgagagtgtctgtaaccctggaaccccagagggagtgttacagtgctgtcttacctccactgtccatggatggctgtgtgttagcagctcaactgacaggagcaagctctgtgcagggcctgcggcagtgcccaggtcagggtgcctgtgaccctgaaaccccagaggatgggttacagcattctcttagttctgccatccatggacagctgtgtgttagcagctcagttgaccccttgcctcatcacatggggcaactaccctccactggcaagggcaaagggctggtgtgacagactatctgggtacctgcactcggtgggtcccgagctcttgtctggtgtccaagaagaatgaggtcatatggatgaactgaatgatggggaaggtggaaaattttactgagcaatgaaaatggctctcagtggagaagggagctggaaaggggatgggaagggcaggttgccttccctaaagttaggctatctctcctctgaagtgcagccctctctcatcgcttctgactgatagtgggatgtttctctgcacaggacggtgggggtgggccataggtagttttgaaaaaggcaagattcaattggtaaaaaggcattattcagaaagaacaaataaggagagaatgggcaaaaaaggaatagaagtgctcacttcaggccatgggtttcaggcttctcagcttgaaggtgcagtttcactggggacccatttctgtctgcctagaatttctctgcctccttcctctatcaacagtaaggaagtagatgggagaaagctactctttgttgcactgatatgtagttaagttctagtgcctaaacagagtaaatctttagcttaattgtgggacagtcattgatctcacaaagggatggagtttgctgaagccagttaccataagctcctaacgaggaaagatgatctcaatgcataaaaagggctttgacagaaagctgttcctttctgcctccctccaccctccctacccccagatcctgacaatgctgtttctctacattcaaaccattccagagtatccagtgttctaccacctcttctccattaaactgatacagctcgtgtgattcatctttatgtgaagctcaagaggaaatactcagatgccacatactcagataattcatttgaagtttcatggttttgaatggtaaattgttctgatgacctatgagagaaaagcactccaatttctttgaatgattcttctttaatgtcaggatgcattttcactccttcaggccaccaggctacaaagtagcaggttttgttgttttgctgagtactgctgtagtgctgcaatttacacagatgcaaagcagacagtgattaggaatgtgttttggccttattagtaagacctgttaattgggtgatataggagtgatttcttcctatgggtggactccagcaacatccaaaaaagagaaaaagttcaagcagccacaagcacagaggaagctttaaaattaacctgccatgtgataatttgttgataggttggttactggaaagacatggaacaggaagatacagcagaaacagtcaaaactagagggaatgagtctttcgtcatcctaacaggattagaaggaaatacgttatatcacttcacagtgagggcttacaatggagctggatatgggccacctagcagtgaagtgagtgcaaccaccaagaaatcccgtaagtgacctgggctttttgtttgtttcagacaaaggggaaacatcgtataacatttctcaaagccacgtgaggtgcataataagcagagtcaaaggggagttttgattcatagtcttgcttcagtgcttagatctgaatcctcaaactagctcagaaaattctgcattcagagtagacaaaggttatcttcctgtgaaacaaggctaagcgattttgacacagaagggagataaaagaattcaagttcaaaagctcagcagagtagctattaaaatgacactcctggagcaaaaccctccttatctgactccagctggaaggaagcctagattgccagccaactactaagcaggagaaaagattgagatactcacaaagaattaaatgaagaaatgtatttaagaatccttgtcagttcactttcactttttattttgcagctcctagtcaagcacctagcaacctcaggtgggagcagcaaggctctcaggtttctctgggctgggaacccgtcataccattagccaacgaatctgaagttgtgggttacaaggtcagtatttcttcactcttttgcatagatactcatctccgaaattgttattatgaagatggaaaattaataaggcataaaaagacccattaaccaacctattttttctcagtcattttctatctgtatcttagaaagatagccttcctatagatagagaagccaaggcagtcaaaattagtttcaactgcacaaggcacagaaagggaaggagtaggaaaagtagcgacaatctgaatgtagtgtgaagatgactctgtgaagcatgatattaggaccagcagaatttaggcagagaattctggcatattcttccaggagactaactttgctggcagctgacaaatatgggaccatttcgttttagtggaaagtctttctattagcaaggaaacagaagaacaaaaaaaatgtaagggctagaacactagaaagaaaacaaaaaatccagggagagacacagcaagctccaaaacagagccaacattcacatacagtcattctgttctgtgacagtaagatctggaaatttgataacatgtgcaatttgtttttgaaaaataactttgttatctgatttttaaatatatgtgatctatgtattgaattggcttaatttcaaattcttgttctataatgtcagattctgtttgttgcattaaacttcacacagaatcattagttgaatattcacaatatttttaatataataaaatatattaagtataatattttaaaatatttcagtgataatatttcaactgaaagctatcattataggtgggttttcaactatcagagatggtaacacagtattcagtacataaaatgctaaaatttaaggagctaaaaactgaagaagttataaatggaatattttaatttccattaatattatattacacaaactagcatttgttacctactgtaattaggatagatcacagacacacacacacacacacacacacacacacaagtccatcagtaatggtcgggaatattgaatttgatcttttgcagggagtgcagatgggtcattttctataccattcccttactcctctttccatacccttccccaaaagaccatatcctcacaacttctcctcttagggaaatatactgtttaatgcttagggatagcaggcgagaaatatgatagaccattcaggaaccaatctaatatcattagaactatgatgaacaatatcccaaactggagaggcaaagtagaatgcaagagaaaaccagataaacgtgtatggtcaagtggaaggctcatatggtttaggtacctttcaagtgagaatagagaaatactatataactagaaaaatactctattgagcttgggtgtagggatcccaggctaggtgccactactctttgttcacatttgacacctctttcccagtcattgttcttactttttatatatgactgtctccccaaacagactgaagtcctcaaaggcaaggactttatcttacttatttcttgttcctaatgtttctagaatggatgactaacgttggcccagatagaaatgtcttatgcagttatttatatatgtgtattatcaaatatgtatttttttctagcataaccttgccatttgttgttgcttagaggaaaaaatatcactggccactgattcagacagattttagttcaaatcctagttgagtaatttaagtaagttgtttaaactttatcagttttattttcttaacttcacaaatggcagaaatagcaataataatacatattatacaggattttctaaagaataatttgtataaaatgcttggcatataaaatgttctcattaaaaaacagataccatttcttagtgttgttggaggagcatgtctcattaggtacaatttttaaaattttaacaaagaaactgatcgttaaaagttgcctgccagttccctcttaataaagatatcacaagtcatgttggaataccttgttgctgagggaagaatcactagcatagtccattttagttgtgtaaattaatgacaagtaggcacacattgcaaaagatatttttttccttttattttcttgaaatggttgcacttccttatatccctgagaaggaagaattgattcgtataaaaggagtctgctgataacaaatggagtgagacctcaaaaccttctcctttgcaactaaaccttatcggaacctttctgatgagtgggatgatccccactgagagaactgctgacaggaaaggcttcctgagggaaaggggacttcagactggactgggcttaacccagagtttggattctcctcagaacgcgggttttcacagggcagccaaggatgaaagctcctcctgacacaatgggacaggaatatatatttagaaataatagctgagaatataaactaaagagctataacccagagaacacaagcttggagcccgtcttctgagtatgacgttgaagacagctactgcacccttggcaaggatccccacacagcagtgaaagaactgtaccatctgaaggtgcacactaatatagaatgaccagggctgggcatgatactcagaaggagaatccttttgattcctactacatcccaaaaattactgccaaccaagagtggcaccactataatagcgggccacctcttcttaagcacaatgtgtgtcacttacaaaaattaataaaatagggacacaggacactaatcatttctcttcccacaaggtagtttgaggcgggcttgacccattaaaactgaacttgcccctaggattcttggaacatttgaagcagaaaacttcttgctcatcggggaaagggagagtttccatacttaattggaatattaaaaagggaggtcacttaattttcactctttgtctttgcaaactacttcacttttgcaagcagaaaggatcactggaaatgcatattgtgtggaggtttgaggctgagaacttgggattaatgcctgaggtttaaaatgcagggaatatatattccaccttttacattaagtccagtttaagattgaagaattcagaaaagtatttatctgggagacttctaggttgtgaaagttattgaaacataataaatgcagaggaaaaagtagatattttccccatatattcagtgcataaataatgtaataaatgattcttttgtatagttaagctgctatatacaggatagacattctgaaaaagtgcactagaaactggatctcataaagatagagactggtggttatcagaggccaggaaggggaaaggagagtgaggaacaaagagagcttaatccatgggtacaaatatactataagatagaagaaataagatctggtgtttgatagatcagaagggtgactatagttaataatctattgtacacttcaaaatagctagatgagaataatttgagtgttcttagcataaacaatgataaatatttaaggtaatggataacccaattaccctgatttgatctttacacatcatacacatgtatcaaattatcatattaccctgaaaatatatacatctattatgtatcaataaaaaatttaaaaagtaaatgatataaaggaataatacattgtcctttaatctttagtagttgaactcctttcaggcagataaatgtgcattaatacctctaggaattttaaaatttattttgccattttccatggaatataataagaacactataaaaaatatatcagtacattataaaattttaaagcttatattaataaagtaattgtaatcttgaaaagtaaactatagaaatagcacaagataaaacagcagaatttgacatttgagctccccattgtccaagaaagcactgtcttagtccttttgcgctgttataacagatatctgggactgggttatttataaaaaacaaaaatttacttctctcagttctgaaggctgagatgcccaagatcaaggctccagcaaattctgtgtctgatgagggtccacttttggtttccacaatggtgacttgaaagcagtatcctcaagaggggaggaacaccgtgtcctcacttggcagaaggcggaagtgcaaaagggccaacaaccacgagaagcctcttttataagggcattgatcatactcatgaaaggagaagtccttgtgatacaatcacctgttaagggccccacctcttaatactatcacactggcaacacctgaattctgcaggggacacattaaaaccatagcagcatagatcttactttcttactcgatttcagacattgaggtgtcagcaacatatataactagcagatattactagagaaagatgataacagaaattttgctaacagatattaaaaaaaaaaaagaggtttccctatcacaaaatcttgtcagggccttcaaagtgaccaagaatatcatgaaagatagatggaattgaaccacatataattgcacaataggtaacacattaaaactgaattcatttaggtgaacattaagcagtacctagtggtgaaactttccactgatttttttttgagattgtctatgagatgctgggcttcttggaattttgtttaagaaatccagatttaatagtaataatttcaagatatcatagttttcactaacaagtaaggactaaaagcatagagaaccagcaagatgttggaaaggattgtctgttataccaaataataatacaaataatttccactcaaaataactttccatttgagaagctgaatccaatttggtaatttatttagcatatttatgacttttcttcaggtcaataaacatgtgccactttattttgttgtatttacattccccaattcagaatcaactgcctattttattaatacattatatataaatgattgggaaaatgaaacaaaaacttcaaatcaaagttttcttaccttgacttattttttcaaataaatgtttttaaacaaataaaattttatttttacaactcctataatttggggtctctatctagaatccttactaattatagcacgtaagactcaccattactggtgttactaaagaaatgccaaaaaagcttattgactaaagtatattcagccataatttttaatgatctcaaaaatggaaaatatttttctttacacgatgaaagtaatttacccaggttataaagtaaaaacaaccattttatctccaccttattttcttcacacagacttatgcttgagtgaaagggaaaataaaactcaatgttcaggggctatgctttcacttcagcaaatgtccccttccccacaaacaaaaactgttatcccttcagaaaagacacaagcagtcagaaagaattcaggacctcaggctataatccaagcaaaaactattagttttcaaatctgtatctagaaaatagcctttcctagatatacaaccccttcaccaaatatctcccctcacccatatctactttctacctgttaacagagctagggcaaatagaaggaaatcaggcccaaagtttactagttattatacagtccatcaataccgtaatagtccattttcacattgctaataaagtcattcctgagactgagcaatttgtaaaagaaagagttttaatggactcacagttccacgtggctggagaggcctcacgatcacggcggaaggtgaaaggaacgtctcacatggcagcagacaagagaagagaacttgtgcagggaaactcccctttataaaaccatcagatctcatgagacttactcactatcatgagaatagcacgggaaagacctgtccccatgattcagttacctcccaccaggtccctcccataacatgtgggcattgtgggaactacaattcaagaagagatatgggtgagaacacagccaaaccatatcaaatacaaacagaggttctcatttgtttatgcaacttagatatcagttgagattccagattcctgagatatatgtacacttgggttgatactgttttacatacccactagaactttgaagcccatccctgtatttctctagcttcttgggaactgtatagtctatagccactctagcctctgatttcttttattttgtagctcctccttcatcttatattcactctaaataggagactcagccttcttttctctgtttccacaaattaaaaagactcacatataatgacttaagctggaagataggtacatgaggttcattatagtatcctctttacattcatttatgcctgaaatttctcagaatttttaataattgaaatagaaatggctcatgtcacatgcagtatatatatgaagctgactttttggaaatgctggggagatagagttagaaaggaacaacatgcaagcaaacatctgcaacatgcccaaaaagaaatcttgttgttaaaattgtgttcagacaccctgcaggcagtgaattctcactgatactgtgtctcccaacttctattcatctaacttccattgtcttactgactccttccttcccatcccattgtcaccgaggctttagattcctcaccctttttatgaagagcagttgtacccatcaattcttccgaagatgctcagcagaggaataggcctttcctttaatatgagccatccctctcaggagtagtttgggtataaccagcaaaaatttattctgtcatatttttagcacactctcctcaatattctactaccatcaaacatatagaatagccattttcagatcatgcctttgagaatagcaataccacaatcactttctatttaggatcatctctttagataacccactgctctcagttttttttttaataccaaaatttgagaatagtcttgacaatacattagacaattttctttatgcataaacatagctgtcattgcaactgtcaatctataaatgtccatattctctaagaactctctggactccttactgtcaataactatttttttctatgtcttgataacttcttaaccttctcatagttctcattctcatgcatcttttctaaatcaggattttaaaatgagccaacattctctaaagcactgaagattaactattaatttaatgtatctttttacttagtagatctacatatatgtatagcactccatctccctggatatattggcaaaaggccacacttaatctcaaactcgttttgacaccactaactgattttttccccgtctttacctcttaatcctaaatctcaactgatccacaaatttttcttcaactctagaacattagatatgcattgctggatgtatttttctttgtcataagaaatgtaatttattgaaccataataacactgtcctctaaaataatcactcccctgccaatcctcaccaatttacatactttcccattcccataaatttgctttctaattacctcacatggatgatcagaattctaattcatcacgatgctccagacgaaatcaaaagcatacagatatatttgtcacattttaagacaaaagaagctgcttaaggcatcctccaggaagtgttcctgatttccccaatcttgactaagtacccactttgtgcattaccatagcatcaaatatatttcccgctgcagtgcatatcacacttctttgcattgtctgtctgtcttcaatattagactataaatgccaggaagactgtaaccatgtggtcttattctctgatgaatctccggtatgtagtactatgcctggcctgcatgagatgtccaataaatgtttgataatgctgttatcaccttgcatttacactgaggctatagcatccttcacaataaggatttccatagataaaattgttgcacatcataattaaatggagaattcacttccctcccaagaacatgaagtagatttaaaattaaatgaaaaaaaagaaagtgaaatggagggagcatttattactagaattcagagggttcaagtacacgcaggcttcaatatgtggaaatattgcttctctaaagtatttttggatttttttgtatgtaagttaattcaagctcaaaacacattttctgtaagaaaatatatgtcaataattatctaatttcccaagtcagttcatattttatgatgcacttgaaataccaaccctttaacagttaataaacaatgatggcaacagaaggagtagctttctctttttaagcttatcatacaccaggtcctgtgctaggtattctacaggcgctttctcattttactcccctaaaacactaaaattgttattatcatctctatcatacagtagaataaattgaagtttacaaaatttagtaacttgcccaaattttcccagccaggaaggtataggagattttgttttctttgctatgttttgtaggaaactgtttcatatccagatctgtatgaatacaaagccatttttctttccattgtacacttataataccaattatgaaaaagcacaaaaaacagtgactctgaataaaaacacatttaaacacatcttaactgccactacttgactattataccaaaaattttacttgactatttttggaggcaagtaatagtacaatatagtaaaatagctctgaagtgatgatcaaatataaatcttctgatgagatttctaccctaactagccacacggtcttgtacaagtcacctaacctttatggccttcattttctaatatgtaaacccaggattatcctgtgtcctgatttgcagttccaaaattgttttccgtgcatgtatgtttaattataataccacaacagatgtctaaaaagctttagctttgctacaccatgtatccaaatgccgattttaccaaaaagcaaaccactacaaaagcaaaaattaaaaaaataaaattttcactttcaactgtttcctacattgttaaggatttattattggtatgtttaacaaattttgtttactcctttcaaactatttgaagatgagctttccaaacttccttaggatatttcaataaccaagcataacagactctccatgatctgcctcctctctacctacttctctagcctcattcctcactattcccatatatcccctctccattccctgctctcatgccattgtttcttattgcttagatgtagttattaattttatcttacctctttctggaattctccctttctcaaactggtccactctatcatatttaagtatgtagttcagacatcacttcctctggaagtccttcactaaacccctagacaaaattaaactctctcctgtacctccatggcccttttgtgtacttctactgcagtagactgcacatgtattacatttgcttatgtatctgtctaaactgtaagctccttgtgcttatctcagaatgtgacacatagtaggcagtcaatgtgcatttgtaatctttcatatcaaatgtctaaaccttgttattactctcaggttttttataggcaagagggtcacagcaacagccaagttattgaaacacagaaacttcaagcagtagtaccactcccagatgctggagtctatattattgaagttcgagcatatagtgaaggaggagatggaacagctagttctcaaattagggtaccatcatattcaggtaagttttgacacagtagatttaatttgctgacaaccaacaattacgagatggtatgaaagtcacgaaaattgatgtgatagatttcatggttcagagattttgagggatttctcctctctgatttttatattatcttctgattaatatgaaccatagtaatctgctcacaattgcagaatttctacaaatctagaaaggagttgacattttcattagaatatactgatttgtgaaatgtccttgcctctcctggtctcaagcagtaccttgctagccatttggtttttggagtatagcttttaaactgatattacactggttttgacatacctacatttctgtagttttgattgcctttattgttagacaataaggaatttaaagagaagcttttaaaattgaaatgtgaccatatttattgatttctaaacaaattataaattttattgtacattattattaacaatattaataattgctagctttcactgacccttattatatgtcaggcatggtcaaaagtgctttacatacatcatctaagtttagtaacaatcatatgagataggtgacatttttactgttttgcagaaaacatttaagtaacttgcctaagaccacactattactaagtttcggaaccaggatcaaaacctgcgtatgattgtctccaaaaccacatatctccatcaccaccatcattattacataagcaagggaaaactgattaaaggaagcaagattttagaaatttagaagaaagcaaccatttcgtagagatagtaaaaaaaaaaaaaaaaaagcaaaaattaggcaaatttctaattttaaaagtattagacaattttatgagaacattatgaaacattttctcatgtacaattagtgggtaattaggaacatcatttgttgagcaatcattgccaagcagaattatcaacctacagggaagtgtcccgtcatgctctgtatgtggccctatgttatttaacgtatttatcaacttgaagtcagaccagaggcattgcttgtgatttttttttttatgccaccaagtgaaatgggagataaatacagtgtagaaaagaatgagacagactggaactttgaggaaaagctactgacataatacttgataatttttttaactttttaagttcaggggtacatgtgcaggtttgttacacaggtaaacttaaacttgtgtcatggggttttgttgttcagattatttcatcacccaggtattaagcctagtacccattagttatttttcctgatcctctccctcctcccaacctccaccctctgataggccctagcgtgtactggtcccctctatatgtccatgtgttctcataatttagctgccacttacaatacttgataagttctcacatgaaaatacaggataaggaacattattgataattgataagatttgcatacctgtaaattagatattacatcaacattcatttcatttttttaaaaaactatactgtggttatatttttaaaagccttatttttaggaactatacattaaaatattttgaggaaaagatgcatcatatctgctatctgcaattcatttcaaatgtttcaaaaaaatgtatatatgtacagaaataacaataaagcaagaatgataaactgtcaacatttaaggaatctgggtgaattccttagtctcacaacttttcagtacacctaaaagtatttttaaatgaatagttaaaaatacaaaacataagatgggagaaatctgactttttcagaaattctggtgaaaagatctaagaatttaaattttattgtggtcacacaaaaatttaatatgctttatggttcatttataaaagtatagttttaacaacaagaaaagttataatgtctctgcattaattatttcacaattgaactgttcagatgaaggctgaattttcaagagcatcttaaaagactatttcctgaaaagcaaaatatacgacaaccttcctcttgcttcagcacgtcagattcctagacaacaatacagtgagcatttactgaggcctcatcacgttcctgggattaaactaggtgttttctatatattattttatctttctagcaatcctttgggttaggtattttattcttctctgactctctaaggttactttcaactccaacacaatcagattctatagtattatctgaataagatcagcctcaaccttggaagtacttatgacaaccttaattctcccatttatattttaaattgtaacttctactccaagaaaaaaattgtcaacttttatatttcagttaataaaatttgggcagtgcaacccacttcctgagtttcagtatgggaaactcttacactattgtctaccttagactcagaacctgagtcatgattggtttcatttttatcatattgcaaaaaccaaatgcctaagatattgaatgacttgcccaagtgaaacagctagttagttttatagctggggcaagaacttagtctaatgttgctctttctgttgttttgtggggttgttttgctgtatgaaagtaatatgttttagctttgtagattctatttgaaatttgagacacagaccctacttagcattctgaaagtgagatatttttataaaagtgtcaggtaagttgatttaacaaagatgcagccattcccaatagctagaaaggatgtgttcttgttttttatttattaagcatgcacatacgactccagtgagtctttgtcatctcgcctttcttatagctcacaagtggctatgtgcttcacaataaccccattttgtacaagttgaaatatatgcatcattctccaatatgttgattgataagttctagtagtgtattagctgtaaaatttttcaaaggaaagatttacgctttttgcatttgtgtgtgtgtgtgtgcacgcccatgtgtgtgtttaccaaacaaattattctctagctcttaagcatcaggaaaataaattcagactctatctttgcaactaaaactacccccccaaatcccattacactcagtctagccagagaggattaccttgacagaagattccagcaattgggtagtagattatagtattattattagggttttaactaaggccaatcattgttttaagagagataatacacgagtatctaaatccactaattcctacctcaattactctaagcaagtttacagcctttctaagccccagttccacctgcaagaggagaataaataattgtatttaccatataggaatgttatgaggatcaaataagataacatatataaaaagcttcgtacagtatgtgacatacaataatcatttattaaataatcaattatgatcatgatgcttcagaagacttctggcttgaagaaccactcctgatgttagtatctaaaagtcacttagtttgtggttatgtagggctattaaaactacttcagaccaatcaaccttggatcagtcagtttaatccaacagcgattctaatatattagctgcatacaatgtttttgtctcataaaagatcctctcctgggtataagaaagagtgacgaaagatcaccattttttgccaggtttggcatgagaacctagaatttaagctcactcaactgaaataatcaagaacacataaataaattcagtaaataaaataatgttattagattttaaaatttactagagtaagcatagtcatgtatttcttaatgatgaggataagttctattaaatgcatccttcagcaatttcattgtgtgaacatcatagagtatgcttacacaaacttagatggtatagcttactatacacctaaggcatatggtatagcctattgctcctaggctgtagacatacacaacatgatactgtactgaatactgtaggtaattgtaacacagtgctatttgtgtatctgaacatagaaaaattacagtaaagatatagtcagtataaaagataaaaaaatggtatacctctacagggcagttaacaggaacagagcttgcagggctggaagttctgggtgagtcactgagtgattgccaagtgaatgtgaaggcctatgactttattgtacactgtcatagactttataactgtatacttaggctatattacatttataaaaacaattttttctctaataaacttagcttactgtaactgttttactttataaactttaaattttatctcttttgtaataacacttaaaacatacataatacagattaaaaaaacattttctttatatctgtattctataaactttttaatattttttattttattttgtttgctttttaaactgttttgttagaaactaagtcacaaacatccacattagcataggcttaggcctaggtcaggatcatcaatatcagtcttccatctccacatcctgtctcactagagggtctacaggggcaatcatacacatagagctatcatctcttgtgataataatgccgccttctggaagcccttctgaaggacatgcctgaagttgttttacagttaactgttattctgtaagtaggagtacactaaaataattactaaaagaatagtaaatacataagccaaataacagtcatttgttaccattatcaattaagtactgtacattatacgtttatacaactagcagaacaggtttgtttacaccagcatcaccacaaatacgtgagtaacatattgcattacaacattctaatggctacaacattactaggcaataggaatttttcagttccataataatctcagggggccaccatcagatatgtagtccatggtggactgaaatgtcattatgcagctcatgactgtaaattatgaattcatattgccacaaattttgtaatttttgctccattttctgaactatgcactatcaaaattattttattttttatatctgaatttggaatactttcatcattggtgaaaattaaatctcatgattggatgtgtttgttagacatgacatcaccttttcaatacaatatctcatatatacttgtcccttctatataactttgggaacctcagataatgtctgattttataaatataaagaacactctcatcagaaacaggagcgatcttgcactcattagtcttacatactaaaaacaattctgtcctagctcaagcaaaaccaagataatttgctccatttgatgcttcttttttcacaggtggaaaaatcacaagtgcacagtcgacccttcactctctctccacatcttcgtcatcagtcaccttgctcttggcattgatgattccttcaacttcctggtgaaaactgctgacttaatttgcttttgtttgctttagcttggtaacagcggtgaatagagtgtagtgtaagtggagaaccaggatcctgagatgagcttgagctttaaaaacttgggactatacatggtgaacttacaggaggttaggggggaaatattacttatccatcaggtttctctttggtttttgtaaacggagaggacagttcttagtccagtaaaaatatgcagattgtatgtaatgaatttttgtaaacaaaggtaatttctgtcaaatgtattctttacttttttaatatgttgggattttattttatatctgatgactccgagtgtgtgccatccatttgttaagtaactggcctttagcagatctgtttcaaaaacaaatacaaaaatgagaatgaaaagtttgcttaagactaagtccagtgtttttcattttccctttggctgaatatttcaattgacaaaccagcaggacatatgaaaaatgcttcagtgatgtggtccattataagataagtacacaaaaattttcttgaaaaatattgtatgattgcatagtgaaatagcaagatttgtcaatatgctattctatatgcacccctagagcaagtcattagggtagggaataagccatttacattagtgcaagatagaaagcgagtccagatgaatttcagtgctatagtttttcataaagtactatgttatctagcagcaaatataataaatatttatttttaataacaaaagatggtttaacatcaccaaaaaatatgatcactaaaaactgcagacatgctggcatgggtgctaacttaaaaatgagatgaatatgggacagagcgtttccatttctttacctactgccaaaacagatgttgaattaggtccaaggttttcttctaattgcaaaattttgcaaaaattttaagggcaatgaaaatttgttgtgcaaataattatgcatagtctgtagattaaaatggttcaagtataacaaataagttttgatttttaaaaacagttccatgcatcacataccactgataaaatcaactagtaaaataaagacagtctttcttggataaattgaatttttaattaagctgtggaaacatggcatcagtacagggattcagctagtctagccagctatgcactgtttgattctgtggcttgggaagtaatccttatttgctatttcaaagagtcatcttgagcctgagagatcctagagagttgttggaaaatgagatgaaaattttctacttgatgatatcttaaagaagttctaacaagcacaagaatgtgccagagttggcatcatacccatgaagatgcgtgaaaggatagttattgcaaagtcatatgccagagaagagcctggagaaactatggttttataggcgatgttaacaagagaacaaaaattggttttataattttatataatttaaacttgttaactgtatttgcttcattaataacaagcaaaatgaaacaatatggagctcaaattgctagctctcaaggttaatccttgtagaatcagagaagtgattgaagtttctgttctgaacatcctgaaagaatagtttcagagccacagtaaaagtctgtatgtaggttacatattctctttggggaaatgatgtaagacaccctaaacaaacaagaaattagttaaaagactcactcaatgatattatagtaaatactacagatggtaagtatttaagcctgtaagtaagtaattatgaccaagtggcctttcttgaacgcctcctttaaagtgggagaggctggactttgcaaaaacagggatgctaattgtttagctggcaaaacatgagctctcccaagtatagtttacctttatgaattgtgcatctgaataaaagacagaaagaatatttttaatgcaaaataattttacgtatttcatgaatcaagccattttcttcattttccatggtggtgtacaccagatttagtgaaggactttaagaatcaacttcttacttacactctcagaaagcaaagcccagtaaaatattaaacaaataaaatggcaaatttaaattaaccaatatttttaattagctgatggatggtacgtatctgacagagtatttacacatatagaatgtctgatgtattcttacaggaatcagagatatggaatgtttttacttaacatacacagaatatgtattttgcatcataaacctatttaaaaaacaggttttcaatgtttatgtacttatgtgctgcatatctgttactttgtagaaaccagaagagcattcttatcaaggtacattatttttcagctacagtactgagttttttctgctatgggatagtaaccacagtcttaaatcactaaagagactgtatttttgtataatgtccattgaatatgaagaaagcaacagtccttataattagaaatttcatgaaagcaaaagttttgcatacccaaatgaaggtactgtggaccccatgtcaaactgttaaatatattgtgtacgatctgtatatatactatatataaggcatataccgtgtggaaggcacagtcaaataatagttctgtgtactgttcttgtaacattagatctttttaataaataattctctttttattgactttta

SEQ ID NO: 2396 - DNA, 621849 bp, Homo sapiens
ttcaatttactttttatttttaacttaaacgactgtgtattttccacagtcttatgatgagaaaggctccagaatcacgtgtaggtgtcctcaacatttcatagctcgaaccgtcctttctttacgttgtgcattgatatgggcttctcagttcagaaaacaaggcactataactattttatcagctacattaatacattgaagatatatttatcctttcatgaaagatacagcatttgaatacaatatggttttatgcagatcaggttcaaaacacccaaggcacacactttattttttttcctttttttttttcttttctgtgtttatttgaaggctcgtattaaaatttcaaaattggcatgaacaaagagttccagagtggaatcaatggacagggattgttgtaattttgaacataaaacggtaaagactgtggaatgtagaacaagttacaggaacgataaacaaaatcaccaatacagcatggattagaaatcaaagtgatgagatctgcggaagtctgagaaacaagtttggaaattctctgattccccacaaagcacgggcagtcctgtctgcatgcagctgctgtggtcacccagccactgtggaatgttcacctacttgcatgggttcatggttgtctacaaatacagaaacacattccagttcgccagttattaaaatgcctccaatttcaagtaaaagaaaaaatcttccaataattttcctagtaaggtaaacgaatatattcatctaggaaaagtggtctggaagaaaccattggaagcaaagtctaggggggtgccaaggtttgggagaaactattggatggtgaagcgggagagcttgagggtgaactacaaaagatatgaggactggaatttttcctgaacgtggaagcatagaggctgctgctcaactggggaatgtgccaaagtagaagaaactttaggaactaaagacaacaagttttcactggtgaggccaaagaagaagttcaacgtttaggtttaaaatatgcttccctaaagcggagggatggcccatgtcttcctggcttagttctttgccaatagacacaaattctctcttgctccaagccttagcatgtggtttgcttgtcaaccagagaggcggcccagttctgccactcccttggccttatggctagaagacaccctgctggggtgtggggagactggaccctaagggaagggtccggatctggctggccctccgcggcaccgctgcttccacccagaacaaaaggaaaagccgagcctcagctccacgcctatagcagcggtcacagaagcagattttgacgttttgcataattctgaaataacatgcacgtatccattgataaattgagaataaggaaatggaaccaaggcagattagctcagtgacaggagcctgtttactcgatgagagagatttttctggtcagttttagagaggcagagctggccacaatgcctgagataatctacattagattgcaagtcgggcagctttttgtttaattcagacagtgttcactgtttgtttgcaatcagaaccacaaccttagtgcaatagtatatttatttttttacagtaattttggttgccatacaagagatttaaggattgggagaaagtgcaaattacaggagcttttttttttttttataaagtctaaaaagaataaaagcacaaaagtaacagcaacatagataatgcgaacacgtgttgttacacaaactatagtgtgaaacatattagtatttaaaaaacaaaaaaaaattgttaatgggaaaatcaatattgtggcccacacacaaaaagtcattgccagatcaactggataatgcttgcttgttcaataactgagaaaaaaatttaccattttattaactaaagtatcacaaataattcactttgtgatatgtaaagttcagcaaatcaacagtcacattgagtaatttttatattatgtgaattaacttaaaatgtgcgcagacaccctggaaaaggtatcttggcaggtatacataatttacattttgagagatttgggttttgtatacacaatattacagaaactaggcatgtaaatgcagtttatttaaattacagtatgtaacaaaagttgatcttaaaacctggaataatatcaacatgatctttagatgagcagtttaacatttgttccaccattaaagaggggcatggaatagggcctcgtcctaacatgtcccaaagggggagaacagtgggtggtgatttgaatgaggaactattgctttcagtaccaaaataagcagatagagatagagaccgattcatcttggcaacatgtgtttatttgttggtcagtgcaggttctgataggtctattacttctctataataagacagtgtaaaaataaactatgttatcagctctttagtcttgcagccagcttgcttgtggttagtggcatgtggcttggagtatctttaagaaagggaataacatctggccctcaccaactggctgccaaagttcaacaaaccgaagtcacgagtttcgactggttatcgtctgccagcggtttccttgactctcctttgagctagtgttttgcctggcactgagcacagaggtaataccaactgtaggcccagggaaagtgccatgccaaaggaatggactcacggaattttgcggtatcatcaaatggaagacaaattaatggccaaaccaccatttttacattttctaaaatatggggcagcctcagcaggccacctgtagtatcctgtcttgaaatttatctagagtaatgctcattcatctcatgatggaaaaactgaaagcacacggaagtaaagcgccttaatattcaattgacttcaagttggattggatcatttcaaatacaaagattgacctgcaaaaggttttggaacagaaggtccaaaaacttggttccaacatcaggggtgtgtgactggaaaagcgcgtgtgtgtggtgtgtgttttgtttttgtttttggagaaactgctgcattatgaattgtaaccactttgaagaaattgtccttcaatgacgaagttctagcaaagatagaaaatataacacagctctgctggttcagatgcatccaaataaggttgatttaaaaaggtcatacttttataattattccacagaaatagtattattaaatcacaaaagtttttttttctttaactttctagcactgaagtggcacaaaggctgcctagtagaccagccacttttttttcttaaaatattgtgcttataaactatctgtacaactatttaaacttgcagtaaagaaagattttaaattgctaaattttatgtgttcattctagagctgttccagacctaatcaagaaaaaaaggaaaaaaaaaaaacaaaaccatgttttataattagagatgggctgagctagttctgaaataataataaaaccaaaaacctgacattcgagtatcctccaaatgggggagaatgtgctggaagcctgactgtgtgttttgcggcccatgtgcatctggtgacctcttttggaaattcgaggtattgttatggggtggagggactccggggaaagaaaggggcggggctcaagaaagccttgccagagaggctgacctggcagcccaggagacctccctgctttcctctcctcacgcctctgctttcactctgatcctgccgcccaccttctgttctcaaccctgggttctgtctatactccatacccactgggtcctcaaagaagctgttgtactgttaagacaagctggtgggattcctagacacccagagcgataggggaaaagcctctaagtaccatcttccctggcctccgagagcaaaaggactgtctcagcagagatgctcacccttggctgggcacagaactgaggatgctgtgcccgcccagctcccagaggagacgctgtctcactggcagccgcatgtgcccgccatgagccatgcgtcttcttgtccttcatgtcaaagtggatgctcacctgctctgatctttgcagagctcaagacatcttcaattaaaaagaattctgagaggcagagaagcccttattctccatcctggatgggtgctcatggcagacaactgctcttgtcctggagacctggagcttgggcagttgcacgctggctggctcccttggccaggtctcccctccattgtggaatcgtgactttgtgctttgactaactccatgtgacatctgcttggccaccttggaattatgctaacagatttgcagaaataaagaaagctaagcaaagctgggcacgatcccatccaaactcccagcactgccaggaacctcatggccaaagagccatggatgcaaaccacaggaggagatggggaaaagaatctgtgtaggaaaaagtttctctgcctttcaggcccatgatggggcactggacaaatgcatctgggagcatctcactgcaagccaagtgcaggagaaagaggggcaggtgagcatcaggtgtcctctgagaggccacaggactgaggaaaggcctcatgccggggcctggggtggtgagagctgcccggaaagcagaggacggaggtctcaggaggtatctagagtgcactggtgtctgcctacaagagctaggatcccgtgcaaaattgacggggagcctctcggacccggcaaagcgaggccacctgcatgctgggcggcaggctgagaatctttttccatgttagaaaaactccctccccttgtcccatgtgtgatagaaactgcccaagacacccacatggtgagccaggggtctgaagacccagccatgttgtggacacaactcagtatttctttgggtaccaggagacaaacccatggagtggggttgatgctcacagacttcgcttggcattcagatgtttcagcacgagcccatctctacttataacaagagcagtctgcgaggtggagagcagccgtccttatctgtccagcagctgtttcaaagccctttctatgttcattctgtgcccgactcgagttaccccaagatcgatgaggtcctccttctgcaggtttggtaagtgactgccatcgatctcattgtccatgaaggcctctttatgttcacccaagtttagactttccagccaatcggccacatctggtttagtccacaggtggacaggtttagttgtaaaaggcttatttgagattggctgttgcagtatcgagggggatggcgacctactgcgtcccgctgggttcaagccaaatagatccccagaagggggctggcttggaaggctaaagacatctgagagagcgggagaaggagaggcggtggcagcagacaggggggcgggcagggtctctttgttcatctctgttggcgagaccacagggcttggggcacgtcttgttcctgaggtcctgctttcatagtcggggggccggctctgcagggtgatgggctgggaggtgccggggcgaacagtgaaggtgaccgtcgtgctccgtgtacctgagatggtgctcatgatctccgggcttctgaaacagcaacacagagaaaaccatcacaaggcaggtcaccgagtcagggcagctggctgcagatcacccaggaaggcgagggagacgcccaaaccatgccagagtgtctagtggcagatccactggcagtgaacgaatgatttgccatgccagggtgggggagggggagaaaggggccagagcaaagttggagacaccagagcacaccacgtcagcccactcacctgaactgggacagaggggctgggggacctgcctgtgctggggggagcacaccacgtcagcccactcacctgaactgggacagaggggctgggggacctgcctgtgctggggggcagggccgggggaccctcgggagggtggccactgaggcatttggaaggggtcccttgaagagggcacggagacagggacagagtggggtcctgtcacctgggtagaacgtgccaggcaacatctccagcgcctcagcttcagcaggtgggaaggagcacacctggaggacaggcccctcagccgcctggcagccttaggctttttgggtaaatggacaagagcagggcaggatccttcccaggtggcccctttcagtaactggaacccctgtagctacgcagggcactcaggggttgagatcacccggaaacccagacagcagggcgtggcttgtgtggccagtgtgggctgcgctcaccttcctgaggcagcactgtccagcgcccacccagtggacagttttgttgcagaaggagctggggtaccctgtgttatttttagcccctttcatgtgagaggctcactggtaggacacacgggccttactgaaaagcagaacgcgtgaggagccctgtcttccccagggtggccatgggcgtccccgagggtcccctgtgccttgccgctctggctgggcaggcaaagccctcagagctcaagtcagggaggacgacccttctagctccaacctttactggccccagggtggtggccagatgactcccacaggcaggaggtcccatctcagtgccagagaagtccaagtcctcacgcttacccacgtggaggtggcctttcacacaccactccctcacgggctctggccaaggcctgtggcaggcactctccacaccaagagaactgccactctgggccctagtgcatgttttgctgtccccacactgaaagcccattcatcctattgtccctaggaaagccacagccactggggaggggaggagaggtgtgggtctcttgccttttgggcccattcacgtggatatgaacggcccacccaccgcttctgaaaagatccatcctaccacggctctctcttcaagacctggacttgagagatgtctgctggagccctggctctgtcagatgccagcttgggtgcacttttctcctgtctccacatcttcccacatgaagtgggctcctctccctcctatgtggtgggttaccctgggtggaggggctctggagagcatgaggagtgcactggtgtgacatcgtgaccgtgaatggtggtgggctgcagtgtctcagtgaaagggtcatgggcaagagggggagagctgcaaacagtagagatgctgccgtgtggggagactccctggagggcaagactgaagcccctgcccgtctgctgggggccagttcatcgacttgcactggggctgtctttggagctcaatggctgaccagttagagcagcacttcccaaagaggagcccacagacccttcatagaaaccacctgggacactggtgggccgtgaggactcctgagctcgtctcaaacctgtggaagcaggagtgctgtgcatggggaccaggtgtctgcaattaacaaactccccagacactgagagaccctgaaccttagaggccatttggttgggccttggttttcattccagggtatgcacaaagctaatggcccagaaccctccaggagctaaaagcaaagggagtgacctggagacgggccccgctgctggtctagtctgtctctctccgtttttttcttttctctttctttaccatggatgtatatttgggtgaaaccacccatcagttacctaggttcccctaagctgtgggtcagtttcctacttgatgttagtcactgttgcttaaagtgtggactagtccatagtgagaaaggaggggcaaatctgaaaggggcctgtgctgtggactgaggcttcaatcctactgtgagaagtgtttgcaggggctggtgggtgcactgctgggccagggaccccatccacccatagggtgttcacgtgctattttccagagggctgggtgcccctgagtgggagatgttacaaaccaggcatccccatctagaacctgcccccaccctcaatggtggcttgctggtcattggttatactgctcacaccaacaggcacaaggcaggtgagactctgaggattcctccactgtttctgggcccagttactcacaatcaagaaatcagaggctgcacacggtggctcacgcctgtaatcccagcactttgggaggcctaggtgggtgaatcatttgaggtcaggggttcgagaccagcctggtcaatatggtgaaaccccatctctactaaaaattaaaaaaaaaaaaattagctgagtgtggtggtgggcgcctgtaatcccagctactgggaggctgaggcaggagaattgcttgaacccaggaggcggaggttgcagtgagctgagatcgtgccactgcactccagcctgggcgactgagctagacttcttctcaaaaacaacaacaacaacaataaaaaaacccccaaaaaacccgaaatcaaatcagagcccagtggggcttcacagcaggggagaggggccagcaccctctagtatctcagtttatactctcaagagagaggtggcctatggacataggatacacgaaaaaacctgcaacccccccttctctggtactcaaagaaggtcgaaagaccagctccagttccaacttaaaactgggggtgctgtggcctgttcttctgtgtttattccagagtcacaagagcacagttttggggaaggcttatttgtccacgttgataaaacaattaagccaagatgattgaaatcaaataatgggtaagttgaaagccactgcattcagaggtgatttggggtgttaattagggccaaggaccttggggcacagggaatgtttcctataaaatgggaaaacatcttacaagaagacatatgcccacagaggactagaggaggaggggtagctggggtaaagttctggtctccatgtgcttttgctaaagctgactacatggtgactgtgcctgcagccctgactctgggcagctccaccgtggcagcatgactggtgcctggccttggtgctcaccaggcctgtgaagcagaggcaagtaaagccccagagtgagagcacctacctcacgcctgggcagtattcaccacgggtatctctggcccagagggttgccccagtgctgccctcactgggaaaatacccagctgttcccaggtagttgggattgattttggtttttgtaaggaaaggctctgcaggcagctgtgtgtgtggttaggaagcgaagaggaggctctgcaaacacctcggtgggcagcgggagcgcgagagtggcacacacggggtcacgcagcagcacagcaggtggcacttacttctgttcagcacgaccctcttctgttaacaccggtcatgggagcaaatgaaaatgacaaatggaatgacttgagacaacactgcaaaaattaatgaacaagaaaggaagaaacagaaaaaagctgcttttcgacagatgaaatgaaggcagtggggcagaccctggctgaaagcccatccgtggtggtcccttcggcctgccacagcctgcccagagctgaaacatcaatatggcatcactttcatagggagcgtgggaaactcacaagcttgtcttctccttctttggcttgggataatgtaaccacttgtaaagaagaaaaataaccaggaaaaaagaaagaaaatagtagcattggagtgaagttcgcctctgcctgaagcccactgagaagcagcttattgccaatttcctacctcaggtgcctgaactgtctttcctgtggcttagggaggataaacgaacattcctggtgggggagggcaccccaacaggacaagtgctttgcttcaagtctacatcatgagatgacagcccagccgttaatcacatgggcgtcaagtgcttggggcctgccagtgtcctgccccacattgctatagaaagtaaccgcctgtgagtgtgagacgcagggtgaaggccaccctgggctgcccgccctgccctcctcagcagcttgactctcttggttaatcacattgatgatattcactggatcttcccggttgcacagatggttacgttgctaagcaaccgctgggttcccagtcggaacacacaggaatctgctgccctgatttagaacacagacacatatacacactcacacccaactccccaccaggtcaccactgtctaccctgccttttaaatcacattcatgtagaaatgtgagaattaaaaaaaatcaaggtaattgagacactcagagaggtgctcttatttcatcagtcagtacaagttaattggggtgaggtaagtaaagaagcaagtggcttttttactgtttacaaattcaatttggcttttttttttttggagacggggtcatgcagcaatcatagctcactgcagcctcaacctcctcaagtgatcctcctgcatcagcctctggcatagctagagtaatctgctctttaactgtagctgaacatgggccaggggctggtcagtgatgctgattaggcatgctggttctgtccctcccatgagccgcctgtcaagggcctgctgggcctggccagcactgaggctggacttggagcctgtcaacatatgttctctccagcacaccgcacgcctctgcattttagtgatgagcccccatcttgcatgaaaatagcacttatttccaaactgctttcttattttttccatctttacagcctcctgataagcagggcattgaaaagatagaaccggaggcagcaagtccttacctagcttccccgaggcctggatgtggggactggagcccatattgcccagctgtgccatgtgttatgttgtgtctcagcagctgccaggcctccgcctcacccccagctctgagtgccatgagggggtcctggtctagttttagtccttgaggtctggcccagaacaggggtgcgataaataattgttgactgaagtgttgatggataatatatccttttcccagatcagaaagttaagtgacttgaccgagttacagagccagacctgggagtggggcaggcagcctgaggctccgcggcagttccaccaggaatccaggtcttcaggccaggaggttcgcagctaagatcaagaaggtgcccacctcttgggaagagagattaaccctgtgatatgcttttgccaaaagggcctcatgtccaaaatggggaggaagattctgacttgagatttgcctgttgatgggcaaggacgaggcactcccattcatccttgcccaacgcccgcaagtaccagccccgatggacgcacatcctgactagtgctcccagccacccacagtcgcattcactgatgtcacattcacttttccatcagggcctggaaaccctcaaaccacctagtggtcctgagatgctgaaaacaccgtgaggcagcttctagtaccaagtcagttttgaagcagtctgtgctctgggaccagctgggcagagataactttttaacaacccaaagttatttgaaaatcaagaggctgtcaggataatactgcagagagcccagtagggactggaggccttgggaaggggaggcaggtaccgtgaggcagcaggcgcaggggcctcgggaggaaaactcgcctgagctcacatcccaggtagcctgaactccctcaggggcctctgggacctggagtttcacaggacaaatctccctgaagcccatccatcccatggggaagcgaaggccaatctcgaggtcccttctggaccccacccactgcaaagggctggcgacctagaggggactctggggaactcttataggccatgcaccctaacagaagccatgggggacccccacaagcacacactcactgctctgttgcccccacatacagagcaaatgtgaagctgacctctgccatggaagcgatggtaaagaacatcagatttatctggctttactatcggcgcctggtatgtgtcagtatctctcaataaagctggagggcacatgacacctggggctcctgggtcatagcaagtttgttttgggtcaaagcatataagtcaggcaagctgctgtgttctcctgggttccttaggcacttagcccttgagtctccctgcttgtctccagaatgcaggccctacactcccacagcagcctccctgtgccaccagtgcattcacctgatcacacagctgcctgggccatcttcaggaaacaaagtctggtcatgccaagactttgctgaagccctctgaaggcagccatatctggaactccattcagctcatgcccattacctgcaagcctcttgtgacctggccctgcccagccctcctcatctggccatggtttcatgagcacagaaggcactttctggcctcagggccttgtactctctgtcccgtgcctgggatgctccactcctggttttctgcaaggttggctcctttttaaatttctggtcattcaaatgtcatttccttgcagagtgtcagtccctttctgcacatgctcactgtaacctgctagggcatcctagtccgccctttctgcatgtggtcagggttaacctgctggtgtcccgtggctctcttctgcacgtggttatttttacctgctggtgcatcacagcccctttctgcactggtcactaacctattagcatgttgtggctcctttgtggcatttgtcacagtttgggtttgtcttattatttgttgtccatttctcccctcgagaatttgagctccccaaagggaggggcatctggaatgttttcttgttcagtgataaatcctgggcacagcatggcacctggcacataaaggcaatccctaactttgttgagtgaatgattagtgacggaattgctgccccattctgagggtccaggcatccttgttggtgtattcctcgttactctctagcctcagcctggcactaggcttatagaaagtagctcagtgaactcctgactggtgaattcaggagacagtggggctgggccatgattccaagtctgagtgtccagtcagtctcctaggcctgcacctgaggagcttccggctctgagcttttgcagccccaggctcctgtgctgggacccccagcgtgcagcactgtcaggcctctgggctggcagctgttgtcttggcattctgctgaggagggaccactgactcttcacagagacacactcactcttccttccccaaaccagtttccttcactttgatccagtttgagatcaaagatgagactacctcctggaataatcaggccaggtggtcctggaacacttttcttagaactgacgcctccattcttggcagggtgttttcagatcaccctgggagatgcctctaatatgatgtacttttttctcttttaacattatgtactaaagagaactacttcatcatcttcctttcgtcggcgtatttgtaattaagacgcctgcaaattccatgtcatccttgatttcagggaagagctttgagcatcagagactcattcacggctaaagttaaatcaaacatacccaaggaaaacaaggatctagttgtttaatcttcagctgcttcctttgatcccatcctggattcttgcaagaagtgaaaagaaaggaagaatccaaggatgagaggaactttaaaagggtcaagttcagctgaggtttctgcccatttcatgaatgaacatttgaggaacagctctaaaaattgtccctttcttgggcagtcaaaacttgtttctatggaaatgggatttttacaccactgcttatctgtcatttcaaaaagcatggctggttttcaattttccctagaaaaactcatttctttttcctcggtaggaattcccttcatccaatttcgtgcctcattttgcccagggccattcacagctcttaatttttagatgcatttaaaggtggtggtgagtcgcccaggcggtgaactcaggtgagagttcttaaggctccctctgatcctcagatgatcaaatgcccagggcccatcagtgaagaccacgcccagcaaaggagacatgctgagagataggtctgtggctgagaggagacagccctcacggcaagggggacagctctggtgccctggcaactccgtcctggacccccccccagtggtggttctgactgccccccacttgtccttgtcagtgtgtcccgtggccgtggcgcacctccatgggggctttgtcccaagtgctcagcctggtgaggttattagatccgagaagcaagggcgagggagaggattgagcctagtttagtgcctacagtgaatgctcttcatctttgtcctctggcctcaggccatcctgtttctagtccaactctgagtgtaaagtgtaacccttggccgggagcaagaagggaacagacatggcctctgggagcttggcagtgccagtgaacccctagtgactaagcctgctgttatcggccgcagggtgacctcctagtgactaagcctgctattagcctcttgctgaccaaagagcttggcctaaggacagtcagaggcctgagagcagccccgcccgcggcagtctcagccttgcaggtgttcggtttgccagttggtcattccttccaaggcagtccctggctcccacaaggtgaggagtcaaaccctgagccagctccatgggttggaggtctagttccgcgtcttcctgtgaagtagcctcggctcagtagcttcaccgccctgccttctgcttccttgttcacacagtgggaaaaattacaggccctggctcaggggtgccgtggaatgtagtgcctggcgtttggtgaatgctttgtgtcataggtgtgggctcctgttcttactgtaagagagccgggctataaataacaggacagctgggaggcggccgttcttggcactcacgcgtgggtcggcggtggtatgcagctgctctccttcagagtacagcaggattctgccctatgaagtctgctttgagccagccccctctcagggtccccctggagaaatgcagggcagagaaaccctagagacgctgcaagttggggtcccactcccctgtgggcaccccaggagctggcccagcctgaagacgagtagaggggatgagctgtccagctgccactcagggagaggtctccatggacggggtccctggactccccgagtggagtgctcaggggagcacagcttggtgcaggatgccctgctgacctgaacagtggattccttcctccagccctagagccattcccttccagctccttccttactgcagacattgcttacaaggggaagtgagagtcaggaaaccccagcctgtgtcccagctctgcctcctgctggctgtgtatgtggacaagccacttatcctctgaaaaatgggtgtgactcatacctgctccccagttgtcataaaaattacccacccatgagaaagtgttttgtaaaaatgtgaaacactaagataaggcctctttaattattgcttccacatagagtaatgacggaagagccacattagtatgtaatggggaagggttaaactagtcagtttttcagatttttggcccagtgcagtgactcatgcctgcaatcccagcactttgggaggctgaggtgagtggttcgtttgagcccaggagttcgagaccagcctgggacacatggtgagacctcatctctaccaaaaaaaaaaaaaaaaaaaaaaaaaatagctgggtgtggtggcatgcgtctattgtcctagctactcaggaggctaggtgaggtgtgaggattgcttaagcccaggaggtctaggctgcaaggctgcaatgagccgtgatcacgtcacagcactccagcctgagcggcaaagcaacaccctttctcaaaattcctggaggctgttgagtgtacttgtaggtgtatacgtacataattcttagactttctccttgactggaggcactgtctgaatgtctgcagtgtaactgtgcttctctataccaatgccagcctatcgatactcctttagagtaatagatgacatccaagtcatttatttacatccacactgaaaaataactgggaaaattggggctctcagtctgcatcttgagccccagctgtatgtgatgtcactgattaatgcactgagtggcttaaatcaaatgcctgcccagcaggggtatggagagaggcttcattagtcaaaatgatgaaacccaagatcaaatatcagtgggagagactgaagatgctgccacctggggaacagcaaaatggtgcacaccacagggaaggagaaccaagaaccataagccatcacgggagccaatggggctccccaaagccacagactgctgagccctgatacggtttggatctgtgttcccacccaaatctcatatgtgaaattgtagtctccagtgttggaggaggtgcctggtgggaggtgatcagatcatggtgggggagttctcatgaacggtttagcaccatcttccctggctactgtacatagtgagctctcatgagatcaggttgtttaaatagactgtggtacctcccccgactccctcttgctccccctttggtgatcactgaaagtttcttgaggcttctccagaagccaagcagaagccaacatcatgcttcccatatagcctgcagaactcgagccaattaaacctcatttttttataaattacccagtctcagctatttctttatagcagtgcaagaatgatcaaatataggctccttccagacagcctcagatagagccctctggttgcgtctagaaatgactcctgacttattctacgttcagttccaatggaaataatgtaaaccctgcacaatactgtgaagggctgacatggacacagctagaggcttctgcccctgggacaggatgggctggcagggaagaatgtactgcacttagagttcaccagtacagccatgaccctgtgcctcccaagcccgcaaacctggtagtgatgggaggggaagaagaacccacacgtgtattcagacacctgcacccaccgcccacccactcgctgccctcttggggcagctagtctcctgcaaccaactcgaagcttggtttgggctttggcgaggctctaaacggccttctaggtggtcctggcagagatctggagggcacagaagagagagtagagcttctctttggaagccaaggtgaggagggcttccagcaacctcatttcattacaagtctttatgaaggagtgctgtgtcccaccaggatggctgtgatcattactcggctatcccggagtccaggagcatgagaaaaagaagtgttactgcattaacagacgtggcccacacaggctttacgaattcccctcttcgtgtccgctggggctgctacccgagggcctttcctggtcagcagggacagtgcacgcagagcggtgtgcatgtgcaccaaccgcggacttaccttggagcgaggctggcggacttggctcccattggtgaatccagtccttcccccggctttgccaatttctctcggttcatttgctgtaggatagagttcaattcactaataacgtttgcctttgggcctgagagaatcgggcttttgatctctgtgacgtcgccccacaacttggaggtccttggctggagaaccttggccatcccaggctgggcactgcccggcgggggcgggggagcgggcggggggataacaaagctatctacatcttcttccacgagcgcgtcttgataaagtgcattgcttttgtgaatgatgggcttcatttttggcttaggaggtactgggggtttgtcaaccataaatgcttgcccatctgcatagactgtgcaggtgtccacattctctccaccttcggaagacagggtggagatgctagacacggtggagatagtgctggtcgtctcgaggtggtggtcgctgctactccggctgtccacctcctcgatcccagagtcggcgacggcgtcaaagctttcagggggtggcaggaatgaggcaggcagacagtttgaaagactggctggcttcttgctgtctgcagagttggttggttggctggagttcaacgaaggggactgaggggtgtcgcttttcttctgcttcactaagtctgagagagccgggacagaagctgcccggtcatcggggatatcaaaactatttgcaaattccaggggaggaggcaatggctctgtaaaaataaaatcctcatccaagtccacggatgccagagggggaggagggatgcggaatggcaaaatcaccgcctcttccatggagcccaccgcgacgatggttctgccgggcacggtggtgggctcgggggcagcggagatctgtaaagcaccttcggtttcggaaacaccttctggcacctcggacggcgagctgtctggcttcatctccacctctgccttctcgtcctcttcctgcagggcgttgtccagcttagtggcgtccacggtgtgcaccatcagcaggccagccgacttctgctgggacgtgtccatgatgtcgatcagcatgttcttcttgtcatcgcctttccggtctcggcccaggtcggtctcgtacttgttctccgtctcctgccgcctcaggggtccccgggtgttctgcctggtgaccgtagggaagccggcatccaggctgggccgcattttggtatcaatgtaaagaggtttgttgaggtcggccttgggggcctcccctttgggtccctgttgagactccttcatggctcggtcccttgcggagagtgccagggccagcggggagctgggatcaagcagccgccctgtgagtgggtggacataattcccggggccggctgtgccgctgctcgcggagggcactgctgggctgctctcgggcccctgggctttggacgtggaattcagcggcctcccagcctcacccggagcactggcctcggcgccacccacgaaatggttttcgggctccctgggcgtggcactcggcatgggggatgacagctgctcagcgctgtcctcgtcagcaaaatccccctcctcggggaacatggagggccgcgtcctgggggcgggtggccccaggcccacatcctcatcccccaggtctgtggagaggaaggccggggagttcctcctggcttccagccgcttctcacggtcgcggacggctccggcgatggcggcggcaaaggggctgctgacggtcaggctttcgtcaggccgcagctggctcggtggctccggggcctgggggtcgatctccatgctgctgccctggctgctcttgccgctgctgctggtggacggctccttcacgatgatggtcgggatagggatggagcacgtcttctcggggctgtcctccacgttggactgcttcaccagcatccccttccgcctggcgggcttggcggggacgtagacggctttgctggcgatcttccccacctctgagtatgggttttctggcatctggcctctcttgttgcggaagttggcttgcgggccggcattccgactgtagaggtcttcagagtccaaggagtagcggtccagctctctcctgaagtacatccccttctccctcatcatggtggccacggtgtcggacctggtggcgggggacaccttggcggcagaattctgattgaacgcaggcttaatcgtcccgtagactcttggagttggggacttggggcagttgtaagtggttggggaaggtggtggtggggacgggggcacagactgcggtggaggggggatgtcctcagaggtgtccggcatggacaggcttctggtgaacttcagcattggaggagccagaaactgccgctcttcctctgttattcctacaagcagaaaacaggtttagctttaagtcacaatagcaacaaagcctaagttcctaggaacgtgcgatacgctacatctccacaaactcacaaattcagatgatgaaccggatgttcaggaaacacagcacaagccacgatgccgagtggttagtcacatggcccgtcgtgagccaaaggacaagaaagggaagaacagaaaggcactggggatgctgtgagtacgctgctgctgtggggcctccaggcacaggctgcagcaggggagctgtgtgaggccagggcaggagggcccctgacgctgagccgtgtgccagtctgcaggccaagtgggcagctcgccttggggctgcttgtgcgtgtgtgtgtgcgcttacgtgtgcttgtgctggcattgtggcattgtgcttggggcggggttggctagaccaggaggtatccttccaccatgccccttcaggcatggtaagggctcctgggggtgtttttagggcaggggtctaaggctgtcacctgtgcatctgaaatgagagcaaagggttgcaggtattgctgtgtttatgtggcaaggatggtgtgcagtccaccgtccagatggcacttgagccccacggctgcccagatgtacagggaggcctctgccaccctgagcgaagccatctgcccacggttggctctgtgcgtgctgggaggaggtgcttttcttccagggtcatgtgaatcctttcattgcctgacttcactgggccccactaagggttctatgtgtcctcgagctctctggaccttcagagagatggatggctggggaattgcagctcagaggaggggccatgtgggctctagagcctgcccctgaggggagggagcccaggttcctttaaagtcctggactgagccaggaataggatcctgagccaggcctcagtgagccccttctgggtcccagcggcagccctgaaagtggtcctgccaagaccctttggagcaggggctgagagcccagtggaccaccataatcgcaactaaccagggtccaagtgtggctgacctggcacaaagtatgagttgacctaatgaaaatatgtggatgttgaatgtgtggggatgcagctgaggtcctacgacagccagcagggtggcctgagggttctctgggtgtgttgcctaggtgtgactttacagactgttcaacagctgaagacacagacacgtcaacaggagcacttggagaagggaagcgagacacgcacacacaccgacagacgcgtggcacagggatttcatgttgggagcatgcaggttttcaaagaggtagcaaaataaattacttgaaatgaaaaaaagtcctaggacaaactacaataatttattccaatgaaaacttccattcgataagggtattccaaatttaacatactccttgtgggaggacattttggcattgcaaagatggctcgttcaaagtgttctccattgaccagtcactctgagttggctgtctggcaattctgttcccaaggagtactaatttaagaatacaccttataaagtaaactgggttacattcagattacagattccaaaccgtaaggttcactaacctgatagaaagattctgctgtctgacaggaggaaatcagttgttattaaccagtaaccgcaagacaaatacgcagctttccctgagtttgctggtgcagggggagctttaagcacagcagacaccacctccacggccacttactgcctagtgactgcctacagttatccacctgagactcacaagcacgctgcgcttttgcacagcagcccagaggcatttccagaacacacaggacagtgcccctggggtgggctgggcagaccagagtcccagggttgcctccacaactctcacagggcaagggccttagcttctaccagaattgacacagtaaaggcaatgctgaattatctcacaaagggactgtctcaaagggtcaagtgtgaccttgtctcaaggtcaagtgtacctttgcctgcaacagggtcaataggaataattgtgacattaagaagaaaggaaggcagttttctgcaacacacagtacattatttcatttcgagacctgacccaaccacccttggaagtacatctgctgagctcatactccaggcctggtggtggctggggaatgcagggaacccacttacccttcccaccctgagcagggcagggtgggggaggggggttggctcgcaccaccccgcccaccctcccgctttaccctgctggaattatcacagataactgggcttcaagatgacagaagccaccctagattttgtgtccttcaggggggatgagtttcatgccactcagatgttccaatggctccctagtgggcaaggccaggttcccaccctctggtgggtgggctggcagggccttgctggggtgggacgccaaggcaactgtgagaggcccagggctcagaattcctgaggggcctaaggctgtgtttgaaagcccaggggcaacttctgtgggggagtgccacacttcttacctattgatttctgccttcgcatcgtacctcgagggatgcccagaaacggggcttttgggctcccaggaacagtgggcgtcatcacggcgattccttggcgttcgtacacagactgcaaaccagagagcctagggtgagacgcagccctggccagcccccacccacggtcacagggcccagagaccacaagggaacttccgtcactgtggcttccccaagctgcttctggagccacctaaagtctccagtggggctgatgagaaccacagcattgaggacccaggaaggtccctctctaggtgcctttcctattcgctgcagctgctattggcctttggccctgttaggatggcagcatgccctgttccatggagatgtggtctgctgcaacaccatttgccagagcagctggacagatacgtctctctgagaggggggccaggctggatgtcctgtgggaaagggcacagcgtggtgggcagtggggtctggcctgggtccataccccactccccatgtgccatgtgaccatcaagtccttacataggagccaccatctcctctttcataaaatgggctcctgacaccagccccacagtgtgtgcaaaggccaaccaggtattgtggtggtgtgtgggtgagcatgatgtgccagctagcttaagcaagccctggagctgctcaggggcacagcctggagtctgcagcagtgagctgtccccagcttcctccctcttcagcctgtcccaggaggagcctagagctcccctcctcccctccaccttggaagcagagtcctggtgctgccaactctttcgcttccccaggctgttgttttgtctgcaaaactgagatggctcagggccccaaacctgtagtgttgaaggccaacccgggaaaatatcagatgcggacgctcaatggaaatattcgtgtgcaagcttttattgctccagctttgagatgcagtttccatgtgtccacagcctctgtttgtctcactctatggccctgaggctgaggagcaaagtgggaccctttgggagatcaagggcaccttgtctcagacacccccccaacttggtggggcatgtgggtgccacgaaggactgggaacaaagtgggaggcaaggaccggcaggcagggcctggaggggaagtccccttgtggagttcagaggtgatgggaggaggtgtgagggcagatattgtaactgtaattattaacagttgtttaatgcacattacagaaaagccttgtggtaaatttataatatttataggtgttattgttcaagaaaaagctagacataggcagtttgatactggttcaaagagaatactaaggtaagcaatcaggacaggtaggcagtgctagaatctgacatcaggttcagatggctgcctctgcacaatggagaagcaatccaagggtccaggaggccacgccttgttcaggacgtgcctgggggaatcagcagcctctgccccaggcccttttccagctgtgtgccctcctgactgcctagggaaggtgaccatggcacgggcagcctgctctgagccaggcacccactgcgcccagcagccactgaagcccttcatggcacttctggctccgaggacaagtgttgcccaggatctcggagagtgtgggggactgccacatgggatgtgggacagacggcctcttccacaccggagcatttctgtgctctgggtggaccaggaggcaagagcccctctgtctgaagagtgtgtcaaggccccttacttccatgtgctcacgggtcctcagccaagtatgacaggacaccttcgaggctcagggcactgagtgagcggtaagggcagggcttggatgcagcctgctctgtcccaccactgtgagtctgcacagacccggctctttgtcctgtggccacttagatttgggccccacctctggacagcacgaaccagacatgaaagcgtgtgcacctcagctactgagacagcccacccacttcctgggcaccgtcggcccccgccctcgtggtcccaaggtacggccactcacgttcatgtctgagcccgccgggaagcaccggctgctgggccgctgcttgatggtcgccaccctcggttccacagccatgttctcagcagcgcgggagggcttggaggccgggactatctcctcgggtttatctgcaatagaaccgtgaggattggagcagcaacaccagtgggggaagctgggtgtagataggaaagcgcacaggtgcagcagccactccaacatccaaaactgtgcagggggcatttgttgctgctgtgaggagcatgcgtgtgcctctgccacatgcattcccactggggcatgggctccttcccaggaccttgccctcggaggcatgcacgaggcatggacatagaagaccctccacagctcggccaccttcttaagtgcccagcccccaagggctctgaagctttttgggacatttctgttttttgggacatttctgtgttttttttttttttttttttttttttgagacagtctcttgctctgttgcccaggctggagtgcagtggtgcaatcttggctcactgcaacctccgcctcccaggtttaagcaattctcttgcgtcagcctcaagagtagctgggattacaggcacctgccactacgcccagctaatttttgtatttttagtagagacggagtttcaccatgttggccaggctgatcttgaactcctggcctcaagtgatccaccggccttggcctcccaaagtgctgggattacagccatttgggccatttctttagtggaatcacttgattctttctaatgggatttattcttgtgagggttaactaaactgactttttgaagtttttttttttgtttgtttttgtttttttttttgaagagactcagacatatggttcctttgtaactgtgattgccaagacatgaggatctgccacccaaggcagcgtgggtgtttcagaggccagggtgctcgtggccccaggcgttagtaagtgttgcagagggaaggtctctgtttattttccccaatgcagaaccttcccatttcctttaaaaaaaaaaaaaaaaaagaaaaccaaagtttagttataagggatccttagcaattaacaaaagttttttaaagaggacatttgcagcacatttttttttttttttttacttgaaaactgaagcacatcccagagctctcctgacgccttagcttcatctcagggtgtttgggatcaggcataagggtgtgtctaaggctgtttaaatgcaagggccctgtgccactgagacctggagagctggtcttccagtcgcgatgtgcattctggaaaaggtgaccccagctgtacttctaagatgtcactgggttgggacaaagccagtgtggtatctggtgggtgtaccccattctgagcctttgagacagcactggccttactccctggggagaagcaggccatctggaacattctgccttctggccaccctaagcccactcttggggtctggtggctcccatgaagtgtatgctagggccttgcccagactttgagccatgaggctattgtgcaagttagagctgagcagagtgcagggaggaaggcccccatctccaaattgttcttcaagctgaggcggaagttacctgtcatggcagcttctcacggggagctgacccacgggcaaagctcccagagccacggcacggatcagggttgtccaacacaaaggcatcaggctcctgacaaaggcagcccagaccagaggtccccacaagaggaagtttggggagaggaaatgggggtgtgctggggacactgagccaggcgccctgtgatggcccctcaaccttgcagagcagctgagacgtacacaactctgacacctatggacactctcacagtagagtctgcatgaggggcctggttccaggcctgtgttccagacccttgggccagtcctgcccccaccgggccagaacctcagggcagtctatacttttttttcttttctttaagatggactctcactgtcacctgggctgcttggctcactgcaacctccacctcctgggttcaagcaattctcgtgcctcagcctcctgagtagctgggattacaggcgagcaccaccatgcccggctaatttttgtatttttagtagagacggggtttcaccatgttggccaggctggtctcagactcctgacctcaagtgatgtgcccgccttggcctcccaaagtgctgggattacaggtgtgagccaccacacccagccatacacttttagtcttcaaacaaggatggggaagaaaaggcaggagaatgtgcagcagaggccatatggctgtcacgcccagcacacttaccatggggcccttcagggaggtgtttgccgacccctggcctggaccacgtttccagttgtcagcaaaatgccaagtgttcacgcaaagcaagaaagcccttgccccatagtgtccgggcagccaaatctccccccacagcactctctcccttcatgaccaagtccagctgaccaggcctgcaggctcactgggccccaattctgcgtccctgctcatgcattctctcctgttattcctggacccacaagccctgctggctcttcgatgagcctgatgcctccttggggaccttgtcattcccccagtggatgctaagcatctgcttctcagggaactggtcaggcacggtaggaaacacccgattctcatctcacttggcagtggggacatcctggctgtgacctgtgaccccagtccagagccgtgctgtcctcacctgcgttcaaggccctcatcccagctcctccggctgcagcaggtgctgcatggctgcctcatctcacattccctttgctggggtccctgtcaacctccctgggctgcacgggctgggtccacctgccatggtcccagcaatttgcttcctccaaggagcctttcccctcccagggctgggctgggactccttggatggctggggtcgaattggtttctgtgccggcctctgttccctggcctcgccgatcagctgggcttctcccccttgacttgggaccaggtgatgcttgggtgatctcctctggccggctgtgatgtgcaactccagcttggtctatccctggaaatgggggcgctaggcagtggctgttctttgcctcaagtgagatgtggccgctggtggcccccagagtatttttctccaatgaaacgggggttgagatgtgtctcctgcaccagggagttatgtcccatagctgtggtgagccagggcactgcggggtggggataccctgggacctgcttcctgacagtgctggcccgggcccctcctctgaccccagtggagcgtgaggcctgagcggggtgcagcagcatgtacctccatgaacatgacccagaagggatgccaccaagttaggggaagagcagctggagcccaacaaaacatcccacgggggcattccaggtggcgagctctgggggcagccgcagaatccagcccacctgatactgtacacaggtgcagacagggaagggtgccttcctggctgccacctgcctgtgctcagacctgcacctgtggagatgcaggaaggcccatccgagccagaaacgcctgggcatccctccaggcctgacttccaggctatggtaagctcagaggctaaggtggcagctggggctgaatagcggaggtgagggaaagtcatcggcgttgaacattgacaggtgtcagacccagaagatgcaggacggccgaggccctgcaggggaaggcctgggcgcaggtgggtgtgggaaggctgtggccaggctctgctgtgctgttggccatgtctgggcacatcaaggaaggtgggactctagggcataacagctttcctgggattacaatttaaatgagccaaatcttcaagaagctcccgtttccaactgggcccttccagaagccatgtgtctgttttttatgtattaacaaaccccacagctgatgaggctgattcatttccatccactgcacactgagggtctgctgcccggcctccctggggcaccgcctcgacttctcacattcccaaaatgaacaggctgcaggctgcgattttaggacctcagggcctgcggcaggcatcttgttaaatacacctcatgtaactgtgtgcccagggtgaaggaaaggtgtcctggtcaataatgacagccgtccctgaatctggtggaagttctgggccgatcatcctgtttctcatcctaatgagaagctggctgtagtaaagggattgttcccatgtcgaagggaaaacatttcaggtctgagatgcgtaaggccatatgggggcaaaccatgggaccaggcgggagctggggctggcgctggggtcccccaagccttgtgcctgccatgtgatgggctgcccagccctgggccctggtgggcaacggctgcagaaagtttgtttggaaatggttggggtcaccattggcatggtttgcctcgtccaggagaaccacgaggcgggggtgggggcaccctacccatcatcacagtcgccacatcagagggtggggctggtcatgtcattgaaggtgcatccctgaaactgtggccaccttgcctgtggacatctggtctctgttttaaacctttcccttcctaataaccccaaaacaaatgttcttttgaactagagcatgtgagagcagccgggcgtgttggggtggtagggtcaggggctagcattcgtttttaagttagagttagtgtaattcaaatgaaaaaggaaaaccctgcattggctccccacaggggtgtgggtccctcctggcccttgtctcttggggacgtggccagtgggatcatgctggcctgacttgctcagtccttatcttggagatcttgtttaccgggatatggagacttttcagaaaagccacaggactgagattcctgcttctcattctaggctcctaaggattatgcttaatttataaaagctcagaactaggtctttattcagggactctggatgaaggggattagtgaatctggcccctggcagtcttagaatgaattgttcggtgacagaaaacaaacaagcctcagacagatttgaaactgtcaaatcccaaaacactccagtgaggagctgatgaagatgccccagcagtcacccgcatttcagccctctgagcaaacgtgtgttctctctactagatacgtgatgctgaccaggcacagggaaaagggaggggaggtaggtttgtcacctgcctgttaccagagccccccagcccatgagctgactctggaccacgggctgacttcagtgcaggttcccctgatagggggcaggaagcagtgtgccctgtgctagagaaatcttgccactgctctgcatcctcagcaaatcacaagggagtcaccaaatcgaggagtgacacgaccccagcgtccatgccgaggctgggaggcccaggaccacccaggcacctggtggctgagtctcctggaaaataggctctgcactgaagtgacactaggtccactgtccagcgagttcctttgcctgtggccacacaataggcccagagcctgggagccagccccattgaggggcagagtgcccagctgtttgcctgttgactcttcagaaccttctgggggaaagcagcagaccagacctgtggagggctgcatggggctgctccacctcttcagctttcctgggacctgattcatggtctgcttcacatcctctggcatggtccagggaccctgtcagttctcaaccactgctctctccccttatgtgggcttgaagtggtctgtctacttctctggagttgcagtgctactacatcctgtctctgggtgagagagtacaaatgtcactccatttccaaaaggaaaacacacacatctgcagcgccagatgttagaggacagaagccgcgtgtgttagaagcagcggctgttgccagttggccggcctcttggtttaatcttccaaagcggcagtgcagggtgggaagggtgtgcttggaccctggtggactggtcctggcctgcaggctctgagtcacacaccttccaagggctagagtctgaaggtacagccataggtgcctggtagggtgaaggccacagtccccttcatgtgcccaggggcagaggccccaccccaaatcctgcctgacagccggcttcttcctgagcccagcacagggtctgggcactagggcaggtgctcagagaacacttaaagactaaacaaggattttacagatggagaactgaaaacctgggatcactaagcagggtaaagccagcggggacagacccgggatttgaggtgctttgccagggatgttatgataaatgaccatgcacggggggcttaaaacaatggaaacgtatccctgcacagttctggaggctggaagtccaaggtcaggctccttcaggggtctggagaggatcaaatccatggtgtttcttggcttgttccttccttctttacaaggacacaccactggatttagggcccacccgagtccagcatgacctcatcttgattagatctacaaggatcctatttccaaataaggtcccattcacagaactttgggggtcacttttcaacccaatacaactgtaaaggcctgacttttgttccacatggcctttctggagtgtgacgagtgctttttccgaggcgaggccagtcctcccagagacaggtggaggcagcacgaggggcctggagcatttgccgtgcatccactatgtgccccgcacttcgcatgtgcgccatgggatgccctcatggccctagaggcaggggctgtcagcaacgctcggtgtcttcagtccccagctggatcccccagtgtgaccaggctgggccacggctgctggtccctttggggtcttcctgcccacacccttgccccctgttatatctggggttgaggctctggaagctcaaatttgtagccagtttctcttgctcagacgggaggtggatcttctgatgccaccctgggggaggagggtggtgtggatggggccaggtcccagcaggccacaggcgcccacggtggctcagccacctgagtcccgaactgttctccctgacaagggacttctgttgtcccacgctgttctggcaactgggtccctggcagccatggtggggcatcttcctcagttaggtgatgaatagagggccattcccgtgagctggggtttggccttggattgaaggggtgttcacacacaaacgtaattgcacgacatagaaagaagggtattctgtaccccgggtgtccaccacatcctcggcgcagcagtggggcctagaaagcccgctgggagttttctgggcagctgtaggatgctggtgcaagcccggggctgctgcagagaggccgctgggatgacacaggtcgggacagtggtggttctgtgcccacctcacccaatctcatctaacatgattgggacagagttaagatgtgccttagggccaggtgctaggctcctcccaactccaagggattaattaaaagctgggagtgctgcttttaattgttgggggagctgtgtccagcagcaggcgagcaataccccccgatgtgcttgctgctgtgaaagggggaacctgagtctatctggggcctgcggtccggctgcccacagccacagtgactgccagtctcccactccacaccagccctgggtggggaggtgtagccaaagggctcacactgctcccttctccttctagtgccccacagggcacagggcagcctcttggggaatgggtgatttccgggccttaaagggaggcagttcctgcccaccacaaaggggtcctgagggtcaggaatgcagccagaggctctgctcatctgcaaccccccatccaggcagccccagctgagaccaaacaggggtccggccagcttcacggtcatgacgatgtgaacacaggtcagggaagaaacacaggacacgctggggaatcacagacagaagccaagcagaaagaacagacagatgaatgtgctccagggcggcagggctcctcgggcaggacccagcaggagaagccaacaaggctttgcgacacatttgagacttcacggcatcacaaaggatgtttctgttccacaggggggtgatgggcagggggctgagacagacactgggcctcccttacccttcttcttccggaccgaggcttgcaaacagaaaggggaccgccatgagccaccaggatgcagcgcccgcccgcagcctacactcgggccttgtcagctcagggcgcctcaggagcaggctgggccggcaatggggcggcaggcaggggctgtctggaacgctgcgaacgcaggctgcgctatccatggagtggctttccccaaaccttggctgcccgcacaactctgtcctgtctgccctgctcgttaacctactgcctggcagtggaaaggggctttccttcttcctcagcaccccttgtcccaccagcaccctgccaaagtagggaggagttctcagagcagacatgagcagaggtggcggggccagcctttagagtgcacctgtggcctttcctgcctcattctgttgtttcttgactgagctgagctctcaggagcaccccttgcaaagatgagagctgctaggcttgtccctctggggagccccaggacaggcctctgtggagagggcctggaggctggtcacctcctccgtcgcctgtgaggctggggcacgcggggcactactggttctgggtgggtggggcagcgccactgcagggctgctgttttggactgaggcctcatgcccatcctcagactctagccccagaacctcgtgagaagcggcctggccggcctcagcgccctgggccgaggaaggatgacatcactgctgtggcagcacttagcacttgctagactcctctcgggaaagctgcctgtgccagagtgcagggaggacggggcctgtgagtgagagcaccagccagggcttggctctcaaccccccaggccagctggactggaccgtgggccttgggcgggggctcgtttctgcgcccatgtaagctgccttcaccagctccaatttgtgctccagtggagcaagcgtttccacctacatgccatctctgtgtgtttcagagccaccctctttccaaaggtgtccctggctccatggtgactccccggaacaaacaggatcctgcatggccagcatggcccacgtggctgctagtcgcccttcccctgcctacaagatggagtcagagggccagagcctctctctgttgcttgcagaccttacacaaaggtgccgggcgttccctaagcctgctgtgcagaccagactgctctgccaagcccacgctatctacacacagatccccggaggatggagccttctggtctgagccacgtggggagcagctcacacaggcctccgaggcctgggctgaggtggatgtcagtgggggtgccctagacagcagggggagctgctttggggacccagtggggctgcttacctttatccactagtgagaggcccaaaaattcaaaacaaaacaatgttagataaacagaaaagaggaaaggcaggactagcaacaacgccccgcgaggctccgagggaggtgcacacatggggctgcggggcatgcaggggcatttcctgatgcacgtctgggtacaggggcaggaggggggtagcgagcaagcgtggggtcatgcacagcctggtgctttgcaaagggcagctcagggaccggcatggtgactgtacagggctgggccgggtgtgcgacttaccgagctcctccagctccgaggtcatggacttggagcgcagggtgagggctgtggtcggtgcccgctttggaggcgggggagctggagggcagaggagagatgggtgtgagaccccagcccatgtttccagatatgggaataaggctagcagtggccctgtggctggcaggtgggtctcaggctgtttggctgcggtggtcagggattgtgcaggtgtgcttatgatgggaaaggacaggtgctcaggaggatcttgccatatccctgaactgcagtgcaggccctcatgggtgggcctgggcagggggagggaggggacagggcactgagtgggaagcctgcggaagggacgcctgctagtgactaaaagggcactcctggtgggacatggatgattccggcagcgtgtgagccccaagtcattgtcgtgggctctggcggtaaattccagcctcacccctgtgcctgggctctcagaagtgtgggatcagctggagagagggcccactgccccccagctgtcctgcccgcccccaccccccccccccagtagggccccaggctggagctgggcgatgtggggcatgtacctttcttcctggcggtgtcgtcggggtccagattcctggtcaccgtgaccaccttaaggaccaggtgattccctccctgccggatcatgttcaccacctgcctgtggccgactttgacaacattctcattgttaacctgtgggaaggcggagaggatggcatcagtgagagccagcggagaggaagacagttggcacccacccaaggcagagacatgtgggctcctaaaaagggggcaaatgcagggaagcaaagggagtgagaccgtcatctttttggaagcaaaggtgcttttggggaaaccagaatgaatgctgctgtgactgtggaggtcacttaactgtggctcaggaggttgggggaggccttcctctgacactgcagctctctgctgagtcctccacagctgctgcagaggaagggctgatttctatttaacctgagcatccttaggtgcttacttttacaggcctggggcaattttcagggccaccaagagactgcatgtgaagagcctgacaggcgagttccagggctgggctgcagtgccaggctttgcatcctcacaggaggaggaaacgtggcgcttaattgcttctcatgtattctgggaatgcacatcacactgaagcagcccctttcctcccactccctccctccctgctctcccgctccagaggcctgggaaggcagaaaagcctggcccagcagggtgcttacaagagtgggggccctgtccctgtgctggtctgtacaactagctgccccagtgctcctgggacggtgagtggcaggctggggacccccaaggctgccatgctatggccactgccctgcagttgaggaactcttaggagccggttacctcctgccctatttgtcctcaccatggcaaatgcacctgacacggaagtaggaacggactcagggtgccatccccctggcccctctgctattctcacctccctgagcaatgctcagcagcagatggccttggcctctgcctcccagccccacgctactcccagaggaaaacccgagtgatggagactggaactgggtgggcgtctgggctgacactgcccaccctggctactgcaggagtaacacttagtggttttcaaatgttgctgtgaaaaggccccggcctcacccctgcccatggaactgagctccacagggggcctctggcaccttcatcccagcagctcctgaatgggagcgcagcccagaggcagctgtctctaggtggcagcagggagggggaagccccagaaggtgaagtttacagctgcttcacacgccaccttcgaacaaagaaaagcaccctgatcgtaaacaacagccaagacgtcatgcccctcaccagccacactgtgctgtacgcatatcctcctgctatagattcttcaaaaactaaacatctggtatacccacaaacagaaaacttaaagcctgtgtgctgcttggtggattttcacaaatccaacatccctgtaagagctggatagaagcaggtactgcctggctcaccatactgttgacaggcccagtgcctggctccccatactgttgacaggcccaggatgtgccagttttggtcacctacgagacggctgcagaggtcctccaggcagggctgcgaggagcccagggaggactcagtggggccagggcagtccccgtgccagctgctctgcagtctctgctgtgggaccggctcattcccatgtactcagacccacccggtttcagcagtgagtatccagtgtcctgggtccactggacagctggtcaccctgcactgccctgaagatagagtcttgggagcaggactatcctaatggggccttgggagagaggcccacctacagcggcagcggtctttgcaaggtgactcctgggggctgttcctttcactgaggttctcagaatgtaattaggaaagcagatggatttaggaagtaaaggagccggatcgaggaagacagcaccgggagttctcggagggcagacctcagcttgcaggaccctcgctgctctggtacagacaggcaaccgaacaccagccacgcgttatcgggttctctcccctcccatgagcacacccgggtagtggctgttgctcattcattcattcattcactcattccagtgtttctgttccccgtaccactaaaagccatgaggcacaggcagttcagctgtctctgcctccatctgtgggaagtttgcgtcctcatcagggagttttggccgacacacaaagaagtgaacacataacttcaggtggctgagtaccacctaagaaggcagaaccaagtaaaaggagactgaacagaggcctggacccaccaggaaagagcagtgtgggcggagtcatggagtgggaatgggcaaggaagcggtaggcaggggggcgcagaaaaggccaaggcctgagagcagggccttggatgccagggtgaagttatgggccagggagtgctgaggcccgatgcagagatgaggcatctgacccgagcagctgtgagtatgaggtgccaaacacacgtgggggggcaccgagacactggggtctcaagctgagatggaggaggcaggctgcccaggctcaggagccgcgaggccaatgtgtgaggccttggtgagaagacctggcagtagggagcccccagctgcctggccactagatccccaggggtcatcccttgcaaggctgtggggagcgaggggaggactcggccccaccttgagatgggctgggaccagctttcctgctctgggcgggcccccagtgccgggccttgagggggctccaaccaagaaagtgcatattactgcctgcttgctcctgccacccgctgtggggcattctctggatctgatgcttggggagagtacgagactggcacggggatgggctgccagtcactggagaagccaagctcaagttgcggcctcctgagggctcgtcgggctgatggggactttaacagcctggccacttaggcagggaggggctggggatgtggcctctgactgcagcctgctaaccatcacggccttgggctcactccctagaatcctcatcctccagaatctcccgtggttcatttgtggtggctggatgctgtccttctgtgatcttggccagagctggcccttggccgctttgggagaagcagtttgttcctgtgccttggaagggtcaaggggctggagggcccttttcctcagaagtgtcagagacagacattactcttttctgggcaggggaggcaaaggaccaaagaaaggcctctcggggaatgagccactcatgggggattctcaggaagcttggctgcggggccaaggaccttggcggccccagcaccttccttgtctgtagccgacagcctgggtgcacgttctggtggcacctccacacactcatgctgccccagccagagctgctcctgcacagggccaggctggctgcccagatttgatgtctcatatctgagtctgcagaagctgctgttcccacccaactcctaatcagggctccccagttcctgattccatcccctgtacccctcgtagacctgctgccctcagcagactgcagcaaatggcaggacctgctcaggagagctcagaggaaatgaggctcccatgggccctggaaacatcacttggccttctctgaaagctgatgacaaagaggcatacagggcttgcaggggtggagctaggtttggaatcagttgttgggcatctgatgcccctctgacgtccagaatctgtctcgcccaggtctttcggggtcatgagccacttccaaacaaagttgctttggacgagcttccctgcagtcccagctccacttggagggccctccctcctgcttcatggagggatggtatccggtgagccctggtcctggtgggcctgcacccctccagaatcagcatattattgggtccggagcctgtgggggccctgctgcttgctgggtgcccgtgggcaggacacctgcctctctagcggggtgtcctcagtaaacagcatggcttcctgccctggcaagcacttgggggcagggaggtggtgccaacagggcctcaaaccatccacacacatcctaggatgttccctttggtccccatccagcgattaccaagggtcaaatcccacccacacagtgcctcagtcagttttaacttagctgtcacaatttaaagagtataagacctttgcatagaaagtctagaatttcagttttcattgaaaaattagaaccctcgcacttggggagttgggcctcccacttgcatgcggcatcctcccctgctgttagctgaggctgtgactgctgctgtgcccgcccgccccagcctcctgggccctgacgtcaccttctcagcttgagggggcattggatttgtggctcttgccagccaccagtgaaacagaaaactgctatcactgcctttgatgccatctgcgtttagaattttgggaagggacagattgaactctgcacattgctggtctcaaaatcagcctgggtgacattcatgaaactgatttctatttcctacgggagccacaggtgactggtgagccctgtatcaatataagcttcccaggccagtctcctgtgtcagagctcagatctcaaaacacattgaccttctgcccagaatctttcccctgcagagggagagggatgtctgtgaggggcctgcaacagcctttctgagcatgaggaggaggcagaatgggggaatgtcatgtgggcgctggggcagaggcaggtggccatcccgtctgtcaccactccgcattaccctgaaccctagatgcaggcccagtggacagacacggacatgaggtctggaggggcctgtgggggaccccaactcaaacttgggcttgcaaaagccaggaaagtggccccgaatcttgcacttaatatagaaaccacatcgtttccatcaatgaagagccagttccagcaccaagcatgtggtcccagtgacgcgcgtttgtaattagaccctaaataccatcaagacactaaaaatgccgacttccccaaagcagctggggctgggaggaacccgcaagagcggggcttgtgattttttggagtgtttagaggctctgcaaatgaactcagaccggtagtaactcctgcaacgcacatttgctttgcacccctccagggtatggtttagattctgccgagagggcacaggccgtgacagtgtgccacaggaacctctatcatacaggcccaggacaggaagaccccttggtgagaacctggccgcactgacagcctgtgcccggctctgacctcaggcaatgagagcctgcctactgggaacgccacagggcaccagggctcatgggggtggatggtgcccacgtgctgctgggcacacacctgccctgtccccctcagctgagcacagagaacccatcccaaccttccgcccacactgacctttcccgacagaatgctcagcacccctccccacatcccatccctccagcttcccctaaggccaccatcagggctaagtcctggggcggggcagagtctgccccctgccctactttgcctactggtgcatcatctctgtgtccccagacacttgttctggactgaactgtgtcctgcccaaatttatatgctggagtcctaatccctagtatctcaaaatatgaccttactttgcagatacagtcaagttaaaaaggggccattagggtgagcctaacccaggtgactagtgttcttatgaaaaggggaaatttgggccaggtgtggcagctcacacttgtaatcccagcactccgggaggttgaggtgggtgggttgctcaagcacaagtttcagaccagcctgggcaacatagtgagaccccatttctacaaaaaatacaagttagccaggtgtactggtgtgtgcctgtggtcccagctacttgggaggctgaggcaggaggatcacctgagctctggaggtcgagactgcaatgagccatgattgtgctactgcactccagtctgggcaacagagtgagaccctgtctcaaaagaaagagagtcgggggagtctggatatagagatatgcacacagggagaaggcgccatgaagggtgagatcagggtgatgctttgagatgctaaaggttgccaggaaaccgtcagctcctatgggagaggcctggaagattttccctcacagccttagagggaacccatgctactgccaccttgatctcaaacttcttgtctccagagctgtgggacagtccctgtctggttgaagctgcccacctgcagtgcttggtcaccaggcctgtgccttgcccggccttcttggttaccaccctgaggactgttctattgcagccctcagccacagtgcatctctgtctgctgcccactgaggctcacctgcccctgcagcaccagctgttgcccatgcagtggcacaggtctccagcgctgcccaatgtgagcagacactgattgggccacagtcttggctcttggtcccacgacctcccccaggggcccagtgtggggacactggctattggtctcagagcaaaaatggcctcaagtcccatttatcccattgagggggggctcccagcatggagctctgcactcttccttgcaggagctcagagcacggccagctggcatgtagctctgagtcttcagcattggtgtagccttcgggtcagctttcctcagctcccctgccccctcaccctgtctttcagctctgactcagcccaccctgctggccacgacttgaagctggggacttgcagtggctgcatgtctatgtccccccagtctatgtgttgaaaccctcaccgccagtgtgatggggttgggaggcggggactctgggaagtgattacatcatgaggcggagccttcgtgaatgggattagtgcccttataaaagggaccctggagcaaccctttgccctttctgtcctgtgaagagaagatggctttctgcaaaccagtttgccggccagtgccatgatcttggacttctggtctcccgagctgggagaaataagtgctgtttaagccacctgatctgtgtattctgtcgcggcagcccaaacggactaagaactcaagtgacaaaccatagctgtgcttacttacccaggagcctggccacagctgtttccgtctcccatcccctgcaattacatatattgtaccaggcttgagatggggagggaggaggtgtcttggccagcaggtgacccaggagtgactggtcttaaagggaagctgggaggcagggactggaggagcagaccctggggccgcagttcacccagacctgcagagatggcagaggcagctctggcatgcaaaggccacagcccccagatgctgctgctgttagcaaacctggggccaaggttggtggctggggcatcttaaaggtcctgggggaaggggtgttgtgagtgggaactcagaggcactgtcattggaaaatgactgccgcagccctgggagggagtgggcagtgcaggctggaggccacagccctcccgcgctcatgcttgtagcagagcttttgcccttccccaccccacagaggtcctattgaaactgtcccctttagcagggctaactggggcatgtaatgtgggtccctgagaagagattgtctttcctgcctctgccagcgccaccacccccaagtttctgccactggacccagctgtctgtgaggcctctggatacagatcctgtccctcctttccctgctcctcctctgtccaggagctgggggaacctgtctgcaggaagagggtgtcctccaggatgggcccatgtcactgtcttctacctttagaggaagtgtctctgccttgtgcgagtcatagcacagtgagtcctaggggttcctggagtcctccctaggctgggcacacaaagggtggagcccatgctcccagctgccttcccctttcctggtgaagaggaagtgtgactccattttccggacagaagctgcgcagccacatgaagtggcagcacctactccttgctgcctcagagccagccccaaccaaagaggctgcgccaacctcccgtcgaccatgctggtcttaagttctcatcctattctgcaaaataaacaagctttggatgaagtccttccccaaaagtaagaaacataccaaggacaaagctgtgcgtcgtgtggctttgggtttttgtgcacctgctccccgtgtgaaggtgagcactttgacaacaaggctcaaggatgccaacggagtgtgccccagcgcccatcaacacttctatgggaagagtggggcaaaggcacatggctggcaactcaactcaacgtgaaattaattgacaagaccagcacgcaacaaggcaggactggatacttcagttacatttccctacccagttcagcagggacagaggaaaaaaagctttaggatctttagaatttcccagcctttaaacaaacctaaaatcagtttaacctgcaatgagactttggaaccagctacagtccttaaaacagatgccagaaattgctcatgtggtgacagaaactgcagaataggtgaaatgcttgctgtttcctcatatgctcaggttggcatcttgagcttccatggggtttcggtgcccctcaaaaaacctggacctgcaattctggaatgctgccaccaggggaaggtatggcttgatcacttgccagatttatagaaggctcaggtaagtactgcagctcctggggataactgccttggagtagagagaaactgttgagaaatcatggatccagataactccaaaaaaagagtaatgtgcctgtccatgcatcacccttacatacagacatggagacatttacagagtgagtgaatcacagccacatccaggtagatggcaagaacccaagcctatcatcagccacagtccagggaatttctgtgaagaatgggcatacctgccttcctttgtaaataattctcttcttccacttaaatcgttatttaaaatatcaaaagttgtacatacacatacacagagtttacagaaacaaagagttccacaaggattgtcatgatgaaaccccaccaacccagccttacttctcactctgagccttcagctatttaattttatatctatcactcaatctctgaacacctatttttgctacttgatatttacattttcgatattatccgctgacacactgtgatggaaaaggatgacttggctcagagtttgtgaaatgtggcactatggtgattttggaccaattaattctttgttgtgggtgtgcactgtaggatgtttagcagtgtccctgaattctacctgccagctgccagcaataatctccacccccaagcgtgaaaatcaagaatgtttccagatactgccaaatgtcctatggaaggtcaagacaccatcagttgagaaccactaatttggctctttttaaaaaatcctccctccccactgttttcccagtaccaccatcctctagatgtattgatatcaaaattttaactagatcaccattcaggatttacatcatgactatgtaaaatctattcatagcttaaactctatagtatactatggttacttcatcttttcctgtacattttgttctccctagagcaaaataattttgtttgttggtcggtttttctatgtacttaacagtaattcaaatccaaatgcttccctaattatgtaaatctcttttcagagtcttcaaatacattatccattttaagtttgtcttcctgaagaaatatttcctgaagacttttgatctgcactgaacaaccaggattaagtgttttctagcagctgtccccattactctaatcctcaggattcctttgactgattctttcctgtgttggatctcctgaatccctgtatttgtttatttggttcaaaaacctcattttttgtaaaggacatcctccagtatcttctccccaaatagagttaggacataatttttttgagacattgactatttgaaaatggctttatctgtacacttaattggtagtttggctgggtataaaatttgaggttggggaataaggtaaagtaaattcctaagactaactaactcttctgcaggtaatagctataaaatctagacagagtacaatccccacccccaaaccaacaaataaattctctgaaggttctgaagagtgaacaaagacaggcagattttagatgagagttgaaaattagaagctttgtgcaatggatgcattatggtatgagtcacctgcagttttttgttttttttttttaaatccagatcctgcacaaacctgcagttctgatagaaatcagaggatacagcccacagtggccatagcagccaaagtgaggggagaactccagaaaagagagagccagagaagggtagtttcatattctgtgtgtaaacttctcataggtctttggttgatgtctgagctgagctgtgtgtgtaaggaagactcaaataggcttgctatgataaggctgaaatttgagctgctgccactgcagggcagacaaaggttgcaatttgagtttaaccaaactcattatcagctaaaacaaaaacattaacacccatcaaaggaatgtaatataatccagagttgccaaagcataacattcacgaaatttgggatacaactcaaacttatttagcaaacccagagatgacccagatgttggaattatcagagaaggactttaaaaaacagctactgtaacaatacccaactaggtaaaggaaaataggcttataatgaataaaagacaggaaatcccaaggaaattttaaaaagaattatatggaattgttagaaatgcatcagctgggcttaacatcagcatggatatgacagagctaattattagtgaatttgaagacatgccaagagaacatatccaatccaaagaagagagaaaaaaagattttaaaaagtagaacagagagtattaaggatcaaaaggtctaacataacgtgaacgagagtctcagaaggggggaaaattagagtcaaagaagacagagaaaatgagtcataaaaaatacttgaaaaaatggtacccaaggaattccccaattaggtgaaggacataaatttatagattcaagaagcctgtgaatccccaaaaagataagtatttaaaaaattatatagggacattatagtcaattctgctcaaagccaaagacaaggtgagaatcttaaagcagccagagaaattatttacattattcacactctaaataaaaatgactgaatgattgcagactttgcatcagaaaccatggagaagaacctcttgtagaagacggcggaacaacatctttaacaggtgaaagtaaaaaaaacacaactagaattccatttctggtgaaaattctttaaagaatacaggcaaaataaagacctttataaaaaaatgaaaaccaggttatttgttgccagaaagcctgcactaaagaacgttcttcaagctgaagtgaagcgggactggatctatggatggcacaaagggtgccacaaatggtgaacacctggatacaaaataaaagatgattctccctcttaattttaaaagcagatatcactgttttaggcaaaaataatactgattttggggtttacaagtgtgtagatgtaacacacatgacaattatagaataaagtgaggcaggagtgaagaagatgcatctatatggttgctgggtttttatattttacatggagtgtacaatttgaactctaagtagactatggaaagctaagaatgtatactgtaatccttgatccactgctaaaagaatgtgaagagctacagtgtaacgccaatggaaaaattaaaataaggttctaagaatagttaaataatctaaaataaggcagaaaaagggaaaaataaaaactgaggagataaacagaagacaaacttgtaaacctagatggaaccacatgaacaattctattaaatgttaaatagaataaaactccaactaaacatcaggccttataaaatggtttaaaaagaagacctaattatgctgtccgtacactttcaatacaaagacactgagaggctgagagttaataaatgagaaaagacagttcctgggcagaatggctgttaatatcagacaaaataaatttttgacacagggtcttgctctgtcgcccaggctggagtgcagtggtgtgatcgtgactcactgcagctttgacttcccaggctcaggtgattctcccacctcagcctcccaagtagctgagaccacagatgcatgtcactatgcctaatgattttgtattctgtgtagaaatgtggtttcaccatgttgcccaggctggtcttgaactcctgggttcaagtgatctgcccaccttggcctcccaaagtgctgggactacaggcatgaaccactgcgcctggccattcaatgactttttaaatatttcttttattttctctttgaggtatccttattttatacacagtagaccgtctggactgaccttctaattttattatcttcttcgaaggccatatctttttcttttctgagaaattcttttcaagtttatctttcaatctatctttcaaatttttaatgccagcccggagcggtggctcatgtctataatcccagcactctgggaagctggggtgggacgattgcttgaagccaggagtttgagacctgctgggcagcatagtgagacctcgttccttgaaaaaaaaaaaaaaaaaaaaaaacatttaaaagttagccaagtatggcagcacgtggctgtggttccagctattcaggaggctgaggtgggaggatcccttgaggctgaggctgcagcaagtcctgatcacaccactgcactccagcctgggcaacagagcgagacctgtctcaaaaaaattttttttatacctgctatataatatttttaattttcaggaactcttattttgttctctgatcatttcagaaagaacattttactttttttttctttgatctcactgagcatattaataatacatttcttaatcttactcttcctgcatactggtttcttcagttgttttcagtgtgtttgttttgggccgtatttcatattagttcatcaaatgtctgatgttccttggaaggcagctcatatttcagagtagctcctaaaagactaagttcgatcacagccaattattttgtgaatactgacaaatggatcctaaagtttatatggaaagctaagaggcccaaaatagccaacacaatatcgaaggaggacaaagtcacagggctgacactccccaacttcaagagttactatacagctacagtaatcaaggcagcggggtactggtgaaagaacagacaaatagaccaatgatcagaatagaaagcccagaaatagacccacacaaatagagtcaactgatctttgacaaaggagcaaaggcagttccatggagaaaggacagtcttttcaacaagccatgctggacatccacatgcaaaaatgaatgtagagacagacctgaaatctttcacaaaaattaacccccagtggatcacggacttaaatgtaaaaagcaaaactatgacacttctagaagataagagaagatctagatgaccttgagtttggtgatgatttcttagatacaacaccaaaagcataatctataaaagtcaaaattgatgttggacttccttaaattaactctgcaaaatgcactctgaagagaataaaaagataaaccacagactgggggaaaatctttgcaaaacaaacacttatcagataaaggactggtatttgaaatacaaaaagaaagaactcttacatctcaacagtaagaaaacaactgaatataaaaatggggctgggcatggtggctcatgcttgtaatcccagcactttggggggccgagtcgggtggatcacctgagtgaggtcaggagttcaagaccagcctggccaacatggtgaaaccccgtctcttataaaagtacaaaaatcagccgggcatggtggcacacatctgtaatcccagctacttgggaggctgaggcaggagaatcgcttgaacctgggaggtggaggttgctgtgagtccagatggtgccactgcactccagcctgggcaacagagtgaaaaaaagggcaaaatatctgaatagacaactcaccaaagaagatacacagatggcaaataaatgctccacatcatgtggaattagcaaatcaagccaacagtgagacaccactacacacctatggaatggccagaatctcaaacaccgacaacagcaaatgccggcgaggatgtgcagcaaccggaatgcttatcgttgctggtgggaacccaaaataacacaggcactttggaagacagtttggcagtttcttacaaaacaacacacttttaccctatgatccagcaattgtgctcctttgtatttacccaaatgagttgagaacaggttcatacaaaaacctgtatgccgaggtttagagcagctttattaataattgccaaacttggaagcaacccagatgtcttttgagaggtgagtggacaaacacactggtccatctagaaaacggaatattagttagcactaaaaagaaatgagctaccaagccatgggaaggcctgcaggaagcttacaagcatgttgctaagtgaaagaagccaatctgaaaaggctgcacactgtatgattccaactacatgacattctagaaaaggcaaactatggagaaggtaaaaagatcagtggttgccaagggctcagggggagggaaggaaggtggaacagaagcacagagaatttttgaggcagtgaggctgttctgtttgatactataatggtaggtacaggatattatacatttggcaaaacccacagaatgtacaccaagagtgaaccctcatgtagactacgggctttagttaataatggtgtatcaatattggcttctcaactgtgtgggacatttgctacaattgacaagccaattgaaaaatagggaaaacagggagagatataagggggtatgtggcaagtcggtacttttcactcatttttccccataaactcctcaaaatataaagtctactaattaaaaagaggctcatttctacaagtttttattatggaagaagcccaatgttacatgacagtagagagatgagtaccctgagccagtgctgtccctttagccagcgtcagccactgctggctccgagagcacccacccagcccctggggcgatcatatccctctgcgttccctggaaatggctcagcatgctttctatgaaaagacagagactcttattaagaagaaacacaactgaagtgggaggattgctcgagcctgggagattagctgcagttagctgggatcacaccactgtactccagcctgagcaacagagaacctgtctcaaacaaaacaaaaaccaaaaaccacaatgccattctcatgcctaaaaagcgactgcattcctggtatcatgaggcaccgcgtcatggctcaggctccctgagtgtacagctggtttacttgactcatgagcaagatgcacacgtcacatctggctggcacgtctctgaagcctttttacatctctaggctttccccattcctcttttatccctttgcagttcatttgctgaagaaaccgagtcaattgcatcctgcggcattgcttctattagtggtggtcagaggcgggattgcatccaggagccctttgcaggcggtgccgggcatacccacgccaggagccccggcacagctgcttgggtctttctgcgacgagacagcaccggtgggtcaagcaccctcagcctgtcccactccccgtcagcttgccacttagtgtttttagcagccactggtaaatgccatgcccagatccttcacctcctgggagctgcagaacgctgatgttcaacttctgttgctccttctccacttactagttggaataatttttattttaacttcttgagacagggtcttgctctgtcacccaggctggagtgcagcggcatgatcttagctcactgcagccttgacctcctgggctcaagcgatcctcccacctcagcctcttgagcagctgaaaccacaggtgtgtgccaccacactgggctaatttttgtatttttttgtagagatggggtcttcctgtgttggccaggctggtcttgaactcctgggctcaagtgatacacctgggcctcccaaagtgctaggatcataggcatgagcactgcacccagccacactaatttttaagaagaaactttcccttttcaacacttggatgactctgaggcacagtgtatgtgagaaggcccagatacgggccggatactcgcctttcatcagttttcatgtgaatgagtcacttctttcaagtgaccagttctttaaaaagtgtcattatgggcggggcatggtggctcacgcctgtaatcccagcactttgggaagcaggtggaccatctgaggtcaggagttcgagaccagcctgaccaacatggagaaaccctatctctactaaaaatataaaattagctcgacgtggtagtgcatgcctgtaaacccagctactcgggaggctgaggcaggagaatcgcttgaacccaggaggcggaggttgccataagccgagatcgcaccattgcactccagcctgggcaacaagagtgaaactccgtctcaaaaaaaaacaaaaagtgccattatgaactcaagaatgtttataagaacatagctgataaaagtttgaatccactacaattactattgtttttattttattttattgaaacggggtcttattctgttacctgggctggagtgcagtggcatgatctcagctcactgcagccttgatctcctgggctcgagtgattctctcatctcggcctcccaagtagctgggacccaggaccacaggcatgcaccaccatgcctaatttttttttttttttttttttttttaaaggcaaggtctcaccatgttgcccaggctggtctcaaactcctgggctcaagcaatctgcctgcctcagcctcccaaagtgttgggatgacaggcgtaagccaccacgcctggtctagtctttgtttttaaacaaatcttttattttagaatagttttagatttacaaaaaacattgtgaactcagtatctggagttcccatacactccacactgtttcccctattattagcatctcacactggtatgggacatttgtcacaattaataaaccagtattgatatatttcattaactaaagcccacattttattcggatttctctaatttttacctgacgtcccttgtctgtcccaggatctgtccagagcaccacattacgtttagttgctgctctaggctctgcctgctgggatggtttcttagactttgttttgttgaccttgacagttttggctgctggtcaggtcttttgttctacccctgaattaagattttttttcctcattattagactgaggtatatatgggtgttcaggaggtaaagagccattcctgtcacatagtatcgagggcacacactgtcaccaagacttttcgctgttggtgctggccctgctcgcctggccaagggagggctcactgggctcccccgctgtgaagttactctcctttccctactttccacacagtgctctcgaaagcaagtcactgcatactgcccacacctaaggggtggggagttacacaccacctccttgaggacagagtatctttgcacatgttagggaagatttgtctattcctccctttatctttcagttgtttatttatcagtgtggacccatgaatactcatgttgtactttgaatgataaccaaatgtgactttattttctagctcaaattgtcccggccgtggtctttgggagctccttggcctctgggagctccctgggatttgctccagccttttgttttttgaccacttccttcctttccggttctacaggatgctctaggctgctaccttttgccgtgctttcgaatcctccactgtgctgtatgagcagcccttcctcacactggctcctgagcccatcacatgtgactttgtgtcttcaataccttccttgcttttggatgtgacaaaatattctaccctcttcatgattatactgatagcttcaacagaaatttaggatgatgctgtttttacttattttcttttatattggtgtctctttctctttgctgaaaatctaggttcctaatgactgccattaaggtcatgatctatttgctctatcatttattaatcatctatccatctatcattactttcagactaacaccaccaatgtcattactcataacaggattaccgaaaagaggttatgatttctttccagtttgcaatgacatgcaaattgccacttgacataatttgttaatgccattaatttaattagcagttatgttcatttctattattttgttttggattttgagatttttgaaattttgactgttttacaattacgtgaaatatttactcaattccaaaattgaacctgctactctctctcttctacttcctcttcttgtattctcccccttgaggcaatgctaaattaaaacaagttattttggtggattatccttccattaaaaaggagaaatgagcagatacctgtgtgtttctgtatgtgtatgtgtgtgtgcacgtgagcatgtgtgtgggtgagtgtgagcatgtgtgtgggtgagtgtgcacgtgtgtgtgcacattccctccccaccttccttgggtaaacagcagcacgctggtcacattcttctcgccttgcctttcccacgtaacaacaccccctggagacggtgccacggcagctcccagagacgctccctgcacctgactgcagccacatgtcctcgctgcaaggctgttacgcggcacacactgcaggctcctactggtgggtctggtgcttagtgttctgctctccaaacagagctgaaaacagccacgtgagtccttgttctaattttccgagtgcacctttgggctatgttcacatctgtggggttgctggctctaacggtttcttatccaaactacccatcagcccttagcccaggctacctccacctcctaggcagaggccacagcctcttgcagttccgccacgtgattctgactgtaccagctttccccaccacagccccgctccagctttctgaggcctttgagtccacttgctgtgcagccgccatcgccgtttctgctctgtccttgttggtctctgcctctttaaggatggcttatcctgctgcgtgcatggctgaatgcacggcttaacctctatctagatttgattgattggcagtgtccctcttttgctggacgttgccaatcaaacctctaaaaattcatttattcttgaaaaagatacaagaaagtaccaaaggggtggccacagcatggctgtccaggcacgggcgccctcccagggcagccacacttctgcacgtgcagggttctcattaattcttagcttgtctccagccatggcttattcaaaccccgatcttatttcctcctttgactagaaagctctctggtggtaccccctctatcgtctctcatcctacccagggcctccgagtccctgctggctcaggctttgaaagcccaggccccttacccggctccagctccgcgggctggccggccacctgctcacactgtctaagctttttcaaggctgtccttggcatccattcggaccgtgtcccagtccctcagttattgcagccatcagagggggagaggaaagaaggaagagaagggcactgcccccacctccaaccaggcggcatcatttgagactcgtgcagaagggaagccgccccaagccagccaggcatttgggcccctaaatgccacagctcctctcttagcggccacagttgccccggcaacgtgcggccgcgggcaggctaccttcactgaggcctccctccagacccgcagctccaatccacaccctctttgaaaaatgtttacacacagtgccacgaggtctccggcagagggcttgcgggtgcaaggaaacccacaggcccacacctgcaatgctggtgtgggtgtggaggggcagctgcttgtctcctgctcctccccgagcatcaaagcacgcgggtggcacagcagggtgtgcttctgcatctgcccgggccagctggctgctgtgtgcacaccgggaggcctctctgtccagagcaccaggaggaggctggcctcacacctcaatgcgactggttacaaatacagattcccagccctcacagcagcaggtgctctataaatactattgagcagttctctttgggactgtggtaaaacacagcagggtaggaatgcctgggttcaagtctcagctgccccactgtcaggtgagtttgtgacctcagagcagggctctggccctcatcagctctatctgcagcaggggagcagcagttctggcagtctatccatgagaatgcctgaggacgggtgtgtgactggaaggggggatgcagaggccctgctctgctggggaggatccccggtgctgccccgaagccctgtactgcagcccggctttcccacctaagcaggctttgtctatggtcctgccccctccctggctgtccttcccatgtaccctgtgcagcagccggtcctggagggcagtgttcaccgcttcctgtgtcaggaggcgctcgctgctggggctgggctgtgcacgaatcaggggctgtacgggattctcagtccactatcttgttctcaacaagaatatccataatttcagttcaaagcagtggaagagcatcatatggaggcagagtcggagagctggggtagcttcctctgacagcacccttcatcctgctgtgtccttcagctgtcctccctcccctgtgctgctccgcacggccactgcatgctggcttcaaggcccctgtcaggggtcagggcccaggctgaatacctggcacatgagggggcctggccatatttgcagcgtgactagcaagggaatattaacagccagtgtcaactgagcactgacgacatggctgcccctgggctaaggacttcacatagttacaccattcagtcctcactagcaccctatggaccaggtggcgacgggatcccattttacagatgagggacagaagctacagcggagccctgggtcctcccctctctaccaggagagtaaccaagagcagtcccaccccctggggggcagtgcagctgtgaatgccaccatcggagatgggaaagcaccaggggcagctgtgtcgctcacatccacgctcgccttaccagcgtggatgcacagagtcccagggagcctggagaaaggtatggactatcttcaacttaatctggtggtgacacccactgaggttgctgttcccaatgtgctatctttaccggagcaaatcggtacaaccccagacactcggatgcagctaagaccttgtgaattcctttgctccacattgatctgcaaggagtactagtaggagtctgctttcacctgacaacaccagtggtccacatgcacagcccgtcctcaggctaccccgagcctcctgctctctgccatgccggggccctcagagatcccatcagctcagctttccagaaaacatcatgctgtccacgatactgatgacattacggtaactagatcatgagcaggaagtagcaaatgcttcggatgccttctatgcaaagaagggtgggggaagcccacagagatgcaggggcctgccagttcagtgagggttctgcgtcctcagtgctctggaacatgttgagatagcccctccaaggggggaacattccgctgcctctcaccatctcatgcacacatggacacatacatgctcacacgcacacaggcacgaggcttggcaggtctttgtggagtgtggaggcaacacaggccacatttgaacattttctccagcccatctacaaagtcctctgcaagcctgcccgcttctagtggggaccagagtaagataaggctctgtgcaggtcccagctgcagcagcacaggccttgctgccaatcggcttgacagcccggcagctgcagcgacacttacagtacccatggcaaacagggacgcgtgtggaggctctggccagcaccagcaacagaatcccagtgcaggcctcgaggacttgggagcgcatccaggcccttctccgcaggtaactcttcttctgggaaacacctctctggcttgctcctgggccacggtgtataccttgcccaggcttgcccagctaggtcacttctgttagctttgtgtaccagtccccaggctcacccaaggaacagactctgtgggtggcagcccctctccaagagttaaggacagcagcccctaacacccaggacagctcatcccgggtctgtgaaccccagccagcaggcccagggatgggcaggggatggtggatttttttttttctgccttctgctaggagcatgagacagactaagagagaggtgagagaaaagggcatttggaaacgagcttcgaggtaggggagaaaacaggctctttcttttgaaatgccagggttggcagcatcagaacaggagcgaacagggtcctggtactgtgcagccccacctcccaacgccaggggaacggagccctggcacccccgtaaacacacacaccaggtcctggatgggaccaagccaccactttgccccctgaacagcacactcagaaggggatctctgctctccagctaacccccctcctagcccccagggatgtggctcctttagttttgtggaggtgatggcgggaaagtcctgttctcagaagcttccttccccctccctgctctgtgactcctgtctcctctgctggacttctccaccttagtcttggtggcctggggggcaactgcccatcattctcagccagcaggcctctctcaggaggacaggccctggcatactctgcccccaccccccacccaccttttcaattcagacacaactggccagcactcacattaaaacagagatccggagagtaatggaatgaactcctggtagcaataagacaccaaactataaacaagacctgaggccatgccaggcaaggtgatcctgcaccctaaacctaagaataaggtggattctggccgccacaaggcttttctgattctctagcagctaagcaagcgctggccttgggataagcaacattaatataattgtagctcatccacctccagacactgacagctggcctgtgttccaccagccataaccacagctgtgactggacaagagactgatttcagtgactttctcctgacaagagaccactggccgtgggctggctctcgctgggtcacagaggctgcactgagcccctttgagtccctgcttcacctttccacatgcagggcctgattgccatgcctttcaatgttaagtctctaccccgaggtgaacatgggaggcgtgtaccatgcatgtgtgctcagcgcacacgcgtcagggcccctgtgtgaatactcatggcttctataacctgctgagtgtgcttagccagcgtatcctcattccagccccactcccctgaagtgcctgcttccggctttggccagaggctatgcttcccagctggtcacaatgccacctcgcaggcgtaaccctttacaaaataaagtctcctttcgaaattttatgattttgtgatttcttttcagttgacaccactcctccccctcccctactctcaggcaaggaccccctccctccctcctgaacaccccctatcatgtgctgccgacctctgcaggcctggccccctcggaatcacatcccgggggagcccctctgagcccactctcctccctgtaccggccccatctggccaccaccctgggagcatccctgtcctcgtctcagaggtatgccaaccgccccgcccaggtcaccttggctgctgaccagacgctcccagtcctcaacgcttcctacacgaccacatcccagaccctcctcacaccgtccccttccctgatcctggcctccaggcctcctccacatcgtgctggtgttctgacccacaaacggctctgattccacagctgtggtctgggcgggccctgtgtggggagggagagcccagagacctggtcctttattgaccagatgctcctgaacattctgcctgggtcctgtccctgtccccacccccaggactcctgtagttaaagcctcctggggagggtgtggtgccggcctggctgtggacttgtgctgaccccttctggggccgggctggactcaccctgaccttgttcctcttgagcagagcttgcagtcacctgcagctcattctagaacgacccccatggtccccgcttcccagtgggccctggggaatggtgtgggctcaggtggggcctgattcaagttggggaatcctaaagtggcatggcttcctggtgtgtttaaaatactcatttgctcctcactcagaagggcagttgctataaatggcctccagcagcctggagatggcactgatggtgtcatcagccagctcgggtctgagaggcgcctcctccctggagcccccgtggtggtgaaaggagcaggggccctgaggccgggcccccaaatctctctggccattcatgtggcctctcaggggatgtggtggtgactcagactccgaggtcatggagaaggcccctctgataagctgagctacgaatgtgcctgactctccttcaggaggctaggacagaggacagaggacacccagggacaatggcagaccagggcaaagggcagagaggaggctgcggaggcagccaggcagccagactcccgcccatgctccttcaccgggcgacccagaccttgccagggactcaggtgtctcagccacaaaatgggatggtggtgagagggaggggcctgagtgcatgttaaggacctggagagctgccaggagcatctgcagcaaatgggcaggccacactctcatgaccgtcctcccatccctgcagatgatccggacccagacgacaaggcagaaggtaggaaccaggatggcggcgcagaaaccaaccgagcatcaggtgcacctcggcgtgatgctgccagccccagctgaggatctggcaggccgagaggccgagaccccgtccccaggcgtccctgaggtctgagggtcaggttgtccatgtgtgggacgaacgtggctctcgggctgctgtggtgccctagtatccggtggaagcaggaaggtttggcaggtcctcagcagggatgcagcctcctgggctgacgcgaggctccttgccagtgcctcgacgcgcaatgcaggtgccacctggtggccatgggaccctggaaaggggctccaggtcccacaagaacaccccagttcatggccctttatggcacccatgggaggggctggatggggctctttcccgtttactgcgcagtgttcaagttgcccagagctccattagcctgccccggtcagccagcgtgggggcagcagagctccatggggaggggggctcctgcatcctgatgaaggcccaggcagaagcaggcccggcagagcctgaggctgagggcagaagggggtctctcctgggcgattctttactatgccctgacaagcgggtcagctcgccggctccccaggggcatggaaggaaggaagcgtcctcggcatccgtgggggagatcacctacgccaagtgggggagggtgaaaggtgaaggggggtccgtggcagccggcgagctgggagaagcacagcacccagaggaacccaggtggcgactcctgctccagggtccccacacccgcctctcaggaggggctcccctgtttgaagaaataaaaggtcctggggaggcccccgtgacgatttccccccactggtggccttgtgggagccttaggggaggagacgggatctcctcaatgtgatgatgggggcagatcatggggcatcctggagcctggcttggggcggaactcagtggggttcagacaccctggtcacttactcccctttgggaccagggagtaagaaacgggtgcctggggagccagtggcacaccaggccaggaccagtgtctcatgtggcaccagctcaggacccatgtcatgctaggaaaccatcatggcacccactacttgcaacagcagggtctgtacccactgcagaatctcacccagtcctcccagcagccctgtcagcagccactactgcatccccatcttccagatgggaggctgggcccagagaaggcgggtgacttggccaaggccacacagctggtaatggtggctggtgcagtggaaccgggcagttggggttcaacacacgggttccccattaccacccaaaaccccccacaaggtgccgtgggatgcaggctgcagtgcggcggatgcagattctgggttattttagaatagcctagaaggtcctcctctcctgacagggattccaagatctatacaccttcgcattgtggtaaaatacacgtggcctaacactgaccattgataacatttagtacagtcatagcactttgcaaccaccacctctatctagttccagaatgtttttgtcaccccagaaggaaaccctgcactcataagcagtcactcccctccccctcccactggtaaccgctcacctcctccctgtctctgtggatttgcctattctgggcatttcatgtgaaaggaatcagacactatctggcctttcatgcctggcgtctttcacctggcctcatgttttcagggttcacaacgttggaccaggcatcagtcttctgttcctctttatggctgaataatattccattgcacagacagaccacagttggtttttttgcttaccagttacgaccatttatggtttgggttgtggggatgtaggatggtgcggctgctatgaagacagtatggcattcctcaacactcaacagagttaccacataatccagcaattccactcctgggtacagaagaagagaaaggaatgcagggactcaagcagatatttgctcaccatgttcacagcagcgtcatcgcaataaccaagaggtgggagcaacccaaatgtcccctgatggatgagtggataaacaaaatgtggtctatccatgcaatggaatattactcagccgtgaaaaggaggaggccgggcaccgtggctcatgcctgtaatctctgcactatgttgcccaggctggtctcaaacttccgggctgaaacaatcctcgcacccaggagttcgagatcagcctgggcaacacagtgagacaccatttctacaaaaaaattaaaaactagccgggtgtggtgacacgtgcctgtaatcccagttaatcgggaggctgaagtgggaggattgcttgagcccgggaatttgaggctgcactgagctatgatcataccactgcactcctgcctgggtgacagagcaagaccctgtctcaaaaaaatttaaaaacacaaaaggaaggaagtgctgacacatactacaacgtggatgagccttgaggacatcatgctcagcgaaataagccagacacagaaggactaatactgtgtgattccatttatctgcagtccctagagtagccaaatccacagagacagaaagtagaacagtgggtgcccggggctgggagaagagagaatgaagagctagtgtttactggggacggagtttactggggacagtgtttattgggaagatggaaagttctgagatggatagtggtgacgattgcacaacaatgtaagtatactgaagtgtatgcttaaaaatggctgagattttgtccgggcttggtggctcatgcttgtaatcccagcaccttgggaggccgaggcgggtggatcgtttgaggccaggcctttgagaccagtctggacaacatagtgaaaccccatctctactaaaaatacaaaaataaataaataaataaaacattcgtcgggcttggtggcgcacatctgtaatcccagctacttggtggctgaggtggaggttgcaatgagccaagatggcaccactgtaccccagcctgggcaacagagcacgactgtctcaaaaaaaaaaaaaaaaaaaaaaaaaacaaaaaggctaagattatagagtttacatgtattttactatgatttaaaataataactttttaaaagggagaggcatggcccaggcccaggcgcctcacctgccagccccatgagtgcctctctgggcctttgcatccatctgtgctgggggctggtggtggggccactctttggggtcttggaggatcaaatgcaaatgcacccacgcgcccgggggcctgagcctggggtgcatgcttggcagaggtgagctggggttttctttgtcccacactagactgactgcctcgcgggtggacgactgttcccaggtcacggttgagggtgaggccccagggaggcctgggatcatgccagggcaggcagggtgactgtggcatgcagcagggctgtgaggacaagtctagggctaaggtcccatctcagtgtccccaggccttgctgtgtggccacaggcattttgctgcgcctctgcgtcctaggagtggggataagcagcacctcggggctggcatggggactgggtaggagcgcagagacactgagcgccttgggaagtcctgggcctgcatgtcactcggggctggaagtggcttctccacacctggtcacttgctggctggccccccactgatgagacggggtccttgcagctccacttctccccatacatttctttcctgcctcgcagctctgggtgctggggcttgtctctgccaaaccttcccggagctgacagtagggaccagatctctccttgtctgcctggaccgtggtgtgtagtgacagttctgggatatatgcccctctctaggacagaggctgggtacggagctctgagcattttcctccaacctgggcttcttccctctggatcactgcacctgggcagagaggcccaaggaaacaaatctccttgattcttttgcttgtcattgagaaactcaatgctgagcatgagttgaaatttcaggcatgctgagctgaaattcctgtggcagcagctgttctcaggaacatgtcagttccataaggcaggtgcccccatactgtgcaagataaatgtgtttccgggtgtcagcaggcaggactgccctggacaactgtgtaggttgttcactccacaagggggtctgctgggggtggtgttcaagtccactctgtgctctgccccccatgctgtgcacagctgctggcatgcctgcctagagtggggggccttctcacatttgcacaaaggtattgtgggctcacagaggtggcccatcagcaaacgcctcaagtctatgggcagaattgtgggtctgtgtgcgtgcattttcctagagggagggcccctggtcctcgccagactctaaaatggagtcacaacccagaaagaggcccagagcccctcttccagggaagcaggcacagcacagtgaagccagctcccaatacagtccattgtccatggaaaaaaaaaaaaaagcatttagtgggaatgcagaatggtgcagctgcagtgaaagagtttgaaggttcctcaaagagttaaacacagaattacccaatgacccagcaattccatgcctacttataaccccagaataattcagagcagggtcttagaccgacacgtgcgcatgagtgtccacagcagcaccattcagtagccaaaagatggacgcaacccagtgtctacggacagagggatgaataacactctgtggtcgagccatacagtgcgacactcacagaaaggaatgaaatgctgacacgtgttccaacaaggagagcctcagagacatgatgctgaatgaaagaagccacgaagcaccccactttgcatgattgcatttctatgtaatgtccagagtagccaaattcacagcggcggaaagcagacgttgccggaggctggggggaggggcaatgggagggacggcccttggggacggggtttccttctggggtgatggaaatgtccaggaaccggaagaaggtgatggttgcacaccctgtgattgtgtcgaatatcactgtacacttttgaatggtgaattttatgtgtatttttacattttacatttttagacttttatttttgtagagatggggtcttgctgtgttgtctaggctggtctcaaactcccgggctaaaccgatcctcctgccttggcctcccaaagtgttgggattacaggtgtgagccactgtgcctggacttctttttaaaaagacaatcgattcaaggtctcaaatacagagactcctaggtgcaaattctacatccttattccagtgtcagaactgctgagaatgtccaacctagctccaatcacaacccgggggcccatgtcatctggcccctccccctgcttgcctggcgttccctctgccgcagccatgctgggtgcccctctgttccccaatgactggctcccatcagctttttgggggacatgcatatttctttaattgagatgagcttatataatgtaaaattcacacttttaaagtgtgcgactccatggcatttagtacattcacagtgttgtgcaagcaccacctctagttcatccccctacaaggaaaccccctacccattagcagtcagtcctcactctccccttccccagccataggcaagcaccaatcggcctgtcctggacatttcatgaaaatggaactgtgcaccatgtctccttttgtgtctgcttcttttactcagtgtcaccccttccatgctcacccacaaggtggcacgtctcatcactttcttcctctttatggccaagtagtgttccactgcatgggtgcccattctccaagagctgtggtacatggctggtctgagctcatcccagcccagtgtctcttggtgaaggaggagtaaaggccagtatctgctaggcgctgccctagaggggcagtgtattagtctgttttcctgctgctattaaggacatacccaagactgggtaatttataaaggaaagaggtttaattgactcacagttctgcatggctggggaggcctcaggaaacttacaatcatggcagaaggggaagcaaacacgtccttcctcacatggcggcaggagagagaaatgctgagtaaaagggggaaaagccccttataaaaccatcagatcttgtgaaaattcactcactatcatgagaacagcatgaaggtaaccgcccccatgattcaattacttcccactcgttccctcccacaacacatggggattatgggaactacaattcaagatgagatttgggtggagatgcagccaaaccatatcaggcagtaactcactaagtccttgctcagccctgggaggcaggtgctgtccccattcacagacagaagccaccatggagggcccagggcaggacacagggctgggacaaggccccaggtgtcctggtctgcagtctgtggtcttgcccctgagccaggctggcttcaacaaatgccagctggatgaaagaatgacagtgtcctaagactgctggggagtccaaactggtggcttcactctagcatgtcacttcttcccataaatgacagtgacacagttcatcagttcaggtgacgcttcagacactactgcacagaccgagggatgtagaggacaatggcgaggtggggactcacgatctgcatgacggtctttcccttgactgtctgcctcaccgagagtgcagtcaggccatgaagctgcttcggcccaacagagatgaggatagtcaagttcgttagctatgcaggggcaggagatgtggatagtgcctctggctggggaaacactgacaaaggagccatggctccaggaccctggtcagggtggtcctcagctctcacactctgcttcccacccatgttgaacagggcagagctgacctggagggaagactggctttggggcaggtgaggcaggcacatgaagtagtgctcatgaccagggatggttcccacgaacaccttcctccctcccaccctctattatccattttccatccatctgctcacctaatccatcttcccacatgagtcagtccatccatcgctctatccatccattactccatccatccatctgtccttccatccatcctctatcctccatcattcagtccatccatcactctatccctctgttcttccattcatccattcattatctaccatcatccatctgccatcatccatcagtctaaccagtccatccatttatccatcatccatccatccatccatctgccatcatccatcagtccaaccatcagtccgtccgtccatccatccatccatccatccatccgtccgtccgtccatctattcatccattcaccatcatccatcagtctattcatctgtctgttcgtccatctccccgtccttctgtctgctggtgcatctcatgtctgtcaggttgcctctgtgaggtcaagtgttgtgctagacgctggggaatgaataactcctggccccgcctttaagggctgcacagttgggcaggaggatggccacccagggggaccgaggccagccctgcagcagggccacccagcagcactgtgggaagtccctgtgctccacggggcaggagaggttcgggtgggccatccgctggcagggagctgggcccaggcacttgggaagcttgggagcctgagaagaaggtgtcagggcctggtaagctgtgggggaagcagtgactggccggagaccccaggaaaggcacatagcccagaatggacatgtggctcacccgaggctggttgactgagggggctgcgtgggggctgggcctgaagccagaccagccctacagggcccaactctctgcaggtgcacacactgtcgccaaggcacgtggacacacctgcacccccaggccccagccaccgacagcaccatgcctgccccctgggggccctcaccctgggctgaagcccacccaggtctgctggaggcaccgacccaggagacctccttaccctggcctcactgcccggctctgtgctgagcctgccctgtgtggtctgagcggagctcacagtgccaggggctgggccagctgtaagtggcggggtgtggcgggctcatcacgcttgttgtttgttaaagttcaactccgttggaccaagctgagatgaggcttggtctaaaataaaaccggagctgcgtcagtgtgtgggccggctctgtaggctggaggccactccacagccagcaaagtgtggctgtgcaccccagggctgtccccacccaggctggcgagctgtccccatgaggcccagctgtggcctctggtgaacccgagaggcagaatggccggccgatcctgaggctgtgtctgcacccacatggctgcggtgggcacagggcccactcccagggacccgattcccacactcagtgtctcccatgagctcctgggcttcaggcttgtggctccccttcagctggggtcagacacctcaggcttggctctcacttcttgagccaatgtcttggacatttcgtgaaaatggaaccgtgcaccgtgccaccttttgtatctgcttctttcactcagtgtcaccccttccatgctcacccacaaggtggcatgtctcatcactttcttcctttttatggccaagtagtgttccactgcatgggtgcccattctccaagagctgtggtacatggctggtctgagctcatcccagcccagtgtctcttggtgaaggagagaaccatggggtgaggacagagcagaggacccttcttactccaggaaataaacagcattttctgagccgtgttgagtgttgggctttgtgtcgtacgtcagctagaagagggttccccagatgaggctggggaggggtgggggcacggtctgcccatgctccttttgctccctcagggcctcccaaacactgagatcctagtttgaaaggatctgccaagttccctgagcgcccccctctcagagtcccctgcaggggtgtccccaacagcccctccagaatttaggcctgagaagcggaggagggaaacctccccccaggatgctcattaggaaagaagcccccagggccagcatggcagcccccaaaagatatgtcctagtccccggaacctgtgaatatgactttatttggaaaaagtctttgcaaatgtaattatgtttctcaacagaatatgacccgggatttatggtggtttaaaatccaatgacacgtgttctcgtaagagacagaagaggaggagacacacagctgggagagggcatgtggagatgaagtcagagacaggatgcagccaagccaaggaacgctgggagcccccagaagctagaagtggcaggaggcctcctccccggagtcttgggatggcacggggccctgccacacctggctgcagccctgtgaggctgctgtctgacttctggctcccaggactgtaggggaacacattccccttgcttgaagctgccccgtttgtagccacttgtggcaagcccaggccactcaaacacacccaacaaagtgaagaaataggcggctgggccctggctcagtcctgcagaggcacgagtcagctctgcggaggggaccctcgacattctgctggcaacagggaccgtgtgtgcggggccaggcctggtgtagccgacgtcaaccctgcagcaggtcacagaggcccgtggggggtcttccaggaggcattttatggggcacgtgccctgaggaactctctggccagtcacctgccctagctggatttacattgagagggcagcgagagaccccatgagtgtcacaaaacagtgatctcaaagtagctcactcacttgcagaggggcgttacccttgaacactcgtgaccatcctgggcccagcacacccacggggcagtagcgagcggtggagatgaggggcagagaccagtggggattcaggcggtcactgtcacctccccagcctgaggcctgggtaaggccagaaagctgagtcaccccacccgggggctcctgcagccctgcctgtggacatagccagcagcccacacggagtccccgggcgctgacctcttccaaacagccttgccagtccttcccccagaattagccgacagtgacccggagggaccaggggatctgaggccaccgcctttgtcccgaggggcttggccaaggatgcacagtggagtggacactgcttgccaggcctcttgtggactgcacgctaggcctctgtgccaggctctggatggggcaaaatcacaggtggcacatggctcatatggtattctggggatgcgtcctcccctgagccagtgctaaggaggtggctcccactgtcccatgcagtgtcctggcccttggtcagagtaaagctctggtcaggaggaaggagcaggataacgtggggctaacctgtctgctgcaggaaatgcatggaggaggaggtggctgtcactcttgctccgtcagtggtggagtctgtgctggttccctggggctctgcctgctccagggggagataagatccaccagccagggggcagaacagcccccggggcagagcctccagggaacagccccattccacacagagaaagcactgggtggggcgggaggcacgcacagacggtggggagggctgagtgttgggggcagccctgagtgctgtctcaggggcacccccagcctcaccatcaaccacccctccattagccttggctactgagatgcagcctagaagaggacgtgggctaggaagcctcctgggttaccccgtcggccgccacaagcctggcacccaggcactaggcttgcagaactactctgcctctcgctcggggccgatgtacgggtttacttttaccttatgcagagttctaacagggtggctaactggatctgcggcacacagaggatcaggatcaggaaatcagacaaggaagaagggctgcagaggcaggcccatgcacacagagggagaggccggatggcagagcgtgcacggccgaccccaggatgcaacagcaccgaatgccagtgccacagagagcaggctgtgccacacgcgggcctggcatgacctggtgcccaaacgcagctggcaggacagccttggatggactggagacattaaatgatgttctccatttaaagaaagtagagtaaatgaagaacattttagaacattccatcccaaatgggggccagactccgagtcggggtgcccaacagatctgcgggggaaaggtgctgtgacaccgcggtctggggggtttagggcacacagaaagctcactcgccacgctcaccacgctcactcgccacgctcaccacgctcactcgccacgctcactcaccatactcaccacgctcactcatgagtggatgagcaatcacagacagcaccacaggctggcggcaactccggcgctcttatctacccagcttctccctgcccagactctgctgtggggaccaggatgtaatctgggcgctgacccatgtccaccctctcctcgttcagctgggatgagccatgacccagcaggctggggtttccagggagtgcgcttctctcccgggggggccgtagcagagggcctgggtgctttaaccacagacgttcatgttcctacagtcctggaggtgaagtccaagatcaaggtgtgggcagggtgggttcctctggggactgcgaggcagtttctgttccaagcatttttgtgcccctggtggtggctggcaagccttggtgtccctggcttggaggagcatcacccccctctgcctccatcttcgcctggccttcccactgtgtgcctgtctgcgcccaaacctccctcttcttacaaggaagtgggccagtagatcaggggctgccctacccttgtgaccccatcttaaccagtcacatcgcaatgtcccaatttccaagcaagacctcactctgaggtaatgggggttagggcttcaacgtaagaatccaggggaacacgattcattccacagccgtgagttatgggcatgcttgtctcatctcacatgcctcccccaggccagtgtccccaagagcaggggccagggctcacccatctctgcaagaaggagaacagaaccagcaagcggggcgcccacgggcaggtcaaggggacggcgtctgagaaacccaggcaggctggggcccctccctcctgtggagtcgaggtgatgaaggcaggctggggctcctctctcctgcggagtcggagtgatgaggaccattctcatcctaccacctcctccctgcccgcgggagcctgggagtctcatgtccagcctgacacacacacgatacccatggccgcagcttcacgattagcgacggggggtgagctgactccatggaggccttgaaacccaccccgtcagccccacccagggctgcatctttatagttttaatttttaactgtactgcggtaaaatccatataacataaaacttccaacctgcccaacatggtgaagccccatctctactaaaaatacaaaaattagccgggtgtggtggcgggcgcctgcaacgcccagccactcgggaggctgaggcagaggttgcagtgagctgaaatcacgccactgcactccagcctgggcgaaagagtaagactcaaaaaaaaaaaaaaaaaaactcagatataaaactcagcacgctaacctgttagcgcagaattcagtgtcactgaacacacaatgtccagaacattctcatcttcccaaactgagcctgtccctgtgaaccactaactccccatctccttccccagcccctggcactcaccctccaactttctgtctccatggacttcgctactctagaagcttcgtatgactgggatggttcagtgctgagcttgtctcccgtgactggcttatttcacttggcataatatcctcaagggtcctccataggaggcctttgtagccagtgtcggttttccctcctgcctaagatggaacgatgctccctgatcgggatacaccacatttgccttcctcctgcaccggtgatggacacttaagctggccctttcacctgagaacacctgtccttccgtcagcctggctgcacctctaagccttccctactcatcagcctggcgggaacagtaggaatagccaccggccccccaccaaccatccttggcttcatcaagaaaatggacagctggctgtgctggctgggcagcttcctggcgtgccctcctggccagtcacctctgcaggtagcaggtgggctggcaggcacgagccagctaggacacggtgagtgatgactagatgtgtaggtgactgtgggcctcaccagagacctctgggcaggcaggggtgaggccagcaggcactgacagatgtggggcgtggagcctggtgtccaacttggctctgagagcccggtttatggcctaaggcagtggttttcaagcgggggaaacggtgccccccacaaaacacattcagccatgttgggagatatttttggttgtgacaacaacttgtgttgctactggcatcttgtgggtggagaccaaggaagctgctatacatcctacaaagcacaggacagtcccccacaacagagaattgctgagtcccaggtgccaccaatgccggggctgaccctgccctaaggctgagggcagccatcttggaaggcagcctgcagttctcgtggcagctggcacagagcaggacccatgcaaaccagagagctcctcactcagaagcttctgcacaccccgtgacagtggctagagggggtttactgcccaggatccacgctactcctctgtgcacgggccactgagtgcccagtagtgcctgggcaaatgctgagtggctgctgcatggcatggttgagttattgcagagaagttacaaaaacagactacatagtgagctgaccggtggccctcgaaagatatgtccatgcctttaacccctggcacctgccaatgtgaccttatttggaaacagcctctttgtagatataattaagttaaggatttcgagatgagatcatcctcggttactgaagtgggccctgaatccagtgacgggtgcccttatgagggatgagaagagagaggaggatgaggctgtgtgacgacagagacacaggttggcaccatgtggctagcagccaaggaataccgggagccccagagctggaggaggcaaggaaggaccctcccctagagcctagagggggctcatggctttgcccacaccttgattttggaattctggcctccgaactgtgagaaaatccatgtgtgtcgtttgcagcacagcccctggaggtgcatgtgggctgtgctcagccctgcttatgggacacggccatagcctcctgaccctcactgggcagggctctgggactctctccaacacctccactctaaccatcaggtccttcctggagcacaaacccaacagcccaggaaggttggcaaacgactcagaagtcatgtgggcctgagtggctactcctggaagctggttcccaaagaagcattttcacaagacaacctgatcacgcagcttcctgcctgtaccctggcggggtttccaatgggcctcctaactcccgggcaccatagcctcagtttccccactgccatgaagagaggcaggaaatgttcccaggggatttctctagtatctcaagggctgactgtccccccatctggagatctcagcaggaagggggcccccccgggaccgctgaccaatcccacaaatgagaacttgaacagagcaagcaggcgggtagaagggcaggggcggcatgcgctgggtgaggaggcagagccctcaaccggcctggcgtggggtggcggctgagctccccagggtaactgcatgtgcttttcatggaactggaactgcagtttgatggccgggcacctttcagatcagaggatgctctgttagagaaaggcacggaggagccacacacagtctgcgttgtgaaatgggtatttggttttcctctcctctactgacacatggctcctaaaatctcaggaccctccagagtgctgagtgtctttgtatgctagtgagatgactggtggctgggggtccctagatagcttcagaatgggggctggttaccaaaagaaccaatcccaagattagagggttggaattttccgccctgccctccagcctccagggaggagagagagaggctgaaggttgagtcgatcaccaatggccaatgattgaatcaatcatgtccgtgtaatgaaacttccataaaacccccaaaaggacagggtttggaggagtttctgaatagatgaacacgtggaggttccttgggggtggcgtgcctgggcagggcatcaaagctgcacgccttcccctgtacctcaccccacacatcactccatttgtaatatcctttataagaaaccggcaaacgtatttccctccattctgtgagctgctctagcaaattaattgaaccagagaagggcatcatgggaaccctgattcatagctggtcggtcagaggcacaggtcacaacctggggcttgttcttggcacctgcaaaggacgtggggcccatcttgtgggactgagcctcaccctatgggatcaacacactctccaggtgagcagtgcagaactgaattgaattaggggcacctgctggtgtccgagggaaccgattgcttgcttgctgtgtgtgggaaccccactcatctggccactgagggctctgtgtggattgcgttgagagagtatagtgggaagaaactgagtttgctttttcctatagcctcacagtccccccaaatttggcctcaacgagaggctgttagcagacacgttcccatttcttaaggcaactttccagaagtcaggaaacagcctatttggaaaacccaaccctgacctcccatcctgtgcctctccctggggatgacaggcccagttcaaatctccactctccacatgcaggagagagtcctggggccgcagaacctctccagccccggcctgcccactctgtgcctcagtgtcctcatctggaaaatgggccagtcccagcagctacggggaacatagctgttgtgaagataaaatgagcccccaaaggtggagccccacgcgtaggaccttccagaccagctgttagcaattgtcattgtttagcctggggtttggaggggggcaaggctactgcccctgtctgtccctgtgagacccggagcagctgcccgtgggagagtgactgacggatctcactgtgggccgtgcagtgtgtatggttcaccagggcccaaatccctgcccagggagaggcactcagcagggtcaggaggggccaccccgccctcaggtcacagtagacaccatcccatcccaacaccccctccctggcctggaccagcagatggacttgggaccaggagcggggtggccacctctgcagggacacaggtctttcatccggtaggcgacaaaaggggaggcccctgctgctgctgtgacctgaaaccgcagtctcactgcgacgacagaggcgagacctcagcccaccctcaggcttctgatgccacaaaggagcaaatgtcaccggggctgtcctgggcaaggcaccggtgtccccacccacaggtccttcagggattgcatcctctgagcccacgtgagcaccaaggacaccgtcgcgggaccacgtggggctgcggcctctggggatgggccagctgctgtgtctcctgctggggtggcggtggacctcgggagcttctctcacatgccaagcacgggcacaggatggcctcttggaagaggatgggccggtggcaagagcccaggccagggcaggcaagggccactggggcctgggaggggttgcgctctgattccccgatcaccaccccagtcctgccgtgggcgtctctttttgtctgagaatggatggaagtggctcctgcagtccctgggctcgcgctgtctgagctcctaatccggctggccggaggcagcgtcgcattgctaatcagctcctttgtgtgccagtctcgtcttcctgaccagctcccagctcctgcctgtctgcagctcctgctccagagacattcacggcccctgactcactgcagcctttgctggccctggggtggggctcccagggaggggctggccaagcaggggagtcagggcagctctgggaggccccgagccaccgcacgctctctcctggatggcgcccacctcagcgcccactgcagagctgagggtcctcacctcggggtcttggttttctcccctgagagcagctcagtgacagcaccgtctccctaaggccactgggacgggataattcacgcacaccctccgtacggcgcctgcacacggtaattgctcattaaacagctggtgttgtatttttttctgacaccaaatacatcattccaacatcaaccaattctctaatccctgccagctgggtgtcctactgctcagttcaattctgacagtacctcccagagtcagtgcagaccctgcgggcgaagggcccagtcccacaagactgccccagcctcggaggccagttgccaagaagtggctccccagatgacccacacttctgcctggctgactacgagtcagagctcccataacccttgctcaggtctgatatttgctagaaccattcacaatactcgggaacatgcatcacttatggcaaccagttgattatggaggctgcacctctgaacagcccacagggaagagaagctcggggcaaatggggggtgcagagcttccacacccccttgggtaccaccagcttggaacctcccaagcctggttgttttttataaatttatttatttaatttttttttttttttttttttgtagagatgggggtcacactatgctgcttaggctggtcttgaactcctgatctcaaggaatccgcccgcctcggcctcccaaagtgctggaatcacaggtgtgaaccactgcgcccagagttttaatggaggtttcaatacttaggtacagctgattaatcattggccaatggcaattgagctcaacctccagcccctcttcctgagccttctgcacctctagaatcatgtggttggtttttctggtgaccagcccctgccatcctgaagctatctagcctccgcctcccctaagtatcatctcattaacatataaaagacaggaaattcaagaggttttaagagttctgtgccaggaactagggacagagaccccaatgcatgcttttttattattccaagttgtcaagttgtcgagagtccagacaccttgcctcattggtcagtctttcctcaagatcgagaccctcccagcttccctgaccctcatgctacagcccagtcccattgaagcctccccctgccgactgggctggtgtagacccctggtgggccttggtgggagggtgtccactgccttgctggccttggcagatgctgggctgccccagtcccctccctgggaacaagggggaacaatgcatacacctccctgctggctctgggtgtctccagcgtgtcaggccctcgaggttcctccagctgcagaaccttctggggggcatcctgccttggccagctctgtgcttgccaagctatgattaagattctttgcttcaccagactccctggacttctcctgagtccatctgtgcgcttccgtatcaaatccaactttagcaagaactcccgaccctggatacctgatcaggccgctcacctcccacccccacctgggatgtctgctcaccccagcctgcctgcagcaagaatcccattaggtcagtttacccagaatctccctcacccttgatgcttccactcaggaattttccaccctctcactcccacccactcctgggccctaaatccccactagcccatgcagtattaggaactgagtcctatcccgtactaagtctcctccctattcaatattctgctactcccctaccgcaatagtcctggataaaaactgtatttattaacaacttttttttgagacagagtctcgctctgttgcccaggctggagtgcagtggtacaatatcggctcactgcaacctccacctcttgggttcaagcgattctcctgcctctgccttctgagtagctgggattacaggcacctgtcaccacacctggctaatttttgtgtttttagtagagatgccgtttcaccaagttggccaggctggtttcaaactcctgaccttgggtgatccacccacctcaccctcccaaaatgtagggattacacgcatgagccaccgcacctgtcctatcgctttaacttctgttcagctctagtcaccccacagcccagcacagagcaggtgcctgtaatcccagctggacagcgtgtctgagtatcaaacagctattcctcagtcttgaggaaggtacagatctgatttgaaaagaaaagcaacttctctgggacccccgcttgaatagctgacttgaaaggctgagctcttactctacgtaattgtcttccaagtgcaaattaactctgctaaaggaatccttggtccccataaccatttagacacaatcgagacagagaatttcaatgttcttggcaagcccctgcaagcccgaggctgagcttcatggcagcagagtgaagataagcttgttatcagctcactgagtttgaactagaaccggaaacatcctgtctccctgccagccacacagaatgccctagaaggctgtgggtgtggctggcatcagcatcctggcctggcctggtgcagccttctgggcaaaggaggcgctgacatatgtggcttgtactggacagatgtgggagccactgccctctcactccgccttccttcccaaggatggccggcaggggttgccagcatccgggtgggctgtgcccagacactggccacccctggagcaggcggctgctctccccactcagcggcccgctgcctgaaatagatgcttccagttttctcctgtgattttgatctttctgaaaagagcctctgacacagacgtgcacacacagccatctctaacaatcgatggatggctggatttcccttcctactgggactgccctgatcccaggtggggagactctgcttctagggctgcctagcccaagtcccatcccgtccacccgccacttccctgctcttgacctcagcccgtctcccgctgggctccgttctcagggcagcatctagagtttagtgggaggctggccggcgcctgtgcccggacatggagcccactctctgtccttccccttccagagtccccaaggatgagaacagaggctgtcactttctcccctaggaggcaggtgtggtctatgggagaggctgccctgcgcaagtgctgaaccctggctgttgggatcacgggttattgtgggttgaaaagtgttacccccaaacctatgtccatgtcctaacccccggagcctgtgagcgtgaccttatttgtaaacagggtctttgtagatgtaatcaagttaagatgaggtcactggggtacatcctaatccagtcattggtgttctcaaacaagaggacaatgtggacacgcatggtgggaaggaggccaggtgaacactgatgcagagatgggggctgctgctgcaagccaaggggtgctaggggttgccagcagccaccgggagcaggaagaagctggaggagtaggcaaggctcctcccccagggccttccgggaaagcatggccctgctgacatcccgacttcagactgctagcccccaaactgtcagagaccacgcctctgttgttctagccacagggtctgtgggacgctgtgacagcagccccaggaaatggattcccaggcacagctgtgcacacgggggcgctcgacgtgaaagctcatgctgaccacacaggccctgagaccatggtccgacttacgtaggtacttatcacaggctgcaagcaccgcagcccccagtgacctgtgcagcggaacaaaggattccacgccgactgagccaaaggcatcccttccagacatggatgaggtgcgggtcatttcaagtttcttctgcctctctcaccccaagcccacagtcacactggtccccctagtgaagggcccttaaaaataagctcccgatggccgagaaaggtgctcctctgtatttaggaaatggagctgcctgcttcctctttggtgatgggacatcgactaggacggcctcatgacatttgcgaagcgaggttgcttccgctgtcctctcctttggtgctcgaggcagtgtggccaggggcaggcgggggccgtggctcccctctcagaagctgggctcagctgggaagtgacccgaggtccccggccagggactggggagcttgagtgggacaccagggtcccagagctctgtccctgggatgggacgaatgtattaggacctcgaaggaatcttcagccctgttggaattcatgcctcttggaggtgagaccttttccacagacagttaacaccgacacaggtgctcgaggaaacagagctgcattttaggcgtgattctcaccatacctccatgtttgggtttttcaccaggcaaggggcttgcgaaagacacagcgaagctccggttcactcgcagccaccgcctctgggggacttggtgggctctctcctgctgggctctgtcagggctctgtccagtgctggccgaggcctccccatgtgcagggcactgccctgtagcctccccggtcccccagaaaaaccgcaccggcttggccaccaccccagaagccaggaagccaagagcagctcaggcctaccagctcccgccaggctcccctcttcctactcctgcctggggttcctgtatccctggaaagggaggcaccatcaacccaccccctctatgcccacccagcagcccaggtgttctgctgcagacccactcccggtagcacctctggaaggggacacatccctgccatgaacgacctcagcctccttacagccctttccccatgtcagttaggcagaggagaccctccctacctggagggtgggcaggagcacagctggtcttggagcagacgccacccctcccctgctggagcctgctgcatgcgtacccccaggtgggctggggcaggggatgctcttcggtttttggcaaatgctgcgttctacaccctggaccctgcttctcactataccagggtctttctattcaagactaaagtctagcccactgctactgctgctcagtgaaaatctcatctgctggatctgctggcgaggcctccgttcaggaggaaagaccacatccaaggggtcggctcgcatttggtcccggattcgcgtgggttggtgggctaagaactgagcgatgttgttagcgaaggtcccacgtgaaggagaaccctggggaggggcccggtggtgaagggggtataccctgtaggctcagcgcccaaacctcccttcagtcctgggccacggggctctcccaggcagtcagcgggtgaatctcagggcaggacaagctccaggagggcccagaggtggtggaaatgtgagtccagcctcagggcctccatggagcaggtctgagaaacatcgaggtgtggatggatggttatggagaggaacttgtctagcctcatgagcagacacgtgtggacccaaacagccacgctgcagtggtaaacgctctccaggaaggtccagggacactgagaaggcgatgcccctgagggccaagcggggagggccaaggggctggagtgccagcggaccccctcccaccccctccgagacctcatccctgtactttgctgggggcttcaccagggtctgcattttcacatgtgctcactctgcctgtgtctgctgcagcaaatgttctttttgagggagaaaacacatacagaaacttcccctggtgttgcctatgatgtggctctttcagcttcaaagatgtgtctgaggctctttcccgaggccttgagacggaggctggagcctctgctctgtgccctgcccgctgcccctccccctccctcccaccgcctcccccatctccacccggccagtctgaccctaagctgcgtggacggggagtggagctctacctcttaatttgtgggcagaattctcaaaacattcctaccacatgcagaatgtcacacctgactttcgccccagcatctgggctctgatggcgaccgcatgcctgttatctacccccggcctcggcagccccggtgtgatgcttgccatggcctgcattccaggcatggctgcttcctcaggctgactcagtggtttttttcactcaaattcccaagcctccactaagcaggagcatgaatagagctttaattctacaacgatgcgctagttacgtctttgtactaagacactaaaataaatatgctccatcaacatgaagcatagccctatatcccacttagcctcagctgtgggccccacctggggatgtggtgtctctgctcgtccacctggtccctggcctggagtgatgtgaaactcccgcaggcctggactctgggttctgtagcaggcacagtcaggagtgctgggctaggaccctgccgtatggccttgaggctggagggctggggagcgagactctctatgcgccaagcctgtgctgccagcttcccagcccgaggcacgggggagcccgtgggggtgtgagcttcctccctcctggggtctgtacattttattggagagcatggatgaaacttaaatgcgatgagtaattccaggcagtacccaagaccacgtttaccagtgacaatgcctgaggtcagggtgattcccaggagggctgcatggaggaggaggctttgacctcggctttgaagaataatatgagtaggtgaggtgacagttggaaggggcaaccggcatttcccaggtacagccaggctgcctgcgaacaaacgcacacaggcgagcagacagagtgggcctctcctgggaggagagaagctgagagaatgcctgggcgcctccagcccaggccaagcctcgggaggttgggactcctggtgcccagcagggccctggaacactcgtgcaccaagctcagggagatttatagctcaatttagttcctgtatgtcccatgtcacagcgagtcatttatcgagtgcttcaacttgacaacaactgaaaaattaatcccaacagcaagcgattaactctgcaaggggatcagatgtctcatttcccaggctctaatctccaggcattcgtctatgaagcgattcgtcactttctacccaagatgacacaggcagaggctgatcctgggcaagccgcgggccaccatgggctgcctctggggctcgtcgctgggcgtcattaaacctgtggctcgagggttctccgtggcgcagggggccagtgacggacacagcctggggtgcaagggagtcaccgtgtccagctgcatcgggacgttttccttacacacgtgtctcaggacggagggtgactctggtgcccacctgccctctaagctggacccagttccggaagcctctagtcgtcagcttgggctgccctaacagagcacagacagggcagcctaaaccacagacaggctggaggctgaggtctgagagcaacgtatctcagcgttggctcctcctgaggcctctctccttggatggccgccttcccccgtgtcctcatgtggtcatccctctgtgcatgtctgtgtccaaatcccctcttaaggacacagtgatatcggattaaggccccctctaatggcctcatttgactttaataatctcctttatttttttttgagacagagtcttgctctgtcaccaggctggagtgcagtggcgcgatctcgtctcactgcagtctctgtctcccaggttcaagcaattctgcctcagcctcctgagtagctgggactacagctgcccaccaccacgccaggctaattttttttgtaattttagtagagaaggggtttcaccatgttggtcaggctggtcttgaactcctgacctcaaatgcttcgcccacctcggcctcctaaagtgctgggattacaggcgtgagccaccgtgcccggcctgatcttaatcatctctttaaagaccctgtcttcaaatacagtcacattctgaagtactggggattggaacgctaatgcatggatttttgagggacacaactcagctgtgacgatccccagcagccccctgccatcctgactgccggtcccagctcctgtcctgacagctcagtcactggaacactcagccacgtgaggtgcaggagtgcagtgggacgcacgtcaattcagggtcaggagcctggcacccgggctctttcaccgagggccatgcgatcatcagcaagacgcttctcctctctgggggaacatgcagcagaacaagacaatgtcagaggtttgcttctgccctgccacttgagcttccagtgatgatctgcgtgacatagggttgaagtcaggatgtgtgatacatccctatattagttaacaccccctcagtgaataagagcccagtcacatcaggagtcactcctcatccaggtggggttgggataagctcacttgcaatgggtgattcaggggtccctgcgtgtgccgcagaagaggctacaggcctggtggacaggaagtcagcagcaatctgaataaagtcatgaaagagaactcgaaatggcctggggtcgctgaccggactggctgcaggaagtccccgctggggatgacaaccttgctttgccttctcctttgtggggagcagatggtaggaacagcctgtgctgataggggaggaactcccgagtccagcccctgtccccagaaaacacaacatctgcaaccctcccctcctgataagaaatcacaggcacctccttgaccctccaaccacttctagaacattccattcccctcctaagagcctggctttgatgagcccccaagggggtccagtctcagatggcctcaaaagtcaatgcgtgctcagatgatcacccacagtgcagcttcagggagggttccagagcggcctcttttccacctgttctgtcctctcggataatgggttccccttgtaatcctggattccaccatgagtcaaagcttgcaaggacctacctgatcttattttaacaaagactttatattttggaacatttttggatttacagaaaaattgcactgcacagaaagttcagagttcccagattccctctcctcccccctcccccaggttcctctgttagtaacaccttgcatgaatcggctgttatttgttgcaattaatgaaccgatactgacacattataattaactaaatccacagtcatcagagggttccttctgggcattgtatattcgttggttgtaactatctataacgccccgttcccccactccagtgccatacagaagagcgccactgcccaacaatggctgtgccccatctttcaccctccctgcccccaatccctggcaactgctgatttttcactatctccatttttttttttttttgagaatgtcatatacaggcacacctcacttcattgcacttcacgaacattgcattttttttttttttaacaaatcgaaggcctgcagccaccccacagagagtcagcccatcagcaccattttcccaacagcacgtgctcactttgcatctctgtgtcacatgttggataattctcacaatattccaaactttctgtctgttatcgtgatctgtgatctatactttttgatgctactattggatttttttgggggtgccgtaaaacacactcaaataagatggtgaatttaatcgataaatattgtgtgttctgactgctccaccgactgtccactcctccatctctctccctctgtgcaggcctccttactccctgagacacaacactattgaaatggggccagttaagaactctacaatggcctctaagtgttcaagtgaaaggaagcgtcacacatcattcactttaaatcaaaagctagaaacaattaagcttagtgaggaaggcatgttgaaagctgagacaggctgaaagctaggctttttgtgccaaagctagccaagttgtgaatgtaaaggaaaagatctagaaggaaattaaaagtgctactctgggctgggtggggcggctcacgcctgtaatgtcagcactttgggaggccaaggtgggaggatcacttgagccctcgagtttgagaccccatctatatgaaaaataacaaataaattagctggacatggtggcatgtgcttgtaggtcgcagctactccagaggctgaggcagtggatcacttcagtgcaggggtttgaggctgcagtgagctgtgaatatgccactgcattccagcctgggtgaaagagtgagaccctgtttcaaaagaacaacaacaacaaaaaagcgctactccagtgaacatacaaattatcagaaagtgaagcatcctcattgctgaaatggagaaagtttcagtggtctggatagaaaatcaagccggtcacaacattcccttaaaccaaagcctaatccacagcaaggccctaactctcttcaagtctatgaaggctgagagaggtgagtaagctgcagaacaaaagtctgaagctagcaagggtgattcatgaggttgaaggaaagaagccatatccataaaataaaagtgcgaggtgaaacagcaagtgctgatggagaagctgcagcaagttctccagaagatctagctgagatcactgataaaggtggctacactgaacaacaggttttcaatgtagcctgtttaggttagcttcttttgcttaatgatacggatttaagtttcctccatatattttgtgactcaatacacctcatttcttttttatgcctcgatagccatttcttttcattgctgaatacttttccattgtctgaatatatcacagtttgtttgaccactcacctactgaaggacatccaggctacatccagtttttggcaataaagctgctataagcacttaacgtgcagcctgatcacatttattttctctctgtctctttctttctttctctctctctctctctctctctctctctagctttcctttatttttttgtcttgctctgttgcccaggctgggttgccaggatgcaggcacagttcactgtagcctcaaactcctgggctcaagtgatcctcctgccttagcctcctgactagctgggactacagggacccaccgccatgcccagctaatttttttcttttttttttttttttcttgagacagggtctcactctgtcacccaggctggagtgcagtggtgtgaaatcagctcattgtagtctcagcctcccaggatcaagtaattctcctgcctcagcctcctgagtatctgggattacaggcatgtgctaccacgtccagctaatttttgtatttttagtagagatggggtttctccatgttgaccaggctggtctctaactcctggcctcaagtgatccgcccgccttggcctcctaaagtgagccatcgctcctggcctcattttttctcattttaaattttttttggtagagatggggtcttgctgtgttgcccaggctggtctccaattcctgggctgaagtgatcctcctgcccttggcctcccaaggtgctgggattataggcatgagtcaccacacctaggcgagcctgactgtatttttacaaagccagggccataaatgtagtggcattgctggtgtgactcagaaggacccaaccacttccatatttcaagtgctcaccacataccaggcattgcactaaaagcctcattcattcattcattcattcattcattcattcattcacctcttcactcaatatttaccaagtgcctcctagatgcaggctgtgtcctgggtgctgggaatgaagctatcaactggcctcaggatctcacgaattacagacaaaaagcaagcaagcaaacagatgatcacatgtgagttccagggcggggactgaacccaggccagcccaccctgaggctcttgctgctaaccaccacctcctcctaagaagggactcacatggagggcgttccatatggaagcttccagacagatgttctggatgctcagcagtgggggaggagcccagatggagttggcagtcctggctctgaggctggatgtgacccttgggaggctcattccagagcttgatgtcggtcttgctgctaaagccgggagcagggagcaggctggcagcaccgcggggccagggcaagagctgacagtggggcctgggggagctgtgggtggggggccctcacagctgtgtcctccaagattcccacagtctggaaggacaagcagaaagccccctgacctgggctttcctgtgcaaaggcccaagtggttccggagatccccagtgatcccgaggaggctgggcctgcacgtttccaacggacaagcggctttcttcatgcacacagctgcccagtgcatctgagcccacctggaccctgcagctgggctttctgcagccacagctcccaggcgtgccgagccggggctgagtcactgctactatttgaacactttccccttcaaaatgacagtctttggcaaatatgttaaataccaattgagaacaaatgccaccaggaactctgatcatccttcatctgctgagcaaggaaatgccaggggagaagggagaggaggcgagaccgtgagggggcccggggtccatgctctctggctgttccgtggcaggggtccagctgcccaccaaggaggcctgggtctttctggggattctcggagaggttctttctatctggaggtgtgcgagggggagccccctggccccccgactggaggctcattcacctgcccactggggcttcggtaggagcgtcaggccatgggcttgtgggcttgatgtcatgtgggggacacctgtacctgccctctggacaatgccacgggagctctcagcaggaagggagcagccggcttccccctgcgtcagcatcgggctcagcccattcggcgtgcacgacccagcccagtcgtgcctgtcaccgccacagagctggccttcaagacagtgcctggacagagcttcggagctcaggctggagccagcctgccagggttccaagcctggatctgccagctctcacttggatggtcttagacaagtggcttacctctctgtgcctcagtttcctcgtctgtaacacagaggcaagatcagtgctcccccatggggatgctagctgggaggccacgtggggaggtagtcagtccagggcctgatgcaccttgggcccctgagttttgcagagagccagattctacacttgggcactgggtgagtgaaccgaaagagacaggactgtgcacacctgagcgggaggcgaccagaaagacacactgacggcccagagcgcagggatgaggcagctacaggagagcacaggagggctccggcttcctggaggacgtgaaagaaaacagcagcacagctgctgcatggagagaaagcagcccccgttggagtcggcctgcagcgcgtctgcacacggaagagagatgtgctcggggcaatgtgcacacacacgcctcttaataacgatttcctcatttcggagactcttaataacaattttctcatttcacagacgctatatttttttttccaagatggagactctttctgtcatccaggctggagtgcagtggtgtgatctcggctcactgcaacctctgcctccagggttcaagctattctcctgccttagcctcctgagtcgctgggattacaggcacctgccaccacacccggctaattttttgtatttttagtagagatggggtttcaccatgttggccaggctggtcttgaactcctgacctcaagtgatccacctgcctcggcctctcaaagtgctggcattacaggcgtgagccatcacacccggcccatagaccctattttttttagaacacttttagctttaccaaaagaaaccaatgcagagagcgttcagagagtttccacacaccacgcttctttttctcacacaaatagcaacacagttaacagtctgtctgctcctggcttttttcacctcaaatcacttactcgggagatcattccctagcaggacccccagagccgcctcagctttctgacagtggcacggcactcctcacactgggcgctccatagcttacctggcccgcgctttcctggggacacacctggacaagtagagctgtgggatccagtcctgttagcacagaggctgggccagagggcatctgcatcgatcattttcataggaattgatgagctgtcctccaaggaggacgtgcatcgtaacctctccccaaaacagaagacggtgcgccctgcccagtcccctcctgcccaaatggtagatgatcagactccaaaaaaagagccctcacacaaaacagccctttcctcttcctgccccagaccacccatattctggggggttgctttatttatttatttatttattttgagacagagtctcactctgttgcccaggctggagcacagtggcgtgatctcagctcactgcagcttccgcctcccgggttcaagtgattctcctgcctcaccctcccaagtagctgggattacgggcacacaccaccacgccaagctaatttttggatttttagtagagatagggttttggcatgttgaccaggctggtctcgaactcctgacctcaagtgacctgcccgcctcagactcccaaagtgcttggattacaggcgtgagccaccgtgctcggcttggggttgtatttcaagtggagcagaatgtcctggatcctctggacaccccggtgagtaattctatatactagcaaaaaatgatcacaaacagaaattcgaaaatacctctaccatatcttcaaaaaatacaaactaggaataaatagaacaaaagatgtgccaagacctgtatagcaaaagcattaaacatggctgagagaaatggaagatctcaataaatggagaggttttagatcatgtggcaggagactgaatctctcccaactggatctatggactcaatgtaattcctgtcacatccccagtagggttttttttttttttttttttttttttggtagaaaaggacaagctgattgtaaaattcatgggaaatgcaaaatatctagagtaagcaaaacaactgtaaaaaaggacaaagttggaggactaacttgacctgattccaagactttttttcgtttgtttttttttttgagactgggtcttgctctgtcacccaggctggagcgcagtggcacgatctcggctcactgtgacctccaactcccgggttcaagcgattctcctgcctcagcctcctgagcagatgggattacaggcacccaccaccacacccagctagtttttgtatttttagtagagatgggtttcaccatgttgaaccaggctggtctcaaactcctcaagtgattcgcctgcctcggcctcccaaagtgccgggattacaggcgtgagccacggtgcccggcccacttactataaagatacagtaatcaagacagtggcaccaagctagacaaatagataatggaagagaaaagagagcgcagagatagccccacacacacacgaagaacgggtttttgataaagggcaaaggcaattcaacagagtaggaatctgcaggattcttcctctctcatttctgctgttggctatgtgtgtcttctcttttctccttctggatcagcctggctagaggtttctatttttttgagacatggtctcactccgtcacccaggctggagtgcactggtgtgatcatagctcactgcagcctctacctctgaggctcaatcaatcttcctgcctcagcctcttgagtaactgggactacaggcatgtgccaccacgcacagctaatttttgtatttcagtagagacaaggttttgccatgttgcccgggctggtctcaaactcctgagctcaagtgatcgcccagcttggcctcccaaagtgcatcgattttctcgacgttgccaaagaaccaacttttggttgctccattttccttgtttttctattttctatgtcattgattgctgtgagcttaatcacttcttctgcttgcttgttgttgttgttgctgagacagggtcttactctgttgcccagactggagtgccgtggtgcaatcatagctcactgtagcttcaaacttctgggctcaagtgatgttcccacttcagccttcagagtagccaggactgcagacgtgcaccgtcacacccagctagtttttaactttttgtagagatggcagggggggtctcactatgttgcccaggctggtcttgaactccttgcctcaggtgatcctcccatcttggtctcctaaagtgttgggattacaggagtgagccaccacacttagccttactttggttttaatttgctcttttccttttagcttctaaaggtagaagctgaagcagtgatctgaggcctttcttcttttctagtatagatattttgtgccagaaatgttcccttacagacactttagaggcattccacacattttgatatgttgtactttcattttcatttggttccaatattttctaatttcccatttgatttctactttgatcccggtgttatttaaaataatactatttactttcctaatatctgggggattttctagagatctttctcttactggtttctaatacgattccgttttggttagagctcacatctgtatgacttgaatagttccaaatttattgagacttgttttatggactaaaatatggtttatcttaataacccttccaagtacacttgaaaacaaagcacagaggattctttccacaactgtcagttaagtcaagctggttgatgggtttgttcatggtttcctatatcccggctgactttctgtacacttccatcagttacagaaggagaagtgattatacttgtagttttatttatttttccttgcaggtctattttttgcttcatgtattttgaggctctgttattaggtacatacatgtttagtgtttttaatgtccttccatagaactgacccttttaccataatgaaataaccttctttaatactgttaacattctttgttctaaaatctattttgatactaatatcgtcatcccagttttctttggattagtgttaatgtggtatatgcctttccaccttcttacttttaactcttttgtgtctttataattaaagcgagtgctccttggaggtgagcatttattcaacttgaagaatctgcccttaaaataagggtgtttatatcgtctgcatttaatatgtgattattgataggaagtttaactctgtcctctttccattttgcttttcatttgtcccttgtatattttgcccacccccgccaattctctcattttctgccttcttttgggttgataatttgtttgtttgtttgttttgagacagagtctcgctctgtcactaaggtggagtgcagtggcacgatctcggctcactgcaacctccaccacctgggttcaagcgattctcctgcctcagcctcctgaacagctgggattacaggcacccaccaccgcgcctggctaatttttgtatttttagtagagaggggtttcaccatgttggccagcatggtctcgatctcttgatctcgtgatccgcccaccctggcctcccaaagtgctgggattacaggtgtgagccactgtgcctggccgggttgataattttttatgattccattttatttcctctgtcaccttatcagctattattctttgttttgttatttcagcagttgctttagaatttatatttatagtagacacccttaacttatcactgctgatgttctaccacttcgtgtacaatacaagaacttacaacagtacacttccactcttcccctcctagactttgtgccattgttgtcacacctacgatctttccatgtcgtaatccccaagctacatttattcttctgtttaaagacagttatctttcgaaagaattaaacaaaacaaattttacatatatagccatgcagctaagtccttccttccttggtgtatttccatctgtggtcacttttttttttttttttgagatggagttttgcttttgttgcccaggctagagtgcaatggtgtgatcttggctcaccgcaacctccgcctcctggattcaagtgattctcctgcctcagcctcctgagtagttggcattacaggtgcatgccaccacacctggctaattttgtatttttagtagagatggggtttctccatgttggccaggctggtcttgaactcccgaccccaggcactgtctttttatctgaaagacaacctttcatattctttatagtgtacctgctggtgatgaatgattaaaccttttgtatttttcaaaagtattttacctttgttgaaataattctgtttgaattatgttgaaataactctgttgaataattctgttttttcttctctttcaatactgtaaaggtatttgtccacgatctgctcactggcattgcttctgacactatgcctgctgtcatctttctctttcgtcttcatgtgtcacgtgtccttttatccccatgtggctgcttttaacatatttgtccttatctctaatttggagcaatttgaatcctatgtgcctgggtgtgtttttgtttctttttctctcatgtgtcttgtgcttggagtctattgagctgcttgggtgtgtgagttcattgtttacttcaaatttggaaaaagttccctcattatttcttcaaatatttttcttttcttttctttttttttttttttgagatggagtctcaccctgttgcccaggctggagtgcagtggtgcgatctcagctcattgcaacctccgcctcctgggttcaagagattctcctgactcagtctcccaaatagctgggattacaggcacccaccaccatgcccagccaacttttcatatttttagtagagatggggtttcaccgtgttggccaggctggtctcgaactcctgacctcaactgatctgcccgcctcagcctcccaaagtgctgggattacaggcatgagccaccgcacccagccttcaagtattttttctcccctccccctacaatcgccccctcttcagggactctacttacatgtatattgggctgttggaagctatcttgcagctcactgactgatgttcttttaaaaagaattctttttttttctctgtgtttcactcaggatagtttctattgagacttctctgagttcactattactttataacatttaatctaccctcgatctcatcctgtgtatccgtcatctcagacactgtggttttcatcactggaagtttgatttgggttaaaatgtaaagaactgctttatgctaaaatatatacaacaaaatttatcatattaaccatttaaaaatggacattccagtgggctttcaaaatatcttctgtgtctacatttaactttttggacatatggaatacagttttaatgattcttttaatatccttgtctgctaactctaacatcggtgttaatccccagtcaattttgataatggatttttctcttccttacgggctgtattttcctgcttctttgcaagactgggaatttctgaatggatgccagacatcatgaattgtacttgttgggggcgctgggtagttctgtatcctggtcttgagctttgttctgggtgtagttaagtcacctggaagcagtttcatccatccatccatccatccatccatccatccatttatttatttttgagatgaagtcttgctctgctgccaaggctggagtgcagtggtgcgatctcggctcaccgcaacctccgcctcccaggttcaagcaattcttcctgcctcagcctcccgaatagctgggattacaggcgcgtgccaccatgcccggctaatttttgtatttttgtagtagagatgggatttcaccatgttagccaggttggtcttgaactactgaccttgtgatccacccacctcggcctccgaaagcactgggattacaggcgtgagccaccacgcctggcctcaatgtcttcaatgtggatgttcttccagtctctgcctgagttccctctccctgccccacagcctggaaacgctcagtgcaagaagctggggcaagtatagggctcatcccatctgtttctcatgctttagtgatcactatcatttattacctggtgtctggttgtaaaacctattactttatatattttatcttttctttcagttgtttcatgaggaaaggtaaatccagtttctgtttctccatcttggccacaagtagaagttggagcagaagtaggcattattattattattttttttaattttcaagttccttttctaatggaaaatcgcaaacataaagcaatgtaaagagtaatactgtattagtctgttttcacgctgccgataaagatatacctaagactgggtaatttatgtagaaaaaaaggtttaatggactcatagttccacatggctggggaggcctcacaatcatggcagaagggaaagggcatgttctacatggcagcaggcaagagagaatgggagccaagagaaaggggtttccccttataaaatcatcagatctcatgagacttgttcactactatgagaacagtatgggggagaatgaccccatgattcagttatctcccactgggtccctcccacaacacatgggaatcatgggagctacaattcaagatgagatttgggtggggacaaagccaagccatatcaaataccatgatgagctccatggtctaccctgaagcttctgccatcgtccatctcatcgcattatttttaataagacaaagaccacacttccctgactttacaccacctcacttctcagggatgctgttaagagttgaccccaaatgggagtggaaaagtgacactgcaccctcgcaggacagggatactcccctcatcaaatccagggctgggaccacagtccccagtccccaggctcattcgcagaagcatggctcccactgtctgaaccgcaacatggttgccaagactttccactctgagtccttctgaagtttgcagtcacaattgacaagatatgggtgacattgatcctgaaaaggaagaaattctggtgtttctaagagtgaaatttaccccaccctgcccttcccctcccgtgtttgatggtgagtgtgccccgagcagctatcctggcttgcacagatactaccagagcagacaagggtgattaacaagtaattcatttagtctccatcataaccacttagcaatccatttcctctctatttcctgttcagagacctttggatatgccaatctgaataattgattggagcagaaaagcctcatgcctttgaagtccctcattaattacctggacaggaagaaggaagaatctctactcagccacaaagcggctaaacacgatcaaagaaaccatacccggctttgatggttccctccgttagccagaggcaccatttcccctcgaggctggaggaatgcttctggaaccctctgagctgctgctgaatgccaccaccattgttatcgggtggtgccaccatctactctaagttaaacacaccgggctatgattgatggagaggtgtctgcagagcatctgttatgaagctgtgattggctaaattgtgtccctcttaactcctatgctgaagacctaacctccggtactcaagggtgtgactctatatggagacagggcctgtagagaggtaattaagttaaaaggacatcatgaggatgagccttaatcccggctgactggtgtccttataagagctggagatgaggccgggcgtggtggctcatgcctataatcctagcactttgggaggccgaggtgggtggatcacgaggtcaggagtttgagaccagcctggccaaaatggtgaaatcccgtctctactgaaaatacaaaaattagccgggtgtggtggcgggtgcctataatcccagatactcgggaggctgaggcaggagaattgcttgaacccaggaagtggaggttgcagtgagccaaggtcgcactactgcactccagcctgggtgacagagcaagactcttgtctcacaaaagaaaaaaaaaaaaagaactggagatgaggacacagacacacatagacagacgactacgggaggacccagggagaaggcagcgcctacaagccatggaaggaagacccagaccctgagacaccttgatcttggacttctggactccagaactgtgagagtcaacgtctactgtcccagccaccctgtctgtggtgctttgctggggcagcccgaactaagacagatgccacaccctggaatagctgcagggctgggagggaagctgcagacaccctatgtatttgtccaacccaaacacgtcaaatggactgagctattcaaaccaaaactcagcgaggagacgggcaacaaaagagttaatggggagacaggatgtgaaatgggtctgggccatcagctgatggccagtactggaggctgggtgcaaaactgccgtgaggccagcagcggggtggtggagtctggctccgatcctgcctgcaatggatccagtgaaagggtcagggcaaagcttccaacaaggataacctagaaagcaggcccgcaggcagctgtagctgcagcctcttccgcgagacttaagctgaggaggctggagccagggatccttcgaggggcggcgccgtctccagcaccaggaagaatcttcacttcctcttcgaaaccgccctggaagtgagcttagggacagagctcaggcaaggcagtgcctcactcggtgggtgaagcctccttgcctctctcacagctccctgaaagctccttgcagagaacttctctgtttaataacctcggaaaagcattaaaagcgagtctgaagaactcatttaatggattcttggaggcggctgcaatcctcggagctccgtgaagctggggaacttattcttggtggagcctccagctggagagaaactgtttgaatttccccaaagccaattcgagttgttgttccttctgggaggatacatctcccagcacctcccctctcccatgtgggcagcggattcctgccccccccgcccacttcctcccggccgggagctgttcttttcagcaaagccacgagtagcaggcaggggcgccccaggccaggcatggtccgtctggaagaagccaggttcagggagcaattctgcaagataaaccaccctctggagggtgtggctccaagactttgattctttgagccaccatggctagacagccccctccttcctttctgacagaggacttgagcccttggcaccgcaacccagctgtttatagatggctgagaagcctgcctgtgtccagcaagagtgcagctgtgtggccagtggactcagcatccacgtccgagggactgctcacgttctctgaagatgttcaaggctgcccatgtgccctttccccgttttcaggcatgcagcatgcaggccccactcctgccgctggacttacagtgaacggagccaggaaagcgaatctgccttgacttgtcctggattctgcaggaaggccccacctgaaccacctcagtcccacagagagggggatcctctgtcctctcagggccaatcggactgaggacagtcccaaacccccgggccatcccgagcctaagtgtgtagtgaccccaggggaggctggtggctaagccatgccgctggggtcctggggggtcaggctcgggagcgtctggggtgatcctgctcatgcgcctcatggacgcatcttgccccggtttccaggtgcggtggagcggggagctccggggctggcagagtgagcagggcctgggtcctgagggagaaggcggctcgtaggctgctgtgctgggcagagggtggatggcggggttgaccaacgatgaggccccaggaagagaggcatgggtggcgctgccggccgcttccccatcttacctctgctggtgccgcagccctctcctttctgtggcccctccccacgtggaggataccgaggaggttaggacagccctcgggctcaggagtgcccagtgacccagtcctggccaatcaggggttcccgtttcccaggccacagtgattggttgagggatggtcatccaggccaatcagaatcctgcctgggtttttcctctacatctactggggaagatgctctcctgtccctggggggctgtgatgctggcagatgtgtgagcacggagggggttcctcagcccgggaaaaggctgaggccggcacaaagaagcaagggcaggaggtcagtacgaggagacggggacgacggtacagagcaagacagagacactcaccgagacagagacacagagacatagagagagagagagaagggagtgagagacagagacaggcccccagcaccattgtggactcctgcctccagctgttgagtctccccctgcacattattcacctatgaaacttgagctgttcggttgggcctcataagctgtcgctacctgactgttttttgacctataaaaatggcagcttcacaaggcttgaccgaatgacaagagggaacttctgtggcttgccgccgagagtcctggagaaagtaggtttggctggcggccacgccgacccgcaggagtcctgcccctttgaagcccttccctcttttagatctgccgggtttacaaggggcccaggtcgctcccgttcttgatgattaattttctaaaactggtatttctaattcctgatggtagaacttcaggccccagcgcctccctagggtgcacgcgtgggtgcccctgacccaggatggatactgtctggctctctttaggagctgtggtcaaaggtacccctgcttgctgcaggaccaggaccggggtcccactgccaggctccccagggaggccttgccctgaaaggggccctgggcagcccgagctgtgaactcctcctttggacagggctagctcctcacctgctctgctgcaggcccgggtctgcctccacagctgcggcctccagtggtgtgtgtgggctgcagcttcagacagggtcaccctccaggatcactgcagcccagctggctccatgagagggagtgccaaggggctggaggatgtgggtgtactggagtggggagtggggagtggggaatggggtgtcatagaccgaggccctctgggaatcaatgcccactcacacccggggcccacacccaccagggcctcacactgagctccctgtggagctatgggtgcagttccagggacatacactgcttgtcacccaactggaaatatgggtggggctctgagagtggacagtttcataaatcttgtagttatcttgtgcataacataactatgctgcatcttgggggtcaaagcactcctgtgcggtggtgttcatgggtgttagcatttctttcttctgaagcaatccaggaggctcagaaaaccacagcagctgggtcctggaggcggattctagggaatgactctccctggcttcccccaaggcctctctgaccctgtccagcctctcccccactccctggaggtcaggagtgtccactctggggtcaaggctgggctctgcatctgcacccgtgtttgtgactctccattgccctgcagaagatggcatttaatcctccccgctgcgggccaaggacagtgttgtgagcatgaagtaagcatcaaataccttgtgggtattcaccttagaggctgagtgacttccggtgatccacagcccgaaaatggaagggcagagaatcaacgccaggctctcggctaggccactgggcccagccaggccttctgcagagaaagggcatggcagcaggtcctggatacttggataccatcgtgctactttttctttgaaataaaatgttcattttccagtataaaagtctagatgctacccccaccatgtgccccaccccagcaatagctggctgagctggagtggtcccctgaccccacaggctaatacagtggccttgggtctagggaggagaggtgagctgagcctagcaaattctgtccttggggcagaaccaggggatccaggtgtctgtgcagggagctcagttggaggcccctacaggcaagggctgaggtcgatactggaggagtcggcaaaggagggtggtgcgtgcagggagaagtgatgaaccctgaggagagggaggggtgcggcatcagggggccccaaggaggagtggagacgaggggagagggaactggaaagcgagagaggaggaggaggggtagggctgggtgctgtgggctgaatgtccatgtctctgcaacattcctgggttggaccctaacctccaatggcatggtgttgggggtgaggcctctgggaggagactgagcccttgtgatgggatcggtagccttataaaagggaccccagagagctcgcttccactttctccctctgccacttgagcacagcgtgagaaggcggccatctccacaccagggacaggccctcgccagaatccggccctgccggcatcctattctcaggcttcagcctccagaactgggagaaaatcaacccctgttgggttttgagacggagtctcactctgtcgcccaggctggagtgcagtggcacgatctcggctcactgcaacgtccacctcccaggttcaagggattctcctgcctcagcctcctgagtagctgggattacaggtccccaccaccatacccggctaatttttgcatttttagtagagatggggttttgccatgttggccaggctggtcttgaactcctgacctcaagtgatcctcctgtctcggcctcccaaagtgctcgaattacagccgtgagccaccatgcctggtcacccctgctgttttgaagcccctccatctagggtattttgccctagtggatttagctgactcagacagaagggaagggaaggaaactaagggaggagagagaagagggaaacaaggagagaaagcccctctgttccccacaacattccacttccggcttcacagaagacacagggatggttggcaagaataagaaaagaggcccaacatcaggggtctccagggaaatgtgagctaaagtcacaatgagacgccacctcacactgttccaaatgaaaaagacggcacacaccaagtgccggcgaggcccaggagaggctgacccgccacacgtggctggcagggatgcaagatggtgaggctgctttggaagaccgcttggccgtctctcaaacttacacatccatctatcacgtgacccaggctttcctcttctgagtatccaagagaaatgaaggcacctaactaccccaagtctagtgcatggacattcacagcaactttatgcgtggtaggtcggagtggctgcaaccaaacgcccatcgatcgtgactggtcaccaaattgtgggccatcgacatgatgacggcccatcactcggcaacgcgaaggaacggactgccggaacacacacgcctcagaataatcacactgcctgagaggaaccaacccaaaaaatagcttcagtcgcgtgactccattttatgtgatgttctagagggtgcaggctgctgtgatgtgacggagctgggcggtcactgcagcggtgggggcggggcagggctgtgatgtgagctgggtggtcactgcagcggtgggggcgggggggctgtgatggagctgggtggtcactccagcggtggggggggggggcgggggcaggagcaagccggctggtggatggacttgtcaccttgaccttggcgatggtttcccaagaatacacacgtgaaaacttatagaattgcacactttaaatatgtgaacttgactggacattgattatgccccaataaagtttttaaaaagtgtatcatgatatgaccgataccacaggagaggttgccccatgtgtctgtgtgtgtgggggcggggggggggtggggcatggcatttgatataaagaaaataggagttactgggaccaagacatgaagatgaccccagtggcccctcctacattgaccagatcaagcttcaggttctgggagagagctggagtccacatcccacgcaagcccctggctgcccctgagggtgaggaggggaaacggggcgccagccgatgccccaagcccccaaccccacacctcacttcagccaacggccacttttatgttctgtctgacttagagtatgcaaagtacttctcacaccgaagacttcaaggcacacttaccatcctggtgacagcggaacccgctgggggccctgaaaggcctgggctgatgatgtggtcttgggctccacaccctgccccaggggcggatggcgctatgccagtttctctccagccaccaagacccatgcacctggcccccagcccgggtccttctccaaacatggacacttctcaggaagtctgatctcctcctaccagcgccgagggatggccaagcccccagcatggtgctgatggagaactcggccagttcctcttgtctatgaccacagggctcacagcactcatggcggcccctgcccaatctctcttagaccctgcctcagtttaccctgctgatcaatctccagatgggccgacacagactgcggaggtgtggcccaaagccagcccatgcttgtttggggcctttcttctgagcttccccacactccccacagcctgctgggaactcataccacagggcactaaattccccaccttccccactgggagaggcaacatcagggtagggggtgggggtctttggaggcaggagaacaggctggcttgatgcctgcttctgctccatcccagcactgcaactgtgactgatcacctaatgtctcccattcattcattcagtcattctttcactcattcatctgactctggggccatggctcctcccattttcacacatttgcactttgccaggggacttctagtgactgtccctttgcccatgggggtggcgtgccctgaagggtcccctccccttctctgactctgcatgcagccctggctccaccacggagcaggaagagaaggaggggctggctctgatgggatccaccctgtgcactggggaccaggccgttctgcagcatggagcacagaccgggggtctcagtctatgaactgggggattaggtcacatgtttgctgtagtgcgaggacacccaggacatggaagcccctctgaaaccattatggttggcagccttacaaaactctgaccccaaacctcgctgcccggcaagctttctttgctttccttccccatcctcttcattttgccatgatacccggaggctgagcagagaggccccgctatgagtcccatctgtccttcaggccctgcccaaccatccccatccccacactcacacacaggaagccacacacacaaagggcacatttctgtttcaaagccttcattgcagctgatcctctgcggtgcattcaagctgggccctccttgctccctgctctgggtggggacaaggacatcacactgagtgggaaggacactggggtccaggccaagccacccaggcgggcagcagaggaatggtcacccaacggtgactgtcaaagtacaaaggccagccggatgtggtagttcacgcctgtaatcccagtactttgggaggccaaggtgggcggatcacctgaggtcaggagattgagaccagcctggccaaaatggcaaaaacccatctctactaaaaatacacacacaaaaaatcagctgggcatggtggtgggtgcctgtaatcccagctactcaggaggctgagtcaggagaattgcttgaacccgggaggcagaggttgcagtgagctgagattgtgccactgcactccagccagggcaacaaattgagactctgcctcaaaaaaaaaagaaagtacaaaggccaacagagtcagccccaaagcggggacacagagtcccctggggtggggaggagacaccaggcttttctttatcattccctctgcctccacctttggtgtttccacatgtgttttgcaatgtgtgagcgctttacagactgcaagtaagtcgacactcaggtggtgggtggggggcgcaggatgagatgtgtggagactctagggctgtgaggtggctgctgactggcttctgcatagcccccgcccgtggtgggtgatggggtggcaaacttggggggcgtgggctggatagggtggaggatgctgagctcctgtgaggttcctcggagctaggctggggccctggtaggttttaattccttacggcagaatcccctgggccgtgctgcagcctggcagtgtcaggggctcagtaattatttgttggtggagacacctgagcattgagagtcaggaatgagcttcggtgtgctgcatgtcccatttcccagagtggaaatgtgttcccccctctccccacaaggagagcatttcacgggcttaaattttggcagacagactcttggaatctgagcaccaggccatttgtgtctacggggaactacctgtccctcagcacttcttacaagccctttgttgtcacaggtgctgggatgcagacgaggaaaggagaggctgggggtacagacacggaagctgcaggtgaagatgtggtgcagagccctcctgcgagggacagcaagcggctgcggcagaccccatgcacctcctggggagagagccgtgccagtggggagcactggacttagagtcaaaaaacccacactcatgcctgtaatcccagcactttgggaggccgaggcgggcagatcacgaggtcaggagatcgagaccatcctggctaacatggtgaaaccctgtctctactaaaaacaatacaaaatattagccaggcgtggtggtgggtgcctgcagtcccagctactggggaggctgaggcaggagaatggcatgaacccgggaggcggagcttgcagtgagccgagatcttgccactgcactgcagcctcggcgacagagcgagactccatctcaaaaaacaaacaaacaaacaaaaaaccccacactcccaggcctaactctgcccttaccagcctgaagaagctacctggctctcccagggcctccgtttccccatcagtaagactgggatgcccagggctgctgtgaggcaacgaaagcccctgcaaacaggtttcatcatacccttatccctcacttttctcccctactaaatagggcagtagtgctgccaactctgagggactgtgaggggggccatgagtcagcaacaaggacacagcaggcaggtggtaaatgcctggtgagtgctggtggctctctagaaataatgagtatcacgcagttagcggaaggggtggccaggacactgtgggagcccaggagagcgcccgtcctgcacctgccacggaggccacgccgctgtctccctccctggggatgagctcccccagtgtccccagccccacatcaccagacgccagcctcttccctcagtctggatacagtgacacagacgtgacaccgtggagcccagacagccccaggaggactcgtgatccccgtggggtgagaggaaggaagagtgactcagagctgcatttttctggaaagcatgataagggatcatcagtgtcaaaaccccgagctccaggcaggggccatgatttctccagtgaccccaagaccaccaggaatgacccaaccatgtggagagtgaggagggccgtggccacgcctgtctccttggtggagccacttcatggcacccacggaccacgagacatctctgggctggggaaagtcacatgattccctgagcctcaattccactgcaaatggggaccaaaagccacaggcgggtttgcagaattgagccaggtaacaggcgtggggtcctggccagtgaccacccccaggcccacaggcactgctgctactccttttgcaggggaatcatcctttcctgatgtgcacaaaatagatgaggcaacagattgatttgaggggccaggactggtttcccacccaggcccacccccacctgagcattcaggcactggactcgtggctccctgccctggctgcactgtaccccacagccaggtgggctgataaacggaggtaaactgtgggtcaccattcctgtgttacagtcccgacccccacaacctcagaacgtgactgtatttgcagatagggccttgaaagagctgattaaattaaaatgaggccattagggtgggccctgacctagtaggactggtgtcctttaaggagatgaggacactgacacactggtggggatgacctgtgaggggacagggagaaggcagctgaatgcgagcccaggagagaggcctcaggaggaaccagccctgttccatcttgatctcccattccagcctccagaatgtgagcccaccaacgtcccgtgtaagccgcccagtctgtggggcgttgtggtcagcctgagctgactcagacacacgaagacacactgacttagtgcggtgccatggcatctcatacactgtactctcgccattgcacagacagggaagcggcctacagatacggcgcctgtccaaggtaggactcgaatcccggcaggatgcctgcagggcacactgtacttcccagaaccacaacaggctgcaagaaacagagactcctgctcccccaagacaggaggaacgcagattgcttttgaacttttattccagccccgcaagagtgggtttcaggaatggcaccttccctgctcacctgaggatggtgatgttgttggcacagaaggcgaggtctcagggggacaggcgcatcacgacgcacagccttcccatcctggaccacagcattgcacggcccaagagctcgtggccacgacgggctccggaggcccacatccttcatttgcaccattctggtactgacagtggttcctcccctgtggagtagacagcgtgtccccgagaaggtggggggccctgggccacgtctcacaggcagaaccttcatctcacaccatcatgaaccagccaggtgcgtgacctcatgcttggtgtcatcgaatctgctaatttacatgaaatggagcaacaggatggcccatggaagattttagcccagttcagagataaccaagagattggttttcttctcaaagggggatgattgctctttccttggaaatgttacttattcatgatggtttagatgtcggggatgcaatgagcccagagaccatctgccgggtcactctcagctcttccctggcctccccacaggatgggcggcctccccttacagcgcattcccacacacctcagcaccagccgggcgaccccatccaccctctgcccagctgttgctgaataaagggacgtgggaacctgaacacagaggagcatgaatgcaggtgagaacgaggcctgtgctggatccaggggagtagaaacacagggctgcacaccctaggccctactctgatttattaaattaggtcttgctcagtctccaggtccagctcacccctggcaaggtggccaagggcatggatgcatccccagtccaaccctgccctgtgctgggcgtggggcatcatatttctcaagaaaatcatttccagccagtgagctcactgggctaccttagcaactacatgaaacacagatcaaagtccctcataggagcatgaagtgtccctgaaaaggcccagctgtgggacaggacaatggtggctgcctctgaggacagccagaagaggctgcagctggcactacatcccttcccttccttctgcccagaaagtggcgcttgcaggccaccccataaggcaaagcccagtcttgggtgatggtatgaatgtaagacaggcatggatgaggctgggccccaggtggcatctcccaggcctgggcggtgatggcatgaatgtaagacaggcatggatggagctgggccccaggtggtgtctcccgggcctgggccggatcccaggacccccggtgtccccgggacctgtcctgtgcaggtcagcctgctgtggtcagcaaagccacggctgcaagatgtctacgccctaatccctgggacctgtgtgaccataagccgcaaaagggactttgcagatgtgatgaagacctggagatggccctgatgttcagcgtcatcacaagcgtcctgataagtggaggaggagccgggaggagcagagctggagaggtgaggatggaagcagaagttggagggatacgctgttggctggagatggaggaccacaagccaaggaacacaggcggcctctagaaggtggaaaaggcaaggaaacaggctctcctggagcctccagcagaaaccagccctgaccacaccttgactttaggccagtgagccctgcattggacttctggctttcacaacgctaagataataaacacgtgttgctggaagccaccaggttcgtggtgacttgctgccaatgcctcagccacgggaagtgcacagctgacttctacaaggctgagaacatcagaaagccgtggacatccaccaggctgctgcgaagggacactttgcagaccagcccctcccttttggtcattaataaacaggggcgtggggtggctgggctgaggcacagcgcagccttactggctacattttgcaactgaagaccctgtaatgagccacaaggtgagagctcagccctgtaccccaaatggccccagtgtccagggggccaccagcagggtgtctctgaacatccctttgtcactgcagaccgtgccagcctccagaatgctcaatcgcgtcccttaccctcctgcaggatgaaattggaccgccaatgagcggcgtgggcctgcagcctgggctgctggggacccggccttgtctgggcagtctgggtctgctcggtgttgccagaagaaattgtgggcacctggtggcacccacgggggctcaagatgaaggaggagggagtggtgttttgccaggaccaaggacagcgccgtggcactggctcagcggttacaggagccacttcctcccactcttcaggcctgaggccgcttccccgctgctggctgcccagccagagccagggctggggcaggcgggaacagcgaggccagcaggccacgggccacatcttcatgccaccctgagaccacaaagcctgtgctgctctcaaagtctggagccagtttggctggggggaccctggggggctcacctcctgttccctctgtgggtcccaggatgctgcagcacacacgtgtgggtatacaccccacactcctctgtcactctgccctgacctggagcccaccaggtccaggggctctcaaagttctggctcttccccgtcatcagcacctaagtgttcgtcactgcgaggccttctgaggagccaccagggaggggggatgccagatctaggggcaagaggcacctggaccaagaatagattaaggttcagggcactcccttctccagaaatcaccatgaggatctccatcagggacgacggcaaaagtaagtctagcgtttgaagggcaagggaagaaaagctcttgtagtcactgaaataaaaccacaaacctgactggctgttccagtaccttaggaaaggcctctgccttcctcaaagatggcatcttcctatctgaatggtatattttgtgttacattaaggttgttggtgcttcagtttttgttactgttttttttttacttctcaccaacaccataactcactgtactttaaagctagctaggccaggtacagtggctcatgcctgtaatcccagccctttgggaggctgaagatggcagatcactcgaggttgggagtttgagaccagtctggccaatatggcgaaaccccatctctactaaaaatacaaaaattaaccgggcgtggtggcacgtgcctgtaatcccagctactcgggaggctgaggcaggagaatcacttgaacccgggaggcggaggttgcaatgagctgagatcgtgccactgcactccagcctgggtgaccgagcgagactctgtcaatcaatcaatcaatcaatcaatcaagctagctagctgaaggcaaagactgaagttggggcctggtgcacacagcagcattccatgagtatagagagtccagccctggaactggaggaactcaccccaagcctcactctgccagctctgagctgtgtgagcggtatggcccctgggaagccacttaatctctttggactatgatttaatgtcctgtagagcaaagctcctgatctcctctcttgggcacacgagggttggggccgtaaatgtttgccagctctgccccgagcctcatgcccacagaggccatcctgcctcccctaggagctgctggtcaatgggaggggacagatcccgggccaggtccagtctcctttccctgccgaagagctgaggccagaggaggggttggcctggggagacagcagacagacccagggcggagagtccaaggtgccatcagtcagagaaggccttgcaaagaaagcagagaggggctccaccccagggggccaatgccgccatcctcatgatgagaaggggcctggcattggcaccagctgaaaggaccacctaactgtccccacacatccggggcctccaagccgctaactctactactgctgactgaatgccgtggaggccgccagccccggccggatccaattagctcatgcacacatctgcaagtgacgggagggctgggttgagatgctctctgctaggcctgctcggcagatgggacccactcagcttccctgtggagtccctgagccagtgtgtccctctgagctccctatagaggcggcaggcagcagatataagctcaggtccatatctgaccagtgcgtgcaggctaggcagcgggaggatacgcaaacctctcccctcgttcactgagggtggccctggagcgatgggccttcacaggtcctggtgggcacccagtcgggtgtggggatgcagggtctcacttccgatgctgtcggggtccctgaaggggccttatcccagagatgacagccgaaaacacagcgtgtcacaggcagcatctgtgtgtgctatggtggtgttctagaagctggcggagcttcagaaccacctggggggctttagacaaatgtagaccctgggccctctccctggtgatctgagtcagtcagtctgggctggggatgggggtggggtgtgcgtgtctgatgagcaggaccctcaggtgttggtgaggtctgagaagccccaggaatcactggcagggtctgctgtgcagctcactctcctgaggcttgcagcaggctcgtggggccagggtgctgccctgtggctgggggtgcagctcagcactctgacagccacatggagcgggggacagagggaagattgggggagaatctgcatggtgcctggccctggggcaggggcactgggctgtggctgagaacatgtaagggagttacggaggccagagcggggatgccttcatctatctacgggctcaggtatggctccaaagatgggggattcccaggctgactccagaaggcctagcagcatgtccccaactgatgcaagaggtgggaggaggccttgctggcagagggagcatgtggcgagaaggtgacctggagggcaagggtacagggccaggatagagccagaagatccagccgcagaacaggggccagcgtgtggcagcagcatccacagtgccctgatcttcggggctgtggcacaggcagagggagtccagtcctgccctgtgcctacagcacagcaagtgctcggtgaatactggcaggtgcgattttcatgagctctgattcttgcaaggggctggctgacttctggctccaaggagggcagtgccaggaaagcgcagctaaatgccagctgcccagatggcacggaaaacatgcactccgggtcatcgaatcccaaattcactggggttgagccccctccatcttgagtggctcaggataaaatctggagcctgtccactccacgctcactgtcaggagcctcctaatgaaccatcgaggctgtgtgtcccttctgcagtcttttgtccacccagtggccagaacgatcctccgcaacccaacaagatctcaccatcaccccacggtataacgtctgcgggctgcccgctcctcacaggtaaaagccagcatggcccagtggcccacaggttcccacggcctggcccagccatgcctcccctctctcccttgccactctctgcagcttgctcagcccagctgcacagccctcctgcttccctctaacctctgggcatggcctgaccaccgtgcatgactctgcagccaccgcgagcatgctcctcaaggtctcatccccggccgacccccagagccattcaattatcggccgtgatggctgcctgtgactcgggtctacctgccagcgctttggctccactctgcccttggttggcccctgatgtgtccccagctctgagagtggggcctggatcaagggcacacttgcgggtctggtgagtccgaaggtaggaggtagttactaagccaggcatcctggcgctcgaatcacatgcagggctgagtctgtgttccgatcccgtgtgacaggcctatcatctgtgtcttttattttctctttctgatgctctggcatccagggttttgctgaccctggagggatggcccctcaagaatcaggcaattcctagagaaagtaaacagctcacctgagagctggattttcaaatgctaaccaactaaaacagaggccaccccacccctcctctatccgggtcccatgctcccagccactaaccctgcccccatcaccccagggctgggtaccggacagccagggacaggccctaggccccagagctctgaaatgattccagctgccaacgctaaacccacttacactgcctacttagtctgctccttcctgcagaaatcatggtaaagctcctgtccacatttcccccctctccctctgcctcctaatggaccttgtgcttccctgaatggcccccaaggcatggcctcccctacctcctgggaagagtgagttagcagctgtccccctgatccgttggtctcgccatacctgaataataataaaacctacattttaaaacactgcggtacacaggacctgcctgacaaaggatccaggaaagcaagtccctgaaggcaattgttttgtgtcattccactacatgttctgaaaagagtggcagtgctggcacggtctggtgcatgctggtgcctgagatcgtcagcggagacgcagaggcctaagggctggaggacaagcccctgagctccgtggctaccaccccaggggcttggatgcactggattttgtgtgtgggggcatggtgaataccgcctcgcagcccctctgagctggcacagctcaggccacagcacgcccactctggctcaagggaaatggtgccaggctctgggccctgggagaccgcctgactcgagggtgggctcctgatcacaggtggtccatccactggctggcaggggctaaagccaagagctgatgcaaagggcactgccaatggggcagggatgaccagtagagccagctggatgggctgatttttgaagcagagaatttgggaccagtgacaatagaacagactggcagagtggggcagggacagcatgagggaggaatggggaagcagccagtcggtaaagctgccccaggtcctcacagctctaagtcccaggccacactgccctgcaatactctccaatttcacctggcatttaacacaaattgaccagaatcattccctgttctttgttcctaataaggacaggcttgcttttatccagacatccattcatccatccacccgcccacccactcattcattcatccatgtattcacccatccatccatctctcttttcatgtatccatctacccatctatccctccatccattcatccacccaccccactacccactcatctatccatttgcctacccattcacccactcattcgtccatccaactagccatccatccatccatccatccatgcattcacccatcctctatccatccatccacttaactacccaaccactcatctatccatttgctcacccacccacccacccacccatgcatttgtccatccaattagccatccatccatccatgcatccacccatcctccccccatccatccatccacccatccttcatccattcctccatccatccatccatccaacagctatctgaactgtttaatgacaacctcccatagggagacagctgggaaaaagaccgattcaaccctgaccttgtggagtttgcaacctgcaagtgacaactgaacaagtagccacgagtgtggtgaagtttcttggagaatcgcacaggtgcctgccctgggttgtgtaacatggtggaggctattctaattagggggaaggtcagggaaggcttctctaggatgtaactgtcaggactgaatgtcgcccaggagtcagcaagggagagaggagtgcttgaggaaagagagctgtgaggtgggcagtgggggcagatcaggaagatgggaatggggtgcctcctcagggaccctctggaagaatctttaaaagctgggcacaaggatcacttgcgccttagaaggcttgctgggggcaggaggggcaggtgcgaatgagggaggttctggggccggggtcacctattggcttctcttaaggcgtggccggggctagtggcaaggagggccccaaggtgctgcatagcttgtcactcagagctgggcagcctggacacactactcttcacagagacctcggaagctaactccgaggcggcccctgcatggctggccaaggggcacatgctgggacgcagactctcagtacagatcgccagcctctggcaccgttgctgtggaaaccaactggcaatgagaaatttagcaatttgaaaaaagcatttccttcccttatttatatctcttgacccttatcctaggggaatggcgagggaagcacggctcgcagctggagccgggagtgggcaggtgtctcgagggtaccgctccccggaacggggaaggacaccagtacctcacccccccagagtgggcagagcctagagacgccatcccagaatacgtcactcctgggaaagatgaaaataatgcagaaaaggcaaagtctccctcttccctcccccacctcactcctctcccagagacgacctcaaacgtcactccgaagattgttattcgaggtcattctccatgcaccgctgggcacatgcaggaatacagacacatgccagtgctcttgttgaacaaaatggggtcacactctagcccatggctcctctgcagcccactccctttgctgagggcctgtgttgctctcccgaccacaacactagggttgttgcgtcacttccactgccgtacagagttccacggcgagctgggccgggctttatgaaagcagttctctcagatgtccagggatgccacgccacatgaatcaccaagaaatgaagcaatgcacttgccagtccctcctctaaatgctttctctaaaggcagcctggccaacaggacccctaactagacaggccctaatggggcagaggggagaagcggggagagcgatctggagaaaggagcctgtcgcggcaccacgggtacatctgtaaacatgagagtcagggaaaaacgaaattggtctggggcattctacgcagccatcaaaggcatggatgacagtgcttaccgacaggaaaaaatattccccacatgttcagaaaaaaagggtaggttacaaaatggtatggaacagcgagtccgacattcagagaaaaggtataaaaaagatgcagaggcatatcttgttttattaccccttgctttattgtgctttggggatactgcatttgttacaaactgaaggtttatggcaacccattgttgagcacgtccagttttttttttttttttttttttaagagatggggtcttgctctgtcacccaggctggagtacagtggcgagatcacagctcactgcagcctcaaactcttggcctcaagtgaacctcccaccttggcctccccaagtgctgggattctgggtgtgagccactgtgcctggcctgaggcaagtaaatctgttggtgccatttttccaatagcatgtgctcacttcatgtctctgtgtcacattttgacaattcttgtaacatttcaaactttttcagtattatgatatctgtcatggtgatctgagatgactgatctttgatgcttctattgtaattgttttggggtgccatgaactgtacccatataagacagagaaattaactgataaatgttgtgtgttctgactgatctatcaactggctggtccatcgtctcttcccatctccttgggcctccctattccctgagacacaacaatatagaaattaggctgattatagctcttatttcacatgccaagggaataaaaaaagaaataaggccaattaatgatcacacaatggcctctaactgctcaagtgaaaggaagagtcactcatctttcactttggatcaaaaactagaaatgattaggcttagtgaggaaggcatgtcaaaagctgagataggctgaaagctgagacagtcctcttgcaccagtttagccaagctgtgaatacaaagaaaaagctcttgaaagaaattaaaagtgttactgcagtgaacacacaactgataagaaactggaacaaccatatcactgatatggagaaagttttaactggtttggatagaaaatcaaattgtccacaacattcccttaagccaaagcctaatctagagcaaggccctaactctctgcaattctatgaagactgaagagctgaggaagttgcaggaaaaaagttggaagctagcaacttccatcaagtttaagaaaagaagctgtgttctgtaacgtaaacacgcaaggcaaagtagcaagtcttgatggagaagctgcagcaagttctccagaggatctagttaacttcattgatgaaggtggctacactaaacaacagattttcaattgagacaagacatccttctttttttgagatggagtcgcgctctgtcgcccaggctggagtgcagtggtgcggtctcagctcactgcaagctccgcctcccgggttcatgccattctcctgcctcagcctcccgagtagctgggactacaggcgcccgccaccacacccacataattttttgtatttttagtagagacggggtttcactgtgttagccaggatggtctcgatctcctgacctcatgacccttccacctcggcctcccaaagtgctgggattacaggcgtgagccactgcgcccggccaagacagccttctattggaagaagatgccatctaggattttcatagctagagaggagaaatcgatgtctggtttcaaagattcaaaggacaggctgactcccttgtgaggggctagtacagctggtgactttaagttgaagctggtactcatttcccattctgaaaatcctagggccttaggaattatgtgaaacctactctgcttgtgctctataaatggatcaacaaagcctggatgacagcatatctgtttacagcatggctatttacagcatgaatattttaagcccattgttgagatttactgctcagaaaaaagagattccattccaaatgttactgctcatggacaatgaacctggtcacccaaggtctctgctggagatgtaaaaggaaattaatgctgttatgcctgctgacccaacagtcacttacagtctatggatcaaggaataattttgactttcaagcctcatatttaagaaacacattttgtaaggctatagctgccataaatagtgattcctctgacggatctcggcaaagtcaattgaaaaccttctggaaaggattcaccattctagatggcattaggaacatttgtgattcatgggaggaggccagtatgtcaacatgagcaggagttgagaagaagttgatcccatccctcatggatggctttgaggggtgcaggggaagaggtcactgcagatgtggtggaaacagcagaagaactagaattcgaagtggagctggccgggcacggtggctcacgcctgtaatcccagcactttgggaggccgaggcaggaggatcacgaggttaggagatcaagaccatcctggctaacacagtgaaaccccgtctctactaaaaatacaaaaaaaattagccaggcgcggtggcgggcgcctgtagttccagctactcgggaggctgaggcaggagaacggcgtgaacctgggaggtggagcttgcagtgagctgagatcagagattgcgtcactgcactccagcctgggcaacagagggagactctgtctaaacaaacaaacaaacaaacaaaaacagaagtggagctgaagatgggacttaaacgctgcaatctcatgagaaacttgaatggatgaggagttgcttcttagggacaagcaaagaaagtgatttctcgagatggaatctactcctggtaaagatgctgtgaacattgttaaaatgataacaaaggattgagaatattccataagcctagttgataaagcagcagcagggtttcagagaaaagactccaattctgagaatttctgctgtgggtaaaatgctatcaaacagcattgcatgctacagagacacctttcatgaaaggaaaagtcaattgatgtggtaaacttcattgttgtcttattttcagaaattgccacagtcaccccagccttcggcaaccaccgctctcatcagtcagcagccatcaacattgaagtgagactctccaacagcaaaattatgatgactcgccgaaggctctgatgattgctagcatttctcagcaataaggtattttaaattaagatatgcacactgcttagacatgatgctattgcacacttaacagactacaggataaacataacttttctatgcactgggaaaccaaaaaaaaaaaaaagtgtgcatctcgctttaatgtggtatttgctttcctgtggtggtctggggctgaacccacaaatatccccaggtcggcctgtgcagaaaacaagagctgagagtcatcctggagttaacgaggctcctcttggggccaaggctttcatgcctggcagattcattgcttataattagtatccctctccccagtagatgttatcttttaaaaaaggaaaagacaaagaaatggagggaaagggaaggtctacaaatgggtcagaaaaaggaaggtagagaccaggcatggtggctcacgtttgtcatcccagcactttgggaggccgaggtgggcggatcactggacctcacttgaggtcaggagttcgagaccaacctggccaacatggtgaaaccctgtctctactgaaaatacaaaaattagctgggtgcggtggtgagtgcctgggatcccagctactagggagattgaggcaggagaatcgcttgaatctgggaggcagaggttgcagtgagcagagatcatgccactgcactccagtatgggctacagagacagactctgtctcaaacaaaaagaaaaagaaaaagaaaaagaaaaaaaagaaaaaagaaggtagaaaagaaagaaccaaaagatagaagaaggagccggaatccacagagccaatctgtgcagataaattacaggagtaagcgcattgccctggactcaaacgctgtcaacttctggagatacaacatttgcttttcttaaaaaagaaaaagaaaaagaaaaaaaaagcaacatcatagctccatttttgtcttctccaaggaaacataacacatttcaacaacttaaaaagggacaggaagaccatgtgaaaacatcctgaaatagtgttttctctcaagggcagacctgagctacactgatctcctgaaacattttttaaaatgcagagatgtgggccgggcgcggtggctcacacctgtaatcccagcactttgggaggccaaggagggtggatcacttgaggttaggagttcgagaccagcctggccaaaagggtgaaacctcatctctactaaaaatacaaaaaaatgaggtgggtgtggtggtgtgtgcctgaagtcccagctactcgggaggctgaggcaggagaaccgctgaaaccgggaggccgaggttgcagtgagctgagatggcaccatccaagatcgcgccatcgcactccagtctgggcgatagagcgagactccgtctaaaaaaaaaataaataaataaaaaataaaaataataaaaaataacaagcagaggtgtggagactacatttaaacagggcatgcaggaagcccagtccctgtcaagcctctaatactctcctgtggctcaggctgtgaattgatgtgtgctgaccgccggcctcctcactctacctgctccgtcttccctctgcacgcaggggacaggggaaagacagaggcagctgtcgctggtcccccaggggacagccagggcaggtgaggactgggtcctgcctggggaggctggcactgtctttgggtcagtccgagaggagatgcagtctgctcccactcggagtgagaggcaggacttctgctgactcgggtggagcttccacgcaggcttttgggtgggacgtggccaccaatctgatgcagccaacacagactcaagcagcacacacccagctctgcatcccagcacaccccctccagccacggccaggggagtctttctgaaggccgtgcggcatctcggtggccccccttctgcccaaggcgggtcttgggcagcctctgtccctctgtctgcaccccccgttgagggcaaatgtgtgcagccctggtcctggcctgcttcacctcttagaacaagggctgtgtggttaggccaactccctcctccagccccctcccatttcggcccatcatctaagcaacagtggctgcgtctgcccttttgctatggcccaaggcagctgcggattcccatccatgctccttcagccctgcagccatgtccctctgcatgcaccttcagggacccgatgtccagcagagggacacccagacatccccacctcgcctggggtagcactcagggtttccagcctcctcggccctgcccccaggcctgtcacctacgtgatgcaaccccaagatgtccagcaaaccctcgccgaaaggagggactcacgaagggagcctgcagctatcggaggggtgggtcccagccctggcctcgcatgaaaaacttcccacgtctgtctggccccatagttcggggaaggcctgtggctgcccctgctgcctgtcaaagtcctcccagcaccatttccaacatgaacgcacactgtcccagcacgcgtaggactttggtggcatttttggctaggtgtagctcctctacttattatattctataatttctcagcagtctccacgcagttctgagaactcttgctgcattgagaaaaatctaacctacagcctgtttttaaatgaatgttgcatttaacagtgaatgaaggtaggatatagtaattaaatatttactaatctgaacattcttgctgcctttttttattctggggctgtgaaatgttgtttctagatctggatcctggaatgctcaagagctcttacaccaaagtggtcctggaggaggctggtgctgtttcatcagactcagcctcagtttccccacctgggcatggtggctacctcgcctgcctgccccacgggacgtctgagcaggtgtgtcagaaaatactagagtggcaggaaggcacctcccacacctacaacacccccagggagctctgtccacaaccaactcctgttgagtgaatgaacggagtgaagagtgagctaaagggcattcagtgtcaggaggcctggggcagggttgggcaggttacattcctgactttgtgggcaaacggagtgtccaccttctcgagtgacaaggactccaatctggatccctttggcctcagctggagggacctatgcaactgttatcattagttccttcgttcgttcgttcattcattcattcattcattcaatgaattgctacagtccagatgctgttctaggctctggtgatacaatagtgactgatgcacatgtgggacctgctggtgtcagatgctgagtgaacccacgtggagggtgtgaggaagggatacaagtgccagggaggggcttgcagaaagaagggtggaccagatgtcctccagggcctcttcctaggcactgccgtgttggagctgcccgattcgtaaatcgctgcttgctcacatcaattctttaaaattttattgtgcctcagctgactttataaacaatgcccatccacagatgaatgagtcaacagttgtggtctacccacaccattggatatgattcggccacaaaaaggaccgcagctttgacatgccggggcgtgggggatgctcagcgacttcatgccaaacacgaaagatcgcgttacgtgagtccacacacggttgcccttggtgcactctggagatcggtcccaggaccccagcacagacccaaatccaagaatattcaaaagtcacacagttggccctgaggaacccacgtatatgaaaagccagcctcctttctacgtggggtgggttctgcattccacgaatactgtatttttgacccatgtttggttggaaaaaatctgcatgaagtcaacccaaggagcttgagtatcaacagtatatgaaaagcctggaatagacacacttttagaggagaagtagcttggtggttgccaggctgagggcgggcaggggcaatggggctcaggtgcttactgggtccagggtttcattctaaggtgaggaaaatgactgggaactggataaaagttgtggtggaacaacaccgtgaacctcgaaatgtcactgattatacacactgagtgaatgaatggagtgaagagtgagctaatgggcattcgttgcccatcacctaagcaacagtggctgcgtctgccctttcgctatggcccaaggcagctgcggattcccacccatgctcctccagccctgcagcccatgcccctctgcatgcaccttcagggaccccatgttcgtggttcattttacctcagtaaaatttcaaaaaaagtgaccctgaacaaatgatgagagaagggcttcagggccgggagccgggagccgggtctctctgagcccatttcctggcaggcttcacatctgggtgggcctcattcttcctcattccccaaggtggtttctgcagcctgcagggccccccacctctcagccctcacctgccaatgggcccaaggcttgctctctgccagggtacaagaaaaacccaggctggcccctcacatcggccaccggatggagtggggggtggccctccaggcagctttggccaggagggcagtttgaagggtgcagcccggccgtccaccccgaccccctctcaggaagccccggtgccagtgccaccctccaagcgccccctcgcagccagccgaggccgctgcgtttgttaaaaatacgcagcaccatctgcagcaacttggaatttaataaatttatttataaagcgactgaggcttcttttaaagtcgagtttttatccctgagatgaggctcctgaggcctatgaggctcacccagcttggctcactctctctgaaaaccacacgctggcccagacaaccctctgcgaaggcgacggtgaactgtggcctggagcccagcctacagcccctgtcacaggagaggtgagggaaagttgagaaccacagggcttccacggctcaggttcccctggaccgtgttgaatggcatctgcccaaaattcgtgtctacccacaaggggcttgccagcccttccccagctgctgggaggccccaccgccccgggtagcgggggaagattgaggctcacccagaagtggacttcaccaggaaatgactcagagagacccagctcccagccacaaaacccttctctcaaactgcggattgtggcctgatttggacacggggtctttgcagatttagttaaggtaaggtcatgctggattagggtaggactttattccagcgactggtgtccttgtgagagaaaacagagcggggtttcagtcgcaaacacagaggagaacatcgtgaggatgaagcagagattgcggtgaccacctccacgccaaggcatcaggggcacctcgccaggatacgggaaaggcaagaaggcccctccccaagagcctccagagggagtccacccagctgacaccttggtttcagaattctggcctctagagctgcaggaggatcaatctctgcggtgctgagctgtcctgcgtgtggtgatttgtttggcagcccaggcgagcccccttccccgcctgctctgtggggcacctgggccagggctgggccagagcccggacgcttcccagtgccatggtgcctcctgctgacttcaattcccacaggcagacctggcgcctgggaaccaagaggggaggggcatgggcaccagttccggaaggagccacaggcaccaggcagagaaactgtccagggtatttccaagggacaggccagggtgggtggggcaaagggaaagagctctgaggaccccctacccgggttctagggttctggggttggaaggggcatcagggtcctggtctgggacccacccccaccaggccttgctatgccaagaggactgcaggactttcctgaagtagaaaccactgagggcagaatcctgatgcgggggggcggcaggcccagcagggcaactgccaggacagcagggccagtgcagcgcagggactggtggctgccccttccctcaggccttccttccttcctgccttccctgggctgctgcaaggctcaccttctagaccacaacagtccactctctccggggtcacgggcactttggtggggtacactcaggggctgtctggagctgtgctctcccccagtgtgaggaatcatcgaggcttctcggaggaggagagaacagaggacagtgcgtcgggctgtggcacaacatgggcacaggcttggaggcaaggggcctttcccatgactgaggtctcctatggtctatatctattttgcaagcgcagacatcctcagatcctatgaacaaagctgcatacttgtgcaccggtgctcgggggtgactggtctatatctgttttgcaagcgcagacatcctcagaccctatgaacaaagctgaataattgtgcaccggtgctcagggggtgactgttccctccagactcaggggcgcagcagcacagaggagcaggtttcgcacaaaatgggcacaaggtcactgagcccatgattactcctggcactcatgccaggctcagcacccgccgccaggggaaactcctccctgtccctcattctctctccacccactgccccccgcctttgagctactcccttccactacccaggcaccccataataactgtggagatgccaagaagcagcaagtacttagtagacacaggaaacctggaggagccctgggaaggggttgcctctttgccacaccatggatttggggctcacagggaaagccccctgagaggcggccagtggagctggcggcggtaagataagagggtagagaggatagagagggtagagaggatagagagggtagagaggataagagatttttctttacctggcaaagtcctcatgggacttctgagcaggcatatcagaaaataccagagtgatgggccgggtgcagtggctcacgcctgtaatcccagcactttgggaggccgaggtgggtggatcacctgaggtcaggagttcaagaccagtctggccaacatggcgaaacctcatccctactaaaaatacaaaaattagctgggcagaatggtgggcacctgtaatcccagctacttgggaggctgaggcaggaaaattgcttgaacccaggaagcggaggttgcggtgagctgagatcgcaccactgcactcgagcctgtgcgacaaagcaagactccatctcaaaacaaccaaccaaccaaccaacaccagagtggcaggatccagaccccttcagaccccacctgagatgcaacccctgagagaggccttgcgggcacccctgcaccaaccaagtctgacagcagctcctggaagctgtgcttcgtctctgcacagcacacagggcaatgctgtccgctaactgcccctctggacactcaggggtggagtgggctgcagaactctggccatgcgctggagtccagagccagcaggggaacgtgccgtagacagggtcccatagaggggcagatggagcccgtttgcagctgcaggcgatggggcgggacgaatgactgaggtcatttgtcgaatgacctcagggccacacaagttgggctggagagaagggtattggaaggtggagaagaatagaggaagaggctggaaatggaggcttggcagggagcccttgactatctgggaaggagctgaaaatggatctgaagttagcacaaatgacacaagaaaaaataaaaactcgaagagttctgtaaccttgaaagagattgaaccagaagttgcaaatcctttcataaagaaaacatgaggcccagatggctttctgagcagggtcaagccatcgcagaaggaacacataattctaacccgaacaatgtcttctggagaaaaagagagaacactccccagcttcttgggagactggcaagagcttgactccggttggaaaagaatggcctcagaaaggaaaattacagacaaatctcactcatgaccttggatgcaaaaatcctaaacacaatattagcaaatggaatttggcaacatattaaaaagattactacatcatgacaagtcgggtttatcttaggaagctaagactgatctaacagaaacatcaattaatacaattcattagcaaagaaaagccatgtaatttttgcaagtgatacaaaaaaggacttgaggaaattaattatccgcttgcaattaaataaaaatctcttgcacactaggaaaagaataaaatactttaacctgataagctgcatgtcaaaaaaaaaaaaaaaagactagagtcaacagaaattttgaaagcttttttttttttaaagatcaagaacaaagcaggtattcccactattcccacttctattcagcattttattgcaggtcctagctagcggagaaaaaaagagaaaggaagaaaaaagataatcagtcgataaaagatgagaattaataagagaattcagcaaagtggctggataaaataaaaatcaatataccaaagccagccatatttctacatttcagcaagaatcagcaaatgcaattctgaaaaatatatcatgaagtgacatcagtgaaactacctaggaataaatctaaaaaaggttttgcagaagctctttgtggagatacttaaaaaaccagtttgaaagagaaatgtaggcagggcgcagtggctcacatctgtaatcccagcactttgggaggccgaggcgggcggatcatgaggtcaggagatcgagaccatcctggctaacacggtgaaaccccgtctctactaaaaatacagaaaattagccgggcgaggtggcgggcgcctgtagtcccagctactcgggaggctgaggcaggagaatggcgtgaaccccagggggcggagcctgcagtgagccgagattgcgccactgcactccagcctgggcgacagcgagactccgtctcaaaaaaaaaaaaaaaaaaaaaaaaaaaaaaaaaaaaattggctgggtgtggtggcgggcacctgtatttccagctactcaggaggctaaggcaggagaattgtttgaacctgggaggaagaggttgcagtgagttgagattgtgccattgcactccagcccgggttacagtgtgagattctgaaagaagaaaagaaaagaaagaagagggagaaggaaggaaggaaggaaggaaggagagaacgaaagaaagaaataaaaagaaagaaagaaagaaagaaagaaaaagaaagaaagaaagagaaagaaagaaagaaagaaagaaagaaagaaagaaagaaagaaagaaagaaagaaagaaagaaagaaaatgtatcatgttcttgaacaggaagacaacattgtgaaggggttaatttttcccaaattggtctattctgggtcaatgcaattctaaccaaaatcccaatagggtttgttgttgctgttttgttttggtgtaacttgataagctgattggaaaatacatatggagcaggcacggtggctcacacctgtaatcccagccatttgagaggctgaggcgggtggatcacttgaggtcaggagtttgagaccaacctgaacaacatggcgaaaccctgtctctactaagaacacaaaaattagccgggcgcggtggtgcaaacctgtaatcccagctactcaggaggctgaggcatgagaattgcttgaacctgggaggcggaggtgtcagtgagccgagattgcgccactgcactccagcctgggtgacagagcaggactctgtctcaaaaaaaaaaaaaaaaaaagaaaagaaaaagaaaaagaaaaaaagaagaaaaagaaagaaaatgcatatggaaatgtaaagagccaacgattgctcaaataatcctgaagagataaaaggtgggtgggttgggggtgaaggggagaaatattcagaggtaatgaaggtggtgctcagatagacaaatggaccaacggacagccacaccacagacctgcatccatgtggaagtttggtttatgacgcctccagcacggaagatcttggagaaaagtgttttattccaccaatgctgctggaaggatggggtgtcctcaggggaaaaagtgaaattagatccatgcctcacataacacacacacatacacacacaatctgaattcttggattaaggacttacatatgaaagacaaactttaaactcctggaaaataagattgggaaacagctttacaaactcttgggagaagataatttcttaaataagacagaaaaatcacaaactctgaaggaaagtttgataaattcatctacattaaattagaaatgacttgtcataaaagaatgaaaagacaagctaaagattagtaaagagaatatatctatatctatatctatatctatatctatatctatatctatatctatatttgagatggagtcttgctctgatgcccaggctgagcgcagtggtgtaatctcagctcacggcaatctccacctcctgggtttaagcgattctcatgcctcagcctcctgagtagctgggactataggtgcatgcaaccacgcccagctaatttttttttttcttttttttgagacagagtcttgctctgtcaccaggctggagtgtactggcacgatctcggctcactgcaacctttgcctcctggattcaagtgattctcctgcctcagccttctgagtagctgggactacaggcgcatgccaccacacccagctaatttttgtgttcttagtagagacagggcttcaccatgttggccaggatggtcttatctcttgaccttgtgatccacctgcctcagcctcccaaagtgctgggattagagatgtgcacaaccgcacctggccaatctttgtatttttagtggagacagggtttcaccatgttggccaggcttgtctccaactcctgacctcaggtgatccacctgccttggcctcccaaagtgctgagattacaggcgtgagccaccgcgcccggccagtaaagagaatatataaagaacacaaatcaatccgaaaaggatgaacaactcagtagaaaactggcagaagatgagaataagaatttcccagcaaaggcaccacaaacagtccagaaacataaaagatgctcaagtccattagtaatcaggaaacgcacattcaaatggcaatgaaaaattattaagtacctcccagattgacaaaagctgccaggtctgaaccagaacaggggcagctgcagcatggagccaggagacctgccacccaggtggctggaacgcagctgatacagtttggatatttaaccctgcccaaatctcaagttgaaatctaattcccaatgttggaggtggggcctggcaggaggtgtctgggtctcagggcgggtccctcgtggcttggtgctgtccttgcaatagtgagtgagttctccggagctctggttaagtgcgtggcagctcccccttgcttgctttcgctcttgcttctgctgtgtgaactgcctactcccatttcaccttccaccatgagtaaaagctccctgagccctccccagaagcagatacaggcaccatgcttcttgtacagcctgcagaactgtgagccaattacacctcttttcttataaattacccagtcatagatatttctttacagcaacacaagaagggcctaatgcaactccctgcagagaggtctcggcctccacgtggtagagctgaacacttgcctcctagtgatctagcagctgctctcctaacacctacactcagacatcaggagaatacgcaggagtgctcagagttcctctgtttacagccccccaaaccaggagggggtcacacgtccctcagcaagagaacagacacatcagtgatgggacgggtcacaacaccagaccccagattcccacctccacgaggctctggaaacaaaaacatttcatcctcttcttttcggtaattatactggtggcaacgcctgtatttactctctgcatttatcccactgaatagttggacattttgatgcagaaaaatcagtgtgcttgattacatgacatgattggactggaattatatataaaatacataaaatgttacatcctctgaaatttattttatagtataaattgtataacattacattttacaatattaaacaaatacatgcatgatgtatgtttattctgaaatgcacgtggacccacaggctttggatagcgactaagaagctgtctatcatatgatagagtcctacacaggtgggaaaatgaataaacgagacacacacaccggggaggcagaaccccagagcatactgctggcccgtggcagaggtcggcaaagaatgcaggtggcaaatgtccatttacagaaagctggaaaacaggtaaacgttagctttgtttagtgatatcaacacaggtggtaaaaccccaaggaaaatcctgaggaagcggtggtgggggacccctcacagccctactggctctgcacggtgtcccttggctcaggccagcacctccgtgatgcttccatgacatggggagaaaccgccaaccatgggccatgtacaccagatgggtccaggcccagatggcagttgagcccgaggctcaggccccatgagcagttgtgggcaggaagcttggctgccgtcctgagaccaacaccaagccacagccatcaccgctcctcctccaggcttcccttcctcctctggggcagcagcccatcttcccagctgcccgaaggagaaaggcatatccccagtgtccctccacatcctgaccctgaccctgtccagcagctggtccacagctgcagtaaacccagagtccagcagaacctttgctcagtaggcacacaaatcattcttgagcaggtgagccactaataatgtgtcactgacaccaaggaacagagggttgagtgacttgcttcaggccacacagctagtgaggtactgagctgggacctcggagaaggtgcctcctccatgctaggcagccctctcctgggccagtcctgctccccactcccaacagccttggtgctttcagaaaaactcaagaggcgccaggagaatcccacagtcccccttctcagcctaatttgcaggcaaggaaatgtctgtggagctctccactcatcaggatccatcccctgcccaggggacaggcagagacctgcccgatgccctggtggtggccgcaggaatgctgagcagatggtgcttggcacccagaagtggggtgaggagagcagaacgacccgataaaattatttatgcaaatatttaaccacaggcactgcagcaatgcaaaagtaacatcgaggggcccatgaaatgttagctgcctgccgccccaagtgcctgtgtgcagagccagcagcaagccagagagggcgggagggtttggggaggagacggtgccttggagggagcagcctggagggagggacagcccctctgtctctgcgcaggcccagctgctcaggcagagtctcccttctcctccctcctttaataaacacccatgaagggctctctcacccatggtggggcatttccatggtgagcaaaactgggagacacaagtgagcggtgcaagagcacgagagtgaagctggatgcccgtggggggctaccctgcgctccctgctcctcccagcctctctggcagatctgcacatggcagatgggaactgtggggcacacagctacgtggaggaccctccagaaccctctgccctctgaatggttgggacagtgagtccaggagggccagggggtggcctgggagaggtggtgctggtgctctgggctgcagtgggcactatgatcacgccagtttacagacataaacgctcggcttggggagggcaggcgcctgacccgagacctcctggtgagtggttgctgtgtagagacaatgaggaccgcactgaaagcagtggcaacaaagcttccccaatgtcatacatgatgcgttgatatactacacatgtatacatacaacatgcattctacatacagcatagcggcatgccgcaagcatacgcagtgcttttcataaacaaaaccactgaagtctcacaatggcccctgaagggggtcagtcatatgatcctcaccccatttcacagatgacaaactgaggcacagaagggctgagggtggcaatgggacggaagccccagtggcctggctctggccccctcccaatccatctgcactggccacacaagggtgctggacacagggcagtggtgtgtgggcagcgtgtgagtcacaaggcaggttccgcggtttcagggcccatcgggattcaccagcagcagcaccaggctctacagtcaggaccagatgggccttggtcaggcagcctggggcagggccaggggcctgcagcagccctccgaggatgggaggctctgagaatcctcagtgaagggcagggcttgagcctgggatggcgctttttaacagggccacgtgtctttctacataaaaaaagccccctgtcatgccaaatcttaaagtaaacatgcctcttctggaagatgctctccctgctaggcctggccactccatcgttgtgagccccgggggtgggaacacccagagtgagaagtgaagcctcctgcagcccagcccggagacagcctggctggccacgcccagaaggcagcaagcgggtgagcccgcgacaggcgcaccctcagtggctaggaaagggcccttggcaggaagcccccctgtgaccactcatgtttaggctggacactccacacttgcattttcctaatgcagctggtctctcaccctccagcgattagcacgctgggaccacagagccatgtgagctcctgcagatttcttaatggccggctgcctccggtggccttatttttagccatttccactctactgaccgctcagtgaagctcagatgtatcaggcgcacggggagcatgtccatatcgaactctctccaaggaggcggagggggacgaggaacgcagagctcaactgcacgtttccctgggctcattgcacaaattgagttacagatgcagatttccaacccatttcttgatgttttcctcctggaaccagagcaaagaaaacccgaggaaactgcacggcaacaggccccaggacggcaggtgggctggcagcaagaccactttcttatctagagctggatttaggggcctgaagccagcgaggaaggaggaaggaggaagcacaaatttaaatgacccttctagaacaacctattattcccccccctccttggggtaaaaagatggcatgaagtaccctcagttaagaatcctggggaaagataaccatccgagggtcgggctccccagacagacgacagcagatcggggctgcttcatgagtgctctgctgccaggaagtgtgcatggcaggggggcagctggaaggtcatccagagccaccccaataccagcaaagaccccactcaaaaatcagcccaacccatgtctggaaatcagctcttctggctccattgcccatccttcccccaccttttccactgaagagactcctactcactctttaaagatcctagcatgaacaggcttggttgctcctgcctttgatcccaatgctatgggaggctgaggtgggaggatcgcttgaggccaggcgtttgagaccagcctgggcaatccagcaagatcccatctctacaaaaaataaaaaattagcagggtgtggtggcacatgccatcatatgacccgggggtgggggggtgtcacgtgattgtaccactgaactccagcatgaaccacagagtgaaaccttgactcaaaaaaaaaaaaaaaaaaaaaaaaaaaaggccctagcttgtatcctcagccttactgtgcagacttcagagtttgaatcagcaggtcctttgtggggggccaagtcctgcagtacaattacccctcagactcccctcctgggcgtctgtgtctttgagggcctgtggtcatcctcaccatttctgtaacttctaggtcctggcttggggttaggagctgcccaggtgcaagatggaatggaccgtctgctccttgggcctcaggcgcttctgcagtcctgattcctgttactgggtcaaaccgcagcaggaagatacggaagggaggtgcgctaggtgatgtctctgagcaaccctgttcttcggctgttttcatccttcagtgcaaagcccttaaatctctgcacagccctggagaaggatgaggctcgggacctgagttcccagtcatgtcgtctgtgtctgcagctcctagacaggtgcctggaggggcaggccagcaaggggtgcccacccacttggcccctccacatagccggggtcagtggaagtccaaaatccacactcggatctgaggcctcagccctcttctgtggcccctcagacgggggcggccttcctggaaacatccgccttcctccccgggcaccaacagcaatatgtgccttttcaggtctgggaagaatgtggctccggggtctgggtactgcagattgcccaggtcacgtaccctaggtcctaggggaattttaacagatgaactggtttccaggctgaactctgagcccagcctccgtggaaggtcagaggtgaccagctggcagattctaagaacctggccactttccggctcctctctccctatgtgcctgccccacacccagctccccaaccaagtacatgcttggccaggtcttcccggaagtcagaggtgaccaactgggtcctggtcaccatcacaccccactccctgccctcaggtgcccattctgtgcccagcacctgcacgcacacactggctctagggcctgtttgccagcatttactccctgggcccacgggtccagggacttcttggaaaatgcctgtggccgtcagcaaacagagcagatcagcttggaagaaggcatggcctccctgtatacccctggcttgtccaaggagaacaagggcaactcccaactccccacaccacagggcccccaggacatgccaccatcctgtgagcaggcagtggccagctctgctctgtgttgaagcagcagcaccgcctaatgccagcctggctggccagttccgagagttggggttaagcgggagaggccccatgtggtggccagaaagagaccactgagtattctgtctcttggacaacatatagcccccctttcagaaagaagaatctggttccagctccatccttgcgttcctgtggggcagcatgagcagctgctcatttccacagttgactctgaccagagaggctgagtggcttgcccagagtcacacagaaaaggcagtgccagggctcctgaccactgcccgccatgtccgattcctgctgcctttgccagataaaggtaaatgtgccagctgctcttgtgggaaatcggaatctgaccctaatttgcaagagatttttctttttctttgttttcttttagagacagggttttgccacgtagcccagcctgagctcaagcgatctccctgccttggcctcccaaagtgcttggattgtgggtgcgaaccacctcacccagccagaagggatatttctttcctctttgtgaaaagagctactattttcagctactgactgggctacaggaggagctccctagttgaacacgtagggggcctgcaggcttccaaggccacctggcgatgggaactttttctctcgaacaccccagctcctgatgggggatcatggggtctggagggtaggtctgcacctctgagttctgggacctgggctaagtcacccagcctttccctgagcctcagcttcttcatctgtaaaatggggtcatgtaaaggctctgcaggtgggcaggacacagcactcggcagcagggagccactgagagctactgtccctcctcctcttggccgagcctgggccccatcagccgcaggagcgctgcttcctcagggcctctctccctgcttcacccacctcgacacgggggtgagggccacgggctcccggaaacccattcacagccgaaagctcgtgctatttagtctcatctgtgtgcagccgatcagagaattgatctcaaattacaaacctctcagctaaacgcggtctattacgcaaaacctcattccagcggctataaataacccttacaacacagtccccaggaactctctggaaagatgtggcacggttttgaataacgagataatggaaacacaaacccatgctaattaatttcactgctcagagagagctcgctcctcgcttagccatggtcagtgggactcaatcaagaaaaccctgggatgaaacgggagacgtctcaagggaaacctgttggcaggagggcccagccacgtggagctgcagcaagtggtcgcgttgtttgttcacggacctgtggcaccgggcggcccagagagggcctggccggctcccacctctcaaagccctgctcggacaatgctgctgaggcaaggctccgggacggcccacccaacagaggaatcagacacaaaggcagccctgggctaggtctgacggcagatggtttcaaagcgaaagaggaagaatccgaggactcctgttgcagggtcacaggaggccccaggaggtggctttatctgttcaaattagagacccccagaaagatgatgacctggcgtgtgaagaaaccagcatgggtcacaggaagcattcagaggttcctcagtaagttaaacacccaaccaccatgtgacccagtaattccaccacacagggaggcaaaaacaagcacgcacagccatgctcggagcagccccatccgtgatggccgagaggcggtggaaacagccccaacgcacatccactggtgaatgaacaaacaaaacgtggcacgtacaaatgatgcgggatatatgatagaatggaatagatacataatatatctatattgtatattgtatatactgtatattgtatcttgtatatactgtatattgtatattcatatactatattgtatattgtatatacatgtactatattgcatattgtatatacatgtactatattgtatattgtatatgtatatagatatacataatatatctatattgtatattccataatatacaatatggaatatgtatattatggaatataattcgggcatgaaaaggaatgagacacagatccacactacaacagggataaaccttgcaaacatgacgccgagtgaaagaagccaggcgtaaaaggccacattctgtgattttatttataggaaatatacggaatcagtgcatccatagagacagaaagctcactggggatggccagggaccagggaggggtgaggggagcggctgccaggaggttcggggttccttttggggcggttaactaggtctcggtggtggtcacacagacttgtgaatgtactaaatgccactgaattattccccctttaaatggttaaaatggcacattttacattacatgtatttgaccacaatgaaaagaaaacagttatgggaccaatgggagctttggtgcccctaaaattccatcagcattgcctgttcttaggcttgttcacctcttaatacgaggcgtgcaaactcagctcccagtcccctcttgctgctcagctgcaaaaaaatgaattattgcctggttttatgagtctaatgttgtgacctgctcctgccactgatgccaaggccaggaggtctgtcagtcagggtggcacatgacacgcctgtgcccccggccagtcccactgtccctgatctcagcttctcccatgcaaactcagaagctagaaacaggctgctggcctttgttcttctctccctgaatccaaggatgatggttttccaagcaggctacatttgtaaagtaatcctcgactctccgttttatattaatgaaagccagccagagctgctgatcggctccagcggatgggacaggcccggagaattccgtggggcagccggcacaatgccagcccagagcacagaacacggcatggggctggcgtgcaggaaaaccaggcacccctgccggcccctctgggctttctgcatcttttaagcagctctcagagcccacagactccattccagggcctgtggggatccacaggactcatgccaagaatgacggaaatctttctgagctcaaaactctctgaatttgaaaaacaaatggtcctttgaagaacactgcttccatatggaactatggggcacggtgatcagaagagctccagcctctttaaaaaccagcaaatgatgcaccctgatccctttgaacgtccagaaaaaggctgaacctagagccatagtgactaagaggcaaatgcagcctttcaaaatctccacaacccaagaattgccttttcacatgtgaagccaacgcttcagaatgcaagaaaagtggcagctttcaaaaggagtttggaggttctcagatttaagcgcaaatgccacttcctgaggctggtgctaaaactgcaggaaaaggctggttggcagaagctcacaaaggggagtttatcagtgttgcaaagggcatgttcacggacacctattggtgttggccttgttctctgtggggatggtgaggcggggccagcagcctgcagggctgtggcattacccgttcctcgacagttttctcaactcatcgtcactccagccagagccctgggctgctccccacctgccctgcttccccatcttccctgcaatgccccatggcagccctgggtacttggttaccaccccacgacccacgtcctatccttcagggactgcctcacctctgggctgtttggaaggacagagtgacatgggacagaaacagagggtgtctggtttaagggctacttctgcatttatcattccattctttattttgggtctaattcaaaccatgatttcaaaaaggctaagaatgtacaaagggaagggacccactggccccagggcaagatgggagggtgtcctggtggaggtgtcgtctgagactccttcactcctctagccatttaggaagaatttctaggtagtcaagcacccaggatgggccttccaggatgaatgggggagtttaggaaactgccttcgtttctactgaaaatggagaaaaaaggcaattttcagttcttgcagcactcagcagtgtgaaactgggctgctgctgaaagggaacgagaagcctcgttccaaatttacttgccatgggaggtgggggagggggggcgggtggcgaggggcgtgaacactgggaaggcatcacagaaggggagcgtcttgagcgttctgcccaagatccaggaaggaggcggcgtccgggcgtgacacaggcccaggaggggagctggatggggtggtggggaagttgcctgcgactcctgcctgggaaccaggggtctgtgctggtggtggggcccctgtggggatgtgtgttctcacagagaggactttaataagggttttgaaggcgtcctgctgctgagtatgggaactcacacgtgctgggcaggagagaatcagggctgggctgatcagggaaacgcagaggggaaaggaagcctacctgtagcccccatctctgacagaggcaagatgaacaagcacctgccatttacctgatagcagctgcatctctcgccaggtacagctgcaggcgaaggcatgaaaggttgggtttctctacatacgtgtgtacacgtatacatacacatatgcatgcgtgcatacatattcttgggggtgttttgccttctttgtacaattacgaatatctttagatccatgcatactttctgatggaacttcatccctgaagtatgcatactgtacaggcaaggttaaacgaaactccacgaagaaaaatgcaaaacgctcaacgctccagaagcccccagcggcccccggcagccaccttcctccctgcagaggcacccggggtctgcgcgtgcaattcccgcgctctatctagcactcactgtcacctgctcacttccttaaacaatacatggattccctttgccttttttcaaattttacagatatcattttggcctttttttctttggaactttccatacgcaatatcagactctatgtattcctctgtggcctccacgttcccctccacagcatgtctgagattcacgcgccttgatgaatgcagttggcattcattcattctcccaccagcgcactgtactccacgtgtgagcaactcacggcatccggatcctttcttgttcacaggcacttgcatcatttccagcgtcttgctgttatgaacagaggtgcttggaaacttctcgtgtgtgtctcctggcccacgtgggagaatgtgtcaggggtgtgtgccatggagtcacatgctggtttgcacagcaggtgtgtctttcatattagtgggcaatgactactgttttctaaagaggttgcaagatttgggactttttttcatgtttttcttttttctttttttttgagatggagtcttgctctgtcgcccaggctggagtacagtggtgcgatcttggctcactgccagctccgcctcccaggttcatgccattctcctgcctccgcctcccaagtaggtgggactacaggcgcccgttgccatgtccagctaattttttgtatttttagtagagacagggtttcaccgtgttagctaggatggtctcgatctcctgacctcgtgatccgcccacctcggcctcccaaagtgctgggattacaggcatgagccgccgcacccggccatgtttttctttttttaaaaacaaagtgtagaaactcaaaaggctctggaagacctggccatgtgcagcagtgttatgagttaaactgtgtcccccaaaaagaggtgtggaagtcctcaccccaggatctcaggaggtgaccttatttggaaggagggtcattacagatgtaattaagatatcaattaatgtgaggtcataggggagtagggtgggccctacatccaatgactgctgtccttgtaagaagaggggaacttgtttttttttttttttctttgagatggagtctcacactgtcacccaggctggagtgtagtggcacaatctcagctcactgcaacctcggcctcccgggttcaagcaattctcctgcctcagcctcccaagtagctgggattacaggcacgcaccaccatgcccagctaatttttgcatttttagtagagacagggtcttactatgttggccaagctagtctccaactcctgacctcaaattatctgcccacttctgcctcccaaagtgctgggatcacaggcatgagccattgcgcccaaccagaagaggggaatttggacacagacacacagggagcccaccatgtgacaataaaggccgagactggagccaggcagcgcaagccagggaaggccaaggagtgtcagcaccaccagaagctggaagaggccaggaagggcctcctggagcctctggagggagcgctgccctgctgacaccctgacctttgtcttccagcatccaatgacacagtaaaagtttgctgttttaagccagacagtctgtgggttttgtttttttttttgagacagagtctccctttgttattggggctggagtgcagtggcgtgatctcagctcactgtaacctccgcctcccaggttctaagagattctcctgcctcagcctccagagtagctgggattgcaggcgtgccccaacatgcctggctaattttgcattttttaagtagagatggtgtttcaccatatgggctaggctggtctccaactcctgacctcaggtgatccacctgccttggcctcccaaaatgctgggactgcaggcatgagccaccatgtccagcccaacctgtggtttcttagcagccctaagaaataagtacaagcagcattccaggcccttccttcatcccatcctccagtctttgtctcagtgaccaaataggccttgggtctgttgctgtgagagcaaggatgaccaagcccttctgcagatctccaagagtctgtgtgctcctctgagcctggggtgagcctctgagcccttctcaacacagggctgcaggcctcccctccccactaacttaacaacacgggagtactggatgtccccatggccgtgttagaggtttctggagagggaagaggaagtgggcagctatgctgctcctggctggggggctgtggtcccagggccttgctttaatgggttaactggaaaggcaaaaggaaggaaagaagagaagcctgcttagattggattccccccatgcacagaacccattcgtggacatgccatctgcaatgcttcatggaagacatcttccgatggcagagggggatcatgaactcaacactcagcctccctctgaaccaagagctgttggggaatgagtagggggtggagaacagtgggtgggcctagaaggagaagctgaacattgcctatacacctctgcctaatgcagcccacaccccgctcctcctggtggactctgtgatgagggcctgatacctggtgtgggactgtcctctaggtggccttggacgagcccagttctcccctctcttttgctttcagttcttaagaataaccatagaatgtgctagaaatgcaacaccccgagagagggagggctgactggaatagcctgagctctgtcccagtcttccccggaaacatgatgtccatcaacactttagtccaaaagtcatatggccccggggtataaaacccaggaggagctgctttccagggtcccttagtggcggcgcaagggagcacatgcagtcaagactccggtcagctttcctgagccttacaggctggctcggccgaatcccaggcttctattgtcccttgctgcatatctgtaagcaatgaaccagttcatggaactcgctgtgtgggcggctggctcaccaggctaggacaaggtggtaagcggcgcgtggtgaacctgctccacaccttggggcagagctgtcaggccattcagtccaatcctggggtttggtggtagaaggaagcccacccacccacaggtctaagccaccttggccggtattggctttgttggcaacaagggaggaacttgctctctgtggctcttacatcctcggtctgtctctttgttggttagtggggaggtgagggtgggcaccagcatttactggggccactcagaccccagctgtccctgagagggctgctgaggaaggagtggcagacagcgtggatgccgagaccagagcctgcctctgggaaatggacagaggccttggaacccatcctcccttcactgtccttgccgttaggatgcccttccctgcattcagggcctcagctgctcatcaggatggggggcacatgagattgccattcttgtaggttgataagagttcaatatttgctagtttgacatgatgcaactgaacggaccccacggccgactgctccttgctccgataagtagctactgagctgaaggtccccgagaagtctcaatgagcagaaggcccaggccctgcgtctgttggcgaccccacactgggctgtcggaactggctccagggaccccaagaggaggccctccccagcctgggaggggcctggatggcacctctgagttggggcctacaatgagatcagagggtgagctgagcagaggatgtgaattcgagtgctaggaccgcccgaggagggcgctgggtggtactggggaggcagagacaactcaggaggctgaaagtccagggatgagggaggcagggccaggccacgaggacagaggaggcactgttccccacagaccctggaaccaggtccctggtgcccagtgctgggtcctgagcaagttctcctgagggttaaaacattcacacctgagaaggaaggcagggtggggtgtggggggatctgaggcctccggaggctgctgggtgaaggctgggagtgccagaagggagtacttccaggctggggtggcccagagcctctccctggcccaggggactcctgccaggctggctcctgaccagtccccaggcgaggggagcctgcggggcgtcccccgacaggggccgctgaggaagaggagatgacaaatgccccgcaaagggccacagggtgcagcagccaggggcagagccgtgtgtgctcctgtgtgtgtctatgatagtgtgtgtgtatgtgtgtgagacagtgtctgagagtgtgttgtgtgtcactgtgtgtcactgagtgtgtgcctatgagcgtgtgtgtctatgagtgtgtgtgtaggtgtggcagtgtctgagtgtgtgtatatgtgtgtgtctatgagagtgtgtatgtgtgtgagtgtgactgagagtatgctaatgtatgtgtgtcactgaaagggtgtgtgagctgtctgtgtgtgtgtgtcagtgtctatgaatgtgtgagtgtgagtgtctgagtgtgttgtgtgtgtgtgcatgtgtgtcactgagagtgcatgtgtgtcaatgtctatgatggtgtatgtttgtcagtgcctgagagagtatgtgtgtgtgtgtgtgtgagtgtgtagtgcatgtacatgcatgttaaaaccctttaaaaatgtaaaaatcttcctcagaaactcagtcatggatggaatgtggcccccaggccagagttcacccagccctgccataaaagaaagaaacgcgaggaacggagtggggaggtggagcagatttgtcaaaacgggcagtcagagcctctgcagagctgatcgtgggcttcagagcagagctagggggcagacgcagctgtcgccacgggaagcataggaaccctcagaaccccacgggacctacaaagcctagagcaagctcgagttcagagttaacgggagaagaaggtggccggaatgagggaaagaggctttcatgatcaaggtggagtttaccccacgtgcatatgaccaaaactctgaaaaacagtatttttctgaataaacgtctaccatgccaagcatgttagaaatgtttgattcaaagagaacacatggacacaggaaggggaacatcacacaccggggcctgttgtggggtcgggggagaggggagggatagcattgggagatatacctaatgctaaatgacgagttaatgggtgcagcacaccaacatggcacatggatacatatgtaacaaacctgcacgttgtgcacatgtaccctaaaacttaaagtataataataataaaaaaaagatgtttgattcaggctgggcacagtggctcacgcttggaatctcagcactttggggggcgaggcaggtggatcacttgaagttaggagtttgagaccagcctggcaacatggtgaaaccccgtctctactaaaaatacaaaaattagccagacgtggtggcacgcctgtaatcccagctactcaggaggctgaagcaggagaatcatttgaacccaggaggcagaggttgcagtgagccaagatcacaccactgcactccagcctgggcaacagagttaagactcggtctcagaaaaaaaaaaaaaaaaagaaatgtttgattctgatgtgattcgtgcaggggtgatttcagaaggtcagaatgaacccactgagagggaaaagtctttgaacaaaaggacaaaagtctccagagttaaccgccatttatgtctagcctaaccatctgaggaaggaacgttctagaatcccagggccaccccgccctaggttccaatgaatggcccctggctctgcccacagccaggcctggcctcacctgcaggtgatgtgcatggctcggattcagtaattaagtcataaaacacaaggctggctacttagagcagaattacgaggcatttcagcttgtgaatacggtaatccagcttaattaacaccgactgggagagcaaggcgcaggcttctgggttaaatcagcccatgcggaaaccctggccgccgcttaccctcatcacgctatgctgagcatttgtcattgtgtggaataaaaataaacctgagcttggaaaactgggcaggtgaccctggaaaggcccggaaaccacccaaggctggctctccagggcctttgtgttaaaatggaacaaatccagcaaccctgagaggcgtatccagggcaggcgagcttctctgggacaggggacacacaggctgacccggcagatggccaggagatggacggggtgaatcattgcaggtgccgtgcacagccgccccagtcccttacccacacccttcgtcctgcaggctcgatctcccttcaggacccccgctttctgcccatggccctgcccaggggaggcggaccccagcccagcctgtgacactctaaggacttcctgagggttcatcatttcagcctgacaaccacccttgggttagattcttattgctcgctgtaattaattactacaaatttagtggcttaaaacaacaaaaatgttcttacgtgccagttctgtaggtcagagggccaacccagggctcaggaggctgagagagcggcgttggcagggctggctccttccgaaagctctcagcgagggtcctttcctgtctcttccagctctggggacccctggcgttccttagctgagggttcattactccaagttctgccttggggggtcccatggacttctcccctgcatgcatcaaatctacctctgcctcccccttataaggacgcctgtggtcacactcaggcccccctaagcgatccgtgatgacctcctgattgcagcaagatccctcagttcattgcatctgcaaagccgcctttcccatggaaggcagtcggtcgacaggctctggggataagcacgtggacatcttggggacccttattcagctggccactggcaggcacaactgggctctgcagagaggctgcccagggacccttccaggcagtgataacgcctcagggcccctctcttccccatctccctcattctctttggggctgtcctggctgcctccatgaggcgtgctagtcagtgccggctcacagggaggaggcctccataacagcaaggcccttggatgctggagggtgagacgctgcccagtgtgaaatctacctctgttaccatgggacttggaggagcacgtttggggctcagctctgctaactgatgctcagggaggcaggaggggagagttttaaaagagccacaaagtaccccggaacttagaaggacacttgaggaccttgtttaagactggaacagaatgtctatcctgggagagggtgtgctggtctccctctctcttctcataaggacacggatcccatcatgagtccccaccctctgacctcatcaagccctagccccctcccaaaggccctgctcctgacaccatcctggtgggggttagggttccaacatttgagtgtgggggtcacacagacattcggtccacggcaccaagctgatgcttcctggtgtctgagatggggagaggcctctgcatagcccggctggctcttctctttcccaaggcagaagaatcattaccttgccggggcctcatcagaacaaaaatgtaattgttttgtgccttttagaaacctcctgagttgggagaaatggagattttggtggctgtccatgaagtacttaattaagcagaacaggtaatcccatcgttattacaagaaacacacagagctccaatatctgtggaaatgcagttgcctgtgggcctggaggctgcctgccccgcctggtctcccccacccccaccatgggcgccttccttcacaactatctgggttgttgcattaaggcttgtcttgcccccagacaaaatgtggagtctgttgttaccgtctgaatgtctgtatccccccaagttcctatgttgacacatttggagacagggcctttattggaggtaactcgggttatacgaggtcataagggtggggccctgatccaatgggattagtgtccttataagaagaaactccagagagcttggtggcactttcacacacactctctctctctcctctctctgccatgtgaggaagccagctgcctataagcaggaagcgacccctcaccaggaaccaaattgctggcaccttgatctgggacttctagtctccaaataaatgcttgtttaagccccctggtctgtcgaaccttattacagcaacccaaactgaataagacatgtggggtccggtatgacgtaatatctgtgtgaccacaacaggcctcagtttctccatctgaaatggggatggatggtaacagcacctgcctcaaaggctgtgggggctgaaatgaaagctcaggcaccaaggcaccgggatcgggcagggtgtgatcccgacttcacctctacaggctcacatcaatgacagcagcccctgggcagcctgctctgacctcccaggaagacccaatttctggggtgtccaaggggcagtcctagacacttgaggagattaagtgtcataagacatcagcccctcttgtcctgatcactattttgcagatgaggaaaccgaggcaggagcggccagggtactcatttgaggtcacaggtggaacatgcgaagcagaacccagaccagcttggagcccagcactgcatggctattgcttatgccctgcacaccatctgcccatttctttctggcctggctcctgcctctgccccaccacactgccagatgcacaccaaaggctgtgcccctacagcacccttggcgaggacgtggcccatggcaggtgcttgggaaatacgggtggactgggtggaaggaaggaaggagagaggggactggaaattcttcccagctccttcatttcccagatggaaggtgatttcatcagatgggaggtctgatacggtagccccagccatgcgtggctgcttacattacaaaacaacccaggcaagtgagtgtagaaggggagactctgcctgaggacgtgggtatggggaagaatgatggagatacatggggatgatccattgctgtaactcttctggagacacccataaatgatcccagaaaagcatgattgagggcttaatggcagaggtgatcaagtgtgactgacaggtgttgccgacagacatcccagcctgcacacccccaggcctggccagctcttctgtccacacaggaggggtgagggccaacttctgagctcgtttctcttcccggctctgtccacacggtgccgggaggttctggagctgagcccagcgccatgtggaggggcctggcccaccttgctgggctggctgccccaggcacattggggcaaaggggtgtttgcctgtcactagtggggtgggtgagcctgacaagaacagctggtcaaccactcctcggctccttctagaaccatccaaacccagcaggatgtccaatggaatggacgtctccaatccaacacagcaccgcaacttcccctgcctgccaaaggcttccccgtctcagcaaagggccccacagctgcccggcagtgtatggaagagcccaggactcaactcatgtcaacccccgcccccacctgtgctgtgccccaaaaccacccccagcctcagtcctctccaccccggtgtttgatgtggaacagccgccaatggggcttcctgaccctctgtgcgagtgtcctgggcttttgttacaaagcaacacaaactggggggcttaaaacaacagaaattgattcactcacagttcaggcggcctccagtccaagaccaaagcttctgggaggggccatccgttccggggccctccctcagctccaggggctgcggccaccctggtgccctccccttggcttgtaactgcacctgccagcctctgcacgtggccttctgctcatgatctcaagatctcatctcaagatccttaactataaatgacatctaaggacatctgcgaagaccgtgtttccaaatgagattcccagtggacacagttctgtggaacaccatccaaccccctactgtctccaatccagtctccgaacggaagtcaaacaagctgaacaacacacacgcgcaagcaccactgctccctgccacaaaccctgtcacctggggagtagagtctaaattcttctccacagccaggtgcggtggctcacacctgtaatcccagcactttgggaggccgaggcgggtggatcacctgaggtcaggagtttgagaccagcctgaccaacatggtgaaaccccatctctactaaaaatacaaaattagccaggcatggtggcacacacctgcaatcccagctactagggaggctgaggcaggagaatggcgtgaacccgggaggcggagtttgcagtgagccaagatcgcgccactgcactccagcctgagtgacagagcgagatttcgtctcaatcaaaaaaaaaaaaaattcctctccacatcctgtggggcctgtgcctgcctctcccacccttcccgcacttgggtgcatggcctctgcccctccaggtccccgggcggtttttgcctctggggctctaagcccacctcctccgaggttgccgaccttccctgccggccagcactgcacagctattgcttatgctccacgcaccatttgcccttttggaggatcatcgttatttattcatttctttctggcctggctcctgcctctgtcccatcatgcagccagatgcaccccgaaggctgcgcccccacagcacccttgatgaggacacggcccatggcaggtgcttgggaaatatgggtggactggctggaaggaaggaaggaaggagagaggggactggaaattcttcccagctccttcatttcccagatggaaggtggttttcatcaaatgggaggtctgatacagtagccccagccacccgcggctgcttaagtttcaattaattgatattaaatacgtaaaactaagaattagctcctcagccacactggctgcattttgagtgctcagtagctgtgtgtggccagtggtgccatatcgagcacatgggacatttccagaaagttctaccagacagagttgctttagaccaaggaaggagagagaattcagggctgtcagcattatgaaggtcccagggcatctcttccagcctatggcccctcccaggccagggcagggtgtggacagcaacagagaccccactggggagctggggtataggatgggtcacaactcagggctaagggtgcgcccagagctgccaccaagaactggagccatgggaggcagggcaccttcgtccctgtgcagggaggggcagccttgggtgtggacttctgggagcagaggccctggtttccctaggggaggggtgggcccggagcttcctgggagcctgcagcctcaggaggggctgaggccgggggagtgtgcaggactaacggacaccatgcctgccacttcctgagctgagggcagagctgatgggggcgggctgtcacctgcatggtcttattcccaggcttgcatcctacccctctcccccatggaggaggtgggaatggagcaacgcccccagccaatcccctggttccctggtgctcccaagggattcctgccagctctgcggccctcagacttgaggccagggggtgttggacacactgcacccctcacagagagaggaacaaccatcccctcctgcctgagccaggattcacccccagacatccctcagaatccatttccatctttccaaagagatgctcccatggccacaaccttcttcaaaaaaaaaaaaaagaaaaagcctcaaaccgtctttcccttaaggcagcagtcctcagccaggggtgatggtgcccccccaaaccccagggaaccagaggaggaaccagggaaccacgtgtcaacgtctggagacattcttggttttcacaactgggggctggtgctggcatggagtggggagaggccaggctgctgctggacaccccacagtgtgcaggaggggcccgcagcagagtgatcctgctagaaacgtccccggtgtcgtcctggggcaacactgtcccagttccacacctggcagggcggctctgcgaaatgcctccacccagagcctggtctctatcggctccctcacctggtggcctgcggggggtgtcccaagggttctcaccaggagtttagccaatgtacagtttgagagaacagcccccacaagaccacccttcctcaattcagacaccagctgcaagttctgggggtctccaagaccaccctcaggtttggtgatttgtgggaaagactcgtagaactcactaaaagcacctatgctcacagttatggtttattacagcaaagggatccaggctgagatcaggcaaggacaggcaggcgtggggggcagagtccaggagggtccagacatggggtgtctgccgtcctccctgggaaagtggggataagtccctcccagagatgacgtgtgacaacacgcatggggcattgccgccagggatgctcccagacctttggtgtcccgagtctttgctggggctctgtcacacactgccttggtggcagggctttagtttccagctcctcctggaggttagggctaatccttctggtctccagtttcttctggaggtccaagctgatgtggcatgacccagagctcccaccataaatcacactgtcagactgtccagcagtcaaagcccccaggcaaacagagacacatacatcaggcaggatattctgggagcccagagaccacctcccaggaggtgaaggcaaaggttagctctctctttggatcaagttggtgcttcactacccagacctccctccctccattttagatcagaaaactgaggcccagaccttaggaaatctgagcaggctctgagcagtggaggatgtgggctctgagccagtccctgcactctcctcttttactcaggcccctccgctccccaagtcccctgcctcccagaggtccacaagcccaagctgggggaaatctcagtgcagcctcttggatctctgtgcaaaaatgaaaaaaaaaaaaaaaaaaaaaaaaaaaagacacgtttgtgcataaaatacacactgtagaggaaggaaaaatgcaggaagagaagtttccagtaattcaccccatggcaaccaccaggccagcgtgggacctggagtattaatcctctaaacctggggcccctcccgctcggagggctgagggctgcaggcctctggggcctccccgcctccagttccgctgccttgttctcactcccaggcagcctccgtcccagcctcccatcccggctgagcatggtaccccgcacacacggttgctaagaaaccgttgccaagagtcacaactcagctggcaacggaaaacacccccagcagcaccgtttgctgggcccatttaggaagacatgttttctggtccactcaatgcctcatcctctttgcaaacatttcaaacgttttcttttacatggcttctagatatcacttagcatgcactctatatttaggaacggttatgaaacaaacatatcacccacaatatctgcactgactatggcatgaagcctggtactgggatcaagaggcagggagacaccagggaaaaatcctgcctcatatcacagcgaagcctggtgctcctggctgatttgggagcttgtcggtaagtctcatctggtcaagttcgacaacccccaggtggcaagctttacgccacaaagcccattggactgcaggaaacaggaaagatggacagctctagtcctcggccagaggcagagctcgtcagtcagtctcatctggtctaatcccacaaccgccgagtggcaagctttatgccacagagcccactggactgcaagaaacaggagagaccgatggctccagccctggaccagaggctactatccctgtagtacctctgaaaggccaatccttgtagcagccctgaaaggtccagatgcagccccttattctgcagaggaggagtccaaggtggcccacccacaggaggcagagctggcctctgttgctgtagtggagaaatactgcaccccaagccacatcatgacactcttcagcccagagtgggcagcctgaagaggaaagactccatcccagcaaggatgaaggctgcggttcccaggtcctccgtcagcacgtatctcatttcctgggcacccaagacagggaccccgggaggccctttggttggctttggcgcagccgtgaaggtcagatgggagcctggaggtggggggcgtgggggtggcatggtgttgggggactttgtccctgaagtgtctcctctcacagctcgctctagcactaaaggttcctgtttttgaggtttgtgatattagagttgttccccaaaattccgattttcctccttcttgggcacacacagggctgcaggtctccaccctcctgaagttaggtgcggccaagtgagccggcggctgcagggacgtgtgtcactccaggaaagatgaagaccaactcaccacccaccacactgcccttgaacccagatgtggcaactataaatggatgatggtccagctggtgggggcgtcacccaacccggttcctaagtgaggagggcaaaggacagcacccagcagacctgacagggcagtgagagtgagcaggaaataagcctttgtttttttaagccatggcaacctggagattatttgctactgcagcctaaccccgctgtcctgactgttacaggtcaggtggctacagcagaatagcccttatcctaaacgcttggactagaagtattctggattgcatatatttttggattttggaatatttgcatgtacatttggtatatctgcacatataatcacatatatcctggagatgggacccaagtctaaatatgaaattcacgtatgctttatacacatagcctgaaggtaattttatacaacatttaaagaattttgtgcatgaaacagttttcattgtgttttgactgggacttaccccatgaggtcaggcttggaattttatacctgtggcatcatgttgatgctcaaaaagtttggggttttagagcattttggattttggatttttagatgagctcaacctggattggacctcaaagggtgcccttatacaaggtcaacatgcctagcaaggaagagagttgttttttgtttttttttgaaacagagtctcgctctgtcgcccaggctggagtgcaatggtgtgagcttggctcactgaaatagcggccttccagcttcaagcgattctcctgcctcagcctcctgagtagctgggattacaggcgcatgccaccatgcccagctaatttttgtatttttagtagagacggggtttcaccatgttggccaggctggtctcgaactcctgacctcaggtgatccacccgcttcagcctcccaccatgcctggctgagagttcttaaaactgaagatctcccaggtaagcccatctttgtgtggcaggatccacaggttaggctgggagggtccgggagcagaacgtggaagccaaattctgacgggcgcagcaggggtggaggctgatggcaccaaagtcgggggcggagagggcagtaaacacatgtgcccccctctgtcctacccaggcctcggtttccctgctcgcaaagtaagcatagtcactactaagcagtgccttaatatatcaagagctcttttccccggggcctccttcagtccttatagtagctctgaaatgtcctgcaacagctccctattttgcagaggaggagcctaaggcggcccacccatgggaggcagagctggcctcgacgccagccccatgctcactccacacccagcatcatgatgctgctgtcatcccccaacttccggcttcccgagctccaggcagtggagacccaccatacagcaggctgttagcaccgcctctgggtggtgaggggctgccgaagtttcggcccacctgccctccccaggacaggctcaaactgagtgtctaggaagagtctcttgactaggggagtgaacaggtcccagaggatcacagtactgctgtgggctctggctgggtaaatcatcccagctctggggctctgggctgcagcgcggcaaggcagtgtgttctgcacaaagacaggatgtacttggggagaggctgtaccattgttgtgagcggaagagaaattaattttaagcctggagttgattccagcctgggagggaaacgccaacacttggagagggatggtttcaggcatgtgcgcgccacagctcacgtgctcactgcagcctgaattcagtggggaaacgcgccccgggcaccctccctcctctgtcagtgttccaagccacccccacatcccagcaccggaagagcctggcccctccttccatctagagagccttgggtgtgttctccgctgagccacaccctgtcccctgccccaccaactaaaacacaccacccaggctgctgccgaaaaggctgggagaggggcagcgagccagactgaaaccgcctctttcgaactctctgaagggtttggtcagttctctgtcatttaacctagtgcttggtgatgaggacacagaatagagtgtggctctgctgctggcctcccgggtctccaggcctgatggagtgggacacacggacgtccagcaggttccggcctggcgggagagggaggtctggatcacaggctgcgggccaccgtgaccctgggggccgcatgtggtgggaagggcagcgggatgagctggcaaacactggggactccagctcccctaagggcctccgaactgctgccacagccgctactgctaggtgcactctgacatcagctccaagccggggagagggggtgctgccgtcaggaaggtgccacctgggccagaggcacgggacaccagggagcacctgctgcagagctggatgatcctggtgccctctaatgccctgactccaataagcctatctctgggcctcagtttccccaagtgtgcaatgaagggcctggccatccagacccccagcagatccggccccctgacatccattctagtccccttcctcactatgaggaccctaatattgtcttggcagttaacagacccagctacaaaaccccttttctcagtttcccctggctgctaggagtgaccaggagaccccagggtgcttatcaatgagacaggagaggacatcgtctgtgggcttccagagaggggcagacagcatgcacactgcttttgctcctggccctggtccgggagatgcactaccgtgggctttggcccccactcagcttgccctatgctagaaggttccctgatggcagtggggtgaggtgggctgcagagcccacgcttagagcaagagaaaggtcagccatcctgctgggctggcactgaccttgcaggtgccctgaggccagacggcaggcagcagcgatgccccaggtcccaggccccagaaggctggtcagcccccaggacaggaaccaggccacggctgaggactgtgagggtggcagacagaaggacaatcagacccaggctgcccaggcagaggcggggccaggaagagatctgcggacaaagtggcatctctaggcctctggaaattgtgtgtgatttcaagcaaagagacggtagtggttgaattttgtccccctaaaatccacgtctatgtagaacctcagagtgtgaccttctttggaagtaaggttgctggagatgcaatcacttgggatgaggtcatcctggaataagtgggccctaagtccactggttggtgcccttataaggagggaaaatacagacacacagagacatggccacgtgcagatggaagcagagactgggggatgtggccacaagccaaagaacacctggactccccagaagctgaaagagacaaggaagggtcctcccctagagcactggagggagagggccctgccgacaccttgacattggtctctgcctccagaactgtgaggggagacacttctgttgttcaagccccagctggtggctttgaaccctttgtgagagcagccccaggacaccagcacaaagggtgagcatgtaggaggccagtgtggtgacctgcgcatcctgtggtccctccctccggcgcccaacgcatcctcaggactagccggggcctggggaccggacagggagcaactggcagcagagggtgatgacagagcctgcattccggaatctgacccacaaagggctgtggcattcataggagaagccacggaagaccggcaggaatgacagaagcagcagcgagagcccttcagaggaccgcgaaacgcgaactcccaccccagcaaaccaccaaggggaagaggcgggcccccatccaggaggccttaggaacaggagagctgacttttctaaagcaaataaggtccaggttgcctaaaacaggggagggtagcctaaggctctcccagactcatgacaacttagaattgtacaagtggcacatttagctagaatctgggaggagcctgctgggggccgtgccattctgagggttcccggagttacacacacacacacacacacacacacacacacacccacacaacctccctcccacctgccttctccaaataaaaccatgtccctggtccttttctcttggtatccaccttctccatcatggaggaggtctcagctcctaatccactcggcaaagtcccagcggacagtgagtcactgagtgctgggccaggcacaagctgagctcagggcctccaaggcaaggtgacccagagggcgctgggaataggacagcgtaggtgcccccgcagtgggggatgtggctgggtgtctgtgaggatgcttcctgcatgacaagctggggttataagaacacaaaagcctgtaggatgaagcctggcccaaagcagtcggggtcccctgacctccccggcctctctccaggcagtgttctccccagggcgccaggcttccccagctccaagtctgggcgtctgaaatctgctgtgtaattggatcacgcccggcccgtgctgagcgcccatctgcgcccgtcttggaaaacacaagtctcagagaaggaaagcagttgccacaggtaattttctatcaaatatattacatttcttggaatcacacgcagaaattaactaattagattcccccttatttttgaaatgctttcagaggacaatggaaaggttcactctgttctgggaaacgcttcatttagacgctaaacattagaatgcgatttgtccttcaatcagggaagagtggactgagcggacatttttgtttttgtttttgagacagtctcgctctgtcacccaggctggagtgcagtggcgcgatctcggctcactgcaagctctgcctcccgggttcatgccattctcctgcctcagcctcccgagtagctgggactacaggtgcccaccatcacgcccggctaattttttttttgtatttttagtagagacggggttttaccgtgttagccaggatggtctcgatctcctgacctcgtgatccgcccgcctcagcctcccaactggcggacttttaaggatgctatccacgctccctgctcctggttccatcacgggccccgaacagctgcaggtgtgtgaaggcagtctgggaaacacttctgagtcagacccacctctctggttcaaccagaggctcctttctctccttgataacaatccaaattgtgattgttttatagaaccgccttttacaacagaatcatctccccacataccattttccctgatgctgcctgacaatccttgtctcccagggatgtgggcacacagccacatgctgctctacctcccacccgccctgagcactcggtggatgctgggactctgccggccagccaaccagaaaagggcgcatgagggtacatccgggctgcagaagaacatactaattggtttattttttgaaacaaggtcatgttgatctggaaggtaactcgggggaagagtagacaggaccagagggaggacagaggacaaggacatcattcagcaagatgagggcttgggaagctgggtctctgagaagcctgggcccctttaatcccagtgagccccttgcatggagcgttgatggatacggggcagggggacaaggacaggcgcaggtgctcattgaggagagaggtcctgggatccccagacctgggcatgagggggctgccactgggcacagatgggcaacctgggcaccatgcagaatagtgtctgcagctgatttagacacgttgaatatataaatacgttatatatattatgtatgttatatataacatatttatacatatattcatatacgtaacataaatgttatatttttatatatgtattacataaaaatatattgtatataatatatattctatataaaacatgtataagtatatttatatatatataaataacactgagttgaatatacaaaaatcctgagttcataatgacatactggtgaggaagagagagacagaccagggcagagaagacacagggagagtgaaaaagaccctacttcatccctcaacaacatgatagaaaaccaactcactggacatcagtagagatcactgaagcatcagcttcctatagagagacttgacaatgaaaaagaaagaattaagcatttatcttgccttcttgtacaaacagtgttcagcttaaccaagtcatcttatttgatatgtgaaagttcttcgagatggaagaatctcagctcatcactgcgaaggcatgccaggattaggaagtcatcagatgcaagcctgcaagcctcagtgtactcctcaatgtctgcagggcccaccccagagagaggcccctgggtgaccagccggtgaggagcttcaagaggaaggattcaccatcaccacctggatcctgtgtgcagcttttgtcacagcggtggcgagcacagtttctgcctcctggggagatggggtgtgaagctcacagcacctgcgtgtggctgggcccaacattaacagcgctgcaagagctcacctccatttataggaagtgggaaggacccaaggactggccgatgacaccacaggaggcagaaggcacatcgggggttgggggtagcctatggccaacctaccctgtccctctaacaacctaccctgtccctataacacgttgctggcaggaaacacgggagatggctcagactggagacctggggacatatctaccaagtgccacgtgggtcctgggtcaaagtcaccaccgtgaaaagacatttctgagataatttgggacatgtgctaatggaggggtttcagattccacccagagaccactgctgggtgcgtggatgggacagtgacactggggcccgcaagaaagatcccatgctgtgagagacagactgaaggggaagagggagtgacgcgatgcctgggatttgctgaagaaaaaaaaaagaataaaaaggtccgtctgtatatggatggcaagaatttcttggtaacaaaagcacagccaataaaagaaaaaataaatactaaggtcgatgaaaatttaaaacttttgtgcatcaaagggcaccatcaacagagcaaaaaggcagctaaagaatgggaggaaatatttgcaaatcatgtatctggtaaggggttagtatccagaatgtgcagaaaactcttacaactcaacaacagaaacaaaaatctaatttaaaaatgggcaaactggccaggtgaggtggctcatgcctgtaatcccagcactttgggaggccgaggtgggcggatcacttgaggtcaggagttcgagaccagactggccaacatggcaaaaccccatctccactaaaatttcaaaaattagccaggtgtgatggcacgtccctgtaaccccagttactcgggaggctgaggcagaagaattgctggaacccaggaggcaaaggtcgcagtgaggtgagatcacgccactgcactctagcctgggtgacagagtgagactccgtctcataaataaataaataaaaatgggtaaaggacttgaatagacatttctccaaagaagagatacaaatggctgataaggacttttctgaaaagatgttcaacaccactaatcaattagagaaaggcaaatccaaactacaacgggacaccatctcacacctgttaggatggccacgatcctaaaacagaaagtaatgacgctggtgagtatgtggggaaactggagcccttgggcaccgctggcaggaaggtaaagtggtgcagcccctgtggaacatggcatggctgctcctcaaaaccttaaacacagaacgagcacgtgagccagcaatgccacttctgcatctatgcccgaaggcattgacagcggggtcttgaagagatatctgcacacccgcgttcacggtggcagcactattcatggtagctaagaggtggacgcaacctaagtgtccacctacagatgaacagacacacaaaaggtggtgtttccgtagagttgggatagttatcattcaggcttaaaccagaaggagattctgatgcatgctacaacacggaggaacctcgaaggtattacactgagtgaaatgtaccaagcacaaaaagataaatactgcaggattccactgacctgaggtccctagagtggtcaaattcatagggagagaaagtgggatggtgggtgccaggggccgggggaggggatggggatgagtgttaatagggaagagtttcagtttgggaagatgagaaggttctggagatggatggtggtgatggtgaatggaaatgtacttaatgccactgaaatgtatacttaaaaatggttaagatggtaaattttacggtatgtgcactgtactacaattttaaacataatacaaagtataactgtaaaaaaaaaaaggggggaggaagtgaatggagcaaatggcggctgtgatctcttgggggccagctctccacaaggtcttcataaaccctcggtcacgctcatctgctgctcaagggcctccaatggctccccattgccctaggccttgacacagcctgaaaggccccgtagggcatgaggcccgcccctttctctgccacatccacccctcccgaatgttccagaatacgcagagtctttccctggtccaggtggggccttgcactcaccaccccggtgcccggcccaccctcacctcagctctaccctcctcttcaggtctcagcctaaatccttccccttggggagccttccctgaccactctgtcgacaaaggcgtggtctctgccctgtagctgcacagcatcctagtgtgtgtgagagtatatgcgtgagcatgtgtgaatgcatgtcagcacgtgtgtgtgtgtgaatgtgagtctgagtgtatgagcatgcgtgtatgcgagcatgcatgtgtgtgtacatgtatgagtatgtgtgtgagcagatgtgtgagcgtgtgaatgttagcatgtgtgaatgcgtgttagtacatgtgcatatgtgtgtatgaatgtgagtctgtgtgtatgagtgtgtatgcgagcatgtgtgagcatgtgtgcaagtgtgtgagcatatgaatatgtgtgagcacgtgtgagcatctgtgtatgtgtaagcacgtgtgtgaacatatgtacgaggatgcatgagaatgtgtgaatatgtgtgagcatgtgtgaatgcgtgttagtacatgtgcatgtgtgtgtatgaatgtgagtctgtgtgagtgtatgagtgtgtgtatgcgagcatgtgtgagcatgtgtgcaaatgtgtgagcatatgaatatatgtgtgagcacgtgtgagcatctgtgtatgtgtaagcacgtgtgtgaacatatgtgcgaggatgcatgatgtgtgaatatgtgtgagcatgtgtgtgagcatgtgtgtgagcatctgtgtgagcatgtgtgagcgtgtgtgtgaacatgtgtgtgggcatgtgtgagaacttgtgtatttataagaatgtatgtaagcatgtgtgaacatgtgtgtgcacatggtagcatgtgtgcaagtgtgtgtgaacatgtgtaccgtttcctggggttgtcacgacaaatcaccgcaaaccaaggggcttcaaacaacaggaatttttctctcagtctggcggcgggaagtctaagatcaaggggtaagcagggccacactcctctggtgggcacgtatgtgggtgcattcatgtgtgtgcacgtgtgtgtgcatgtgtatgggtacctgtgtgtatgtgcacgtgtgtgggtgcctgtgtgtgcatgtgtgtgtgcattagtatgtgtgtgtttccattcacagcacagccacagcctccagttatggagcctgttgacccacatagtgcctgtcaatctgtgcagtgcctgtttccccagcactcaggctctgtgagggcagggcctgctcttcctctctgcaggatcccaaaaaggcccaggctggtgctgagtacggactcagtgtgtggcccgcacacaactgattagacccagggtgcctatagagaccctcctgctattcacagatgggggcaggtggggctgggctgggtgtttactcccctcctggccgggccacggccagctctcctcctgcggtgcagaatccaggtgcccacagagacaaatgagcggccggagagccagcccatgataggcagctcctcagacctccccccaccaacccatcgggaagcagccactgcagagagggtgtgacccgtgggaggccgctgcccagcgctcaggaaggccggggcacaaaggatgctaggcactgggagtgaggctggcgccctggcgaggggagactggctgctccagaccctcgaaagccctggggcccagatcctggcagtcttgcaaaacagacctaggtgtcagacccctttccttcccgcaccccacactctaggctgcccaggggaatcccaaggagccttggtatcccagccagcctcaggctgaccagtgagtctacccagtgacggggctggagccctgtttggggtctgcgagctgcccacagctcacgccaagccggcttccgctctgtccatcaattcaggcccactgagcacaggttctcggggaatgctcaagagccccatgccaggtgggtcccattcacagatgtctgctcaccaaccagcaggaagctggaaagtacccccaggacagctagcagcccacagtgagctgtgaggcacacagcaatttggggctaattttctcctgcaaagaagttgatcccataatctggcaaatacactaatcgtcactgcactgctcagagcaggagcttagagctacagagtccggggggaacaggctcggcatagaatgagaccacggactgccggcttgaagaatgtgctgccaggatatgaaacccaaagctggcaatggaccacaagctactcccagtgacagaggacccaggccacagaccagctgctgtgctgggcacaatgcttctattgtcacggaaccctgcatccacgcccggccccgcttgcagatgggaaagctgagggtctggggctgcaggatgtgctcggcgccctgctgatgaccttccctgggccagcctgacccccggctcctctgatcctctctgctttaacggaagcaaagaatgagttgtaacagccgaggaccaaggagcagctcttctgtcaacagatgcaccggaaaatccgcggtggccgaggaagccctattttctttagtctgctcagcatttcttgtacaataataaaaacatctgaatttccaacaaatataatagaaagatttcctagaaaatgatctattctggctttggtcaaaaaagttgagagtccagccgggcacggtggctcacacctgtaatcccagcactttagaaggccgaggcgggtggatcaggagttcgagaccaacctggccaacatggtgaaaccccgtctctactaaaaatacaaaaattagctgggcatggttgcaggtacctgtaatcccagctacttgggaggctgaggcaggagaagcatttgaacacgggaggtggaggttgcagtgagccgagaccatgccactgcactccagcctgggcaacaagagtgagactccatctcaaaaaaacaaaaaaacaaaaaaaaaacaaaaaaaacattgagagtccatggctcacactgccctgagtctcacagagccagcctgggctggtgctgggaagggcttcccctgctggctgagggtctctgcagccaggacttgccactccctgatggcatctagaggcctctgtgttggggacccagatggcagcctcaggaaatggccagtttggggtggaagtgggctccgcaagtgcctgaaagggagtctcagtccatcaggcctttgctcagggtgccgtagcaaaatgccacaaactggtggcttctagacaacagaaatgtatttctcaccatgctgtgggctggaagagtcagtgtctggtgagggcccctgtcctggtttcttctcttggtgtcttcaaagggcagaaggggcaaaggggctctctggggttccttttataagggcactactcctcctcatgagggacccaccttcatgacctcatcccctcctgaaggccccaccttctaaaacaccatcacactgtggatgaggatttactgtatgaatttttcaggtgacacagaccatcacaccacagcaaagagggcctggtttttctttttcttttctttttgagagtcaatttccatctgattttcccagcaacacattaattgggtaaagccaaatccacatgagtaggtggggtgggtgcaggaaggagggtggcctgaggctcccctggctggccagggacatgaaggtgccctgcaggcccacagggtgggttctggcctccagggcctgagcggaccccccttgagccccaaggggtctttacctggctcctctctaaactctcggcctctcagtggtggagttctacgtggctgggattgggacatcagtggacccagggacggccccaaggaaggggctaggtctcagacataaggaggagggggcaggtcttcaggcccacaggcccgtctggggctcagagggctttgcccaggccgtccaggggcctggaggctgcagaacgtgcaggtgcagctgggatgtgtcgccaatggtaagcaggcaacctggggccacgcacagctagtgcagtgggctgagtggtgtctcccagaaagatgtgcccaggtcctaatctccggaactgagaatgggatcttatttggaaagagtcctcacagacataattaagttaaggaccttgagatgagaagattatcctggattacctggctgggccctaaacccagtgacaagtgtctttataagagagaggcagggggagatttgagacacagaatcgcagagaggagaaggccacgtgaagatggaggcagagacgagcgacgcagccatgagccaagggacgcctggagacacgggaagccggaagaggctgggaaggatcctcccctagagccaccatggggagcagggccctgccaggccctggatttcaaacctgtggcctccagcactgtgagtgaacgcatcgctgttgtctcaggccactcagtttctggtcatttgtgacagcggcctcaggacatgaatacagctatgcttcagagaggactgcacgaagctgaggcccgagccctgacctgggatcacaggcatgtgctggagctgggggcccactacgagcaggggagggctggggtaggaggggcgcatgcccagtcaggatccctccctgtctcccattctctagaacagtccctcaaggctgggctctggaatcctctgtaagttgctccatctcagaaagcctcagtttactcatctgtaaaacggagagtcaggcaagtccaccttgcagagctcctaggaagaatcgaggcgactgctgggtaacctgcttagcaccatgagtgcaggcaatgagcgtctacacagagagcctggggacttagagggatgcaaagagcctcttcgcttgaggcctgaaggttcagacagctaaaacatgggctggctactgcctggcatccctccctgatgaaaaataacaatagatcgtgtacagaatttttaaaattctaagtattttttttttctttactatgcttttttttctttttttcttttctttttttttttgagacgaagtcttgctgtgttgcccaggctggagtgcagtggcatgatcttggctcaccgcaagctccacctcctgggttcacaccgttctcctgcctcagcctcctgagtagctgggactacaggcgcatgccaccacgcctggataatttttttgtattagtagagatggggtttcaccgtggtagccaggatggtctcgatctcctgaccttgtgatctgcccgccttggcctcccaaagtgctgggattacaggcataagccactgcgcctggactatgcttttttcttaaacgtgctttagcttgtctaggaggatccagtacaaggcattgtgagatcaacagcagagaatggcatgtgctctccttccagaggcacagcaagaccgcctgccccagcctcccctgcagggaggaatgaccgccagttgagattgcagtcaacggaacagaagcggaagtgatatgcactttctcttctgccagccagaggcggccgagcccggtgacctgggcatctgcgtattcaggatggaggagctgggagctgggaggagcctgaagctgcttggaggagagctgcctgcccgacttgagaggggcaataaatatctttccacggctcaaatgaacagccagttttcagtatgtggcttgttacggtgtccagcattgcgggcacggacacacaatgtctaaaatgggtgcagttctacaaagcacacccgagatccctgggctgtgggcagtccagcgggcaggcaagcccctgccccagcttgcagctgtgctagcacaaaagggccaatctctctgggcaagggttgcactaggcaatcccactggggatgactcttctgggtgaccaaggttcaggctctttcctgggagttcctgggtctggagagaaggctacgggggactgggtaccaggatgggtaaggtcagaaggacaggggctggggtcactggcattcccctgagggaggccgcatttcacaggcttttccagttggtgaagcctttgcccgcagggtctctttaaaaggaaaccagacaaagccaacccaatacttgctgcgctgcgccctgacctcaaaccatcctgcctagctactggcaattaggctgcctttgagataaattttctcgcctaaaaatgcccatgggtcttaaaactttgattttccgttcgattcaaatttaaatccagaatcgcagtgctgtggggggtgggggggaaatgcccaggataaagacaatgtcctagctaacaaaccaaccagtgagtgacagaggggcctcagcaggaagtctgggcagaacggagcttgctaggtcaccccatgtgaactgctttggagaacagagtggtagctttgttagatttatggggacggcggctcagcctgtctaatcgcagttgaggcggggccgagaggtgtctcccctgtgtccacgctagctgggtgcttccctcccacggacacagaggccgggctgccacttccatccttcccctgacacctcccgtcatcttctgggaaacaccaagtgacacaaacaggacactgatttcctggaaatttatatctggctcaggagttgcacctgctgaagaggtgaagatgacaaaggccctccatgcgactgagaataacgcagagatggtccctcaggcttgagagccataatttcaccagctcgtttatttctaattagataaagaatacaagtttttaaaaaaagttactttacagaagagccaaggtgactacagttaataataatttattgcatatttcaaaatatacaagagaagatttggagtgttcccagcacaaagaaatacatgttggaggtgacgacatcgcagttatcctgatttgatccttagacatcgtgtgcatgtatcaaaacgtcacatgggcccgtacatatgtacaattactaggtatcagttaacaaatagctgagccccctgtgactcaccctccacccatctcttcctccaacgggttaccttggaggaaggcttatcttgaaggattatcacattggtgtggagctttccagaacttttgcataacatttatgttcccttggaaaatgtggagtacagagaatacatataatatttttgcatgcttttttaaaaagcagaggccgggtgcggtggctcacacctgtaatcccagcactttgggaggccgaggcgggcggatcacgaggtcaggagatcaagaccatcctggctaacacagtgaaaacccgtctctactaaaaatacaaaaaaattagccgggcgtggtggcaggtgcctgtagtcccagctcctcaggaggctgaggcaggagaatggcgtgaacccaggaggcggagcttgcagtgagctgagatcacgcgccactgcactccagcctgggcgacagagtgagactccgtctcggaaaaaaaaaaaaaaaaaaaagcagaaatattattatactacagtggttggtctgtgacctgtggttagtatttgggatggtgtcttgggaatcacgtcgtggttggtatgcaaatattcctctttcttttatacgttggcattgtttttggtcatttgaatgagggttgagctcctgccatgtgctgggtgctttctcttgtaggtgagcaagaaagacagtctttgctctcatagagttatggtcccatgggggaagactgaccaacaacaaaaggtgaacagaaaccataccgtgtgctggccagagctatgaataaacaggaagccgactaagggactgcaggtggaggggggggaggaacacagaggggcagaggagatctggggtcgggggctgagctggagctctgcccagggtctcagctgacccaagggtttgtacgtggcggcgagcaggggttatcactggtcctgtttcagagctaaggaaacatgctgggacttgccccagatttaacaggaaagcccaactattcaaaagttaaacaacaaaaagtgaagaacattgcttttttaaaaattccaaatttaaaaaaatgtagtagaagacacaaagcataaaatttgccattttacagtggccagttcatggcattaactacatttacagtgtgtgcagccatcaccagcgtgcatctccagaactttctcatcctcccaaactgaaactctgtccccattacacacgaactccccatccccttccccagcccccgacacccaccatcctactttctgtctctatgaatgtgacggatgtgactactctaggaacctcacttgagcggaatcatacagttcaaaggaagagaatgttgtatttggccactcctggcatctgtccatctgcttcccgatgggtcccaggctggatacctccatgtggggtggacgcagcgacaggaactgagggggcccccggccaagggcaggaccagcagccctcccgcatggcagctcccgcctgctgcaaatgcaagagggaggttgatcttggaagaacacacctttccaacatgcattcccagagacaatgcagatctcagcaaagtcaggggtgaggacagtgctgaaatccatctccagacctgcttgctaaaccccacagtgtcactgagtcccactttgctgtgctcatttcattgattccttcctttatgcattcagcaaacaacagcccatgccttttgccaagaccgacacctgtgcctcagacaaacacgtggagaagaaggtgactgcctttaagatgaccccagcctggcagggactatgaacaagcaggaaattcatcaaaagatctcgtcaaaggctgggcatggtggctcatggctgtaatgccagcactttgggaggctgaagcgggcagatcacctgagttcaggagttcgagacgagcctggccaacatggtgaaacccagtctttactaaaactacaaaaattagctgggcacctataatcccagctatcttaggaggctgaggcaggagaatcgcttgaacctgggaggcggagattgcagtgggccgagatcacgccactgcactccagcctgagcaacagtgagattctgtctcaaaacaaaaacaaaaacaaaaataaaaaacacatcaagaatgctttgaagaagcacacaaggtacacacaagcttcatcctgctcaatgccagaatcccggtgttgctggtcggaggcaggggctgtctaggggggctataggctggggatagggctggacatggggctgctgggcacacagcctgttctccaggaacaacaacaacaacaaaaacaaaaaacaaaaaactgaacaacaaatcagtccactgtaatcagaaggctcatcgaaaaacactctggaaaaattaactgacaacaaaaaatgtcttcccggaaaagatgaggctgggcccaatacaggaattaaaaccaatcactgctgaccccacacgggtgctgccgaggttcagctgctatatttacaacaagagaatgatgcatatgtcacgaattggaggcaacgccacctgccacaggccctcagggctgagtcccctcaaattcagtggccgacacctcacagtttcgcttcagtccagcagcagactggggagctggggcaaggcagagtgccctgggctttgagtccagcatcggggtggccaggacccccgagaaccctctgaccccctgccctgccacagcagggcatacagtgttcaagaactctggagccggagccagacttgggtttgaatcctgccctgtcactccctcatcatcacctgtgatgggtcatcctatgttcaccaaacctcagctgttccatgtgcaaactgacactaatgccatctccttcctcacactgctgagcgtggaaggggaccctggcatacagtaagtgctcaagaagtggcagaggtcattattgaaacagtccttgttattgttcccagagctgtgtggacccccagaactcgcatgctggtagcctgtggcggcaagggcagcgtttggatctcctgtgcttggtgccccctcaaacccaggacattcagtgtaaatgactgtgagcctcaggctggaaagatcgtttcccttcccagctagaaagactcatccatcaggctgtgtcagacgcacctgagccctccagggtggtcaaaggtaaggaagcttgtgtcccaagtgcagcatttagggcttcccaaggcaaagtgcccaatcaggctctctactctccaagttcgtggtgcatggtagccacagctcacctctcccaatacacaggatctccaagggccaccctgccatccctcaagttcctcagcccatgttttccctccttccttcagtttgacaataggggtggagcaaccactttgcaggatgtctctgcttaggggctatggagaagcatgggacctgaactctgcactctttgggaagaaggatcagataggattcaaatctgtttcaccaaccactaggctccaggcttgagcctaacaagcagttgctcaaaataacttggtagatgtgtgtaacccagatagataccctaaccccacgtggtccagtccttgttggaaagattttcaaggaatcacagtccagataccaaacagatagaaaacagggtttctgatctttaatagtacttctccagttattaaaaggaatctaacttttatttattttatttatttatttatttatttatttatttatttatttatttatttttgagacagagtattgctctgttgcccaggctggagtgcagtggcacaatctcggctcactgcaacctctgcttcctgggttcaagcggttctccctgcctcagcctcccgagtagctggtactacaggtgtccgccaccatgcccagcaaatttttgtattttttttagtagagataggggtttcaccacgttggccaggctggtcttgaactcttgacctcaggggatctgcctgccttggcctcccaaagtgctgggattacaggtatgagccaccgcgcccagccaaaagaaatctaacttaaagcacaaagcaatatcttttggtagccccaacttttatcatctgtatgtagaagtaagcccccagttttccttcaagtcttgcctgtgcataacttttgttccttccggctttctgcctaagctccctctgtttctttgttttcctctttcctctagaatctgcatcacagaagatatccagttgggcaagaccccgcctccctgacaggtggcacaggagggtggttggagcaggagggtgggaagtgatacgtggatcttggaagaacagcctggctctaccactcgccgtgtgtctgtgggtatgtgagtccccactctgtgctgtggcctcctcatgcagagaaaggagctgataaaagtcaccgagttaaacttaacacaaagtgagttcatgtgtgtgaactctctcaaaaacggtgctggcacacagtaggtgctcaagcagcgcaagcattttacacagtcactgccgtggctgttcggagtcttatttgcagtctgtatcatgctgctcagcagttaagcttttgttggatctgagctctgtcttaacaaaaggggacaggacccccttccctctgcggtccttctgcccaggcatgtgacgaaggtggtgaactcagcactcactgaacacccgcccatcccaccccggatggggactctggggtgtgcatcagcagtttcaagaaacacagaatgaccacctgacccagcaattccactcctaggtatgtaccctaaggaactgaaaacgaaaactggtacaaaaacgtttatgtcgacattattcacaaccataagttagaaacagcccaagtgtccctgaactagtgaatggataaactaattgtggtctaaccacatggtggaacgttattcacccacaaacagaaggtagtacggacacatgctaccatacggatgaacctaaagcacacgatgctgaaagaagccagacaaaaggttgcctagagcatgattctgtgggtggaaaatgcccggaacaggcagacccaagacccagaggggatgagtatttgcctggggctgggagggagatggagagtgagtgctaatgggtttgatggtaaattttatggtctgtgtattttaccacaataaaaaagacatacccaagtgaaaaaaaaagtgtataaacacatgacaaaatgtattactaacagacacatataaagaagtaaaattccacaaagataagccttgttatgcggacactgtctcctggtggcagcatccctggttttttctttggcttctctgcattaccaattttatttgtgtctgacatgatttactcgaaacacagtgaaataatgctaatgtaaaagctggctatcaggcagatatgggggtaaagtttactcaaaatttcctaggaccaggggtacaattccccctgtaaacccctcaggattccagtgggcctggggagagaaggctggcaccttccagggaagggctggcttctcacgctctctctgatgtaaatgaatccacccctccacctccatcagcttttcaagttcaggccctgatggagagggggaaggggtttgggaggaaggagacccttgtccaagacggaagttctatcctggctgtgctctcctcagtggtgccttcctttccttaaggaatatttattggtggcctgccatgtgctcggctctgggtggtcccttatctgatggggcatgtgcaggaagtgactatggcagagggttatgagcgggcatcacaggcaactttcagggagcagatgcaggaggtgccctggtaaagcaggtggaggaggcaaaactgtgggcaagtgtctggggacaggaggggtgtggcacattccggagaccagagagagtgtccaatggcgacgttcatctcctcactggcctggcacacgtgccatctccccttctcacccatataacccactcctccatctgcaaccccagccctgagggtgctgaaggaggtgcacatgcccaggaccgtccctgtctatctccatgaccccctaggtcctgccatggagactgaacacaaaggagatgcatgggaaagtctgctccatgggacccatctgaagatcctggggagagggaagtagagaacttgctggtgggtggttgatttcatgagaccacagcggggctaccattctcagggctccacagcatcagctctaactccccttctcatcccactctgcttactgttggcgcacacacaccctaattcccagggctgacaaactccatcaattaaaagatcctgtggggcacttagcacagggccttcctccagttcatttgccagtctaaccacttgtatcatgaaactccccacgaaagggcaccaaaggcgaagagaaatcagtactaacaagagcctgctgagaacactgggaggtgggcagtgggtgtatgggagggaggaggggggcaggtggagaggacccagaggcaccaatgggtgcatcagaggacctggcgccagcagcttccaacatggagatgtcagcccactatgcctcctgcagccttcgctccatgtagcctggggctgggtgtacagcatccacacacagaaaaagatggctgttaagattacatcccaatgatctgggacttacctggagcatcagacagacacagtgcaaaagaaacaagctttggagtcagcttagattcagacctccctggagggccctgggcaggcttcttaatctctctgaactgtgctgcatgctggagatgtagcagagacctggtcagcaaactctctgacccacagggaatgttccctgagggaggtggatagtaagtcagtcacctaacacgggagatgtatgattcctatggtcatggaagcacacggtgtgagtgtgagagtcagggcaacctgagggtgccaagaggggcctctctgagaaggcatcatgtgagctgaaacctcagtggtgaggggagtggggctcaaagcagatgcagatggacatggcaggacatagcagatgctcaaccatgttggctccttggcccctccttgtggaagagatttctccatcgagtagatgagactgtcactaagtaatgagcctctatgcccagaaactccaaggacacaggggacagaaatgaaaggtgcagggatggagggaggggacatgctgagggctttctccagactcctgaggaaggctgcatccaatcctcccagctgtctagttcagcaccctgcagagagccagtgccctggagtggttcagcaccctggagagagaccatgccacacaagggttcagcaccctggagagatccagcaatgctcttgctctgtgcagctgtacagccacacacatttgtacctacttcactaacaacccaggcccccactagaccagccggtcatgcccagcttcatagcatctgatcactccccaaatccaccttgaacattcctgaccccctaagcttttgctcaagaccttcctcctcagttctgcctgcaaaaacctcacttacccatcaaagcctggagccaacaccatctttcatgaagcccttttcctgatttactttggggccttcaccacactctgctttttgcctaccccttctagactgtgtgttcctcaaggaactgtgtctgattcacgtctttcttccagcccagtacctgggaggcagaatgtatgcttcagaaatgaatgagtgaagcttcagaagtaatttttacaattgccaccatttgttgagaactcatgatgccagaaactgctacatgcttcacacacacttttatttacagttcaagaaactgaggccaagaaatgagcaacctgcccaagttcacacagttaggaagaggcagagcctggattcaaacctggatcatatggcacagcctgtgcccttgaccgcggctcctctctgcctctctccaaccctgtgtgctgccatctgccagtcccatggcatctgagcacagcagccatggtcccctgaagtgattctgaatctttttatagcctgaaattgaaatcactgatgcttcaaattagaaccccaaaatgaacgagccaagacttcagatttgcagttgccgagctgcccgcatccaccttctcagcaagattcctgggccactcctcagcccgaaccacctgttcccagtcaatatggaggacaaagagaacgacctccccaggcccagaaggccacatgcagaaaagggatccaacctccccgccatccagggctccccacagagcagtggcctctgtctgggagaagaaagaccacagtgcattaagcctcagagagcagaccccaatgctgttggcctcagagactgaagatccccagtgctattagccttagagagtaaaggcccccaatgctattacccttggtcaatggatcctgacgacacggtgagaagccactgagctgccaggacagaaacaccccacactcaagagggatgcaggacagaccctgtttgtctttggtgtgaatgcaatgaaatattggccttgatgaccaaagcaccaatgtgaccctggctgaagaattcagcagtcaccctgggttcctgctaacatcagctggtgtttggtctttaacttggttattaagtagccattcaaaaccatctaaataagagtggaagaaattttggggatggggtggagagttcctagattggtcatcaggtccaccagcaggacatgtgacaaagtctctcacaataccccaaaaggaaagctagagaaatgtgagctgtgtgatgtggctgaaccactaaacccaagggatgctggcaccaggcaaaccacaacagggctctggccttggccctgggatttgctgctagagggcaaagtgggcatcaggaataggaattccaaggtgatctaaaagccagacccatgccaacagagaattgtacaggctggtaagtgctctgggagcagtggtttgagccaaaggaggagatatgcctgccagggactttggaggctggcgggtggggtgggacaggtacctctattagtgatgttcctcacaacagaggcacaaggaaaccatggctcatgtactcttggctggaagtgtccgacgtacttggcacatggtgggtgtgccctgtgactgctacatgcttcaaataatagtggtaacaaacatcagtcattattataatattattatccccgtttgttcaactaatagccactggtttcctcttctgagtcaggcatcattaatgatgatgaaagacaagatgataatcaatgacaaatactgactgaggccgggtggggtgcatgcatctttagtcccagtacttcaggaggctgaggtgggaggatcatttgaggccaggagtttgagaccagcccaggcaacaaagcaagactctggctctataaaaaagtacaaaagttagctacgtatggtggtgcgtgcctgtagtctgaactacttggaaggctgaggtgggaggatcttttgaacccaggagctcaaggctgcagtgagctgtgattgtgccatgcactccagcctgggcaacagagcaagatcctgtctctaaaaaagaaagttgattgaatgccagccctgtgctcagcgcctctgaccagcagtccagtgctaagagcccagttcagcacaaccacccattttatcaacacgaatactgggacccagcaagcataatgactgatcatgctgcatctggacttcattttctttcccttttctctttttttgagatggagtctcgctctgtcacccaggctggagtgcagtggagcaatctcggctcactgcaagctccgcctcccaggttcacaccattctcctgccccagcctcccgagtagctgggactacaggcgcccaccaccacacccggctaatttttttgtatttttagtagagacggggtttcaccatgttagccaggatggtctcgatttcctgacctcgtgatccgcctgccttggcctcccaaagtgctgggattacaggcgtgagccactgcacccggcctggacttcattttctttcctccaagtaatatttaactctgaagctgtggggattgacccttgagcagcgagctctaacaactgttcttcacaccagcttggttgcaaagtcaaacatgctagaggccacctcacatttctcaagtcccattttaaaataccagcccaagaaacatatatatttttttcaagacagagtcttgctctgttgcccaggctggagtgcagtggtgcgatctcggctcactgcaacctcccgctcccgggttcaagtgattctcctgcctcagccttccaaaaaaaaaaaaaaaaaaaaaagaaagaaaatgaagtccatattcagcatgatcagtcattaggcttgctgggtcccagtattcctgttgataaattgggtggttgtgacagtagcagaatcacctgagatgaactgggctctcagcactggactgctagtcagaggcgctgagcacagagctggcattcaatcaactgggattaacaggcacatgccaccatgcccagctaatttttgtatttttagtagagacagggtttcaccatgttggccatgctggtctcgaactcctgacctcaagtgatctgcctgccttggcctcccaaagtgctggaattacaggcataagccaccacacccggccttatgagatactcccagggtctccgaggaaaacaccagggcatccctcttagcatcctgacttaaatacaaaccacgagtataaagaagatccacgccctctctcgtgcaagtatttaatacgaggaaaatgtaattagcaaactcgagcaccacttttcaaggatgaaggatactgccacctgctttaactgcaagggaaaacctatttgcagaaattaacacaaaaatgagattggccacttcagggccaagaaaacaatcacaaaaaccataggcgtcatcagagccctgcagcaggcgggtaaggaatggccccgggaaattaattaatgcccaggaaggctttttcctctgacagcaaacagcactatctgtgccaagggggctgaacatttgtctcctctgtgagataactttcttctaagacacagtttcctatgtatgaaatggatacttttcaaaatatgaatacttcgattctaggaaatctgagacaaacatctgaaagaaagagaaaataacacaatctcaccacctaggggttaatatttcctttcctttttgttttctattctatgactatactggggaaagatggtattagatgatattgtgctgatcattttgattctgcctttctcactaagtagaatgtaaccttttctggttggtattaagagctccttgtaaacatcatttttaatgctttcttatgaattcacaacagatgtccattgccactgaaccattctcctattagccccgccccctccctgccccaactccttgtttttgccacactgtaattgctacctggttttgtttttgttttttttgtttttttttttttgagacggagttttgctctgtcacccaggctggagtgcagtggcgtgatctcggctcacggcaacgtccgcctcccgggttcaagcgattctcctgcctcagcctcctgagtagctgggatttcagacacgcaccaccacgcccagctaattttttgtatttttagtagagacggggtttcatcatattggccaggctggtctcgaactcctgacctcaggtgatccacccgtcttggcctcccaaagtgctgggattacaggcgtgatttctacctgttttttaaaaaattattcccttagcatggattcctagatgtaaaattcctggttcagctttatggctcttgttacatactaccacattgattgtgaaaacatttatggcaacttaggctttcccccagcaacacatgagtgctgtcaccagcaaggagtatagtcacaaaaaagtatttgctaatttgaaaataaaacagtcaccgcactgcttttctttttaccttttgcccatttatacataaagcacatcaaagtgttgttcaggcatctttgagccatgacattacagagtcagacaatgtgggttggaattccaccttctccactcaccagctacatggccatgtagttactgcacctatgtacctcagtttccccatctgtaaaatggggaggaacacacatgctatatggatgactgtgagggttaagcggagcactgcagggcttgtagggtttggagatccagctcagctgctataaacaaggacacagccttcttgggacatttgttgcaaatgttgtttgccctctgcctgcctgctgttgagttgaactgtaaggatgtctcagttacaggatattttagatcacaaaagtcattcaagaaacaacatttaggttgtcaaacaaggggtttgtggaagacagtcctagtcttaagactaggagattaacgcagcacctgcttgtgtttgggtcgaggagactttagttggcaggccacatcaagaggctggaatgtcaacttgcactgggccagtgggtcatcaccttgcctgcctgttgggacccccggcatcaccactgcagctttcatggatgcccagctctcgcctcatgattctgattcagggcgtgtgggctggagacgaggtttctataaccctcaggtgactgacgcccagccaggtttcactgagtgagacctacagtgagccctgcatgacatccaagtggcgtccccacctccacatctccttacacacttgatgcactaccgtcatccaggaaccacccacatcctccttagcacatgtcgtgaacttcagaagcaacctgtgatctctccagccccatgttgtgggagtgaaggggcctaataagggccatctcaaagagacagcagacaaagtcttcagcaaactcttatggcaggctcactctcctttgaaactctctggtctcagcttcctgacaagctctaatcattatgaaaaccagtttggactgggtttcctgttgtcaccagagggacatgggcctctgtcactcctggctggtggaggccccatcctcacctctgacctgcatagaaagaaacacctgccctgcttctctcgggggctgtcactgctccaagcctcggcttcagcctccctcagcaggtcccacgggcattctccgcaggggcattcaacttcccgccgccctgcccctcccacggcctctgaaatctctttggctccttctcccctgggctggctgacatttcacaatctgggacggcttagtgtcactgtctatcctgggaattccggcacactagctgatctgaaatggcaaatcgcaccatccatggggccactgtgatcaaatgtccctacccgtgggacattcacttatctttcacgtccacctctgaggtgaaccttttattaccacacagcttgagtgataacatctatctgtctcatgagactcccgatctggagatagctcaaagcctttgattgtggttggtagggtcagggggtggtcaaccaaggaacaaaaacaacagcaaaagaacaaactcttcccaaaagcttaggtaggagagaaataaattctacaagctaagtacccaagaaagtcatgcacagcaggaaatcatgacaggcaccaaggccgagagccggatggccacgtcggggcattctcacaaagttaacgagggaaaatgaagttctagagataccaaagacattaaaagccaacattcacttcaaagggtgcccattggtccaaaagttcaaaccgcagcatgcatttttaaagagaaaataaaaatctgtcacactttcgaggttctttcaaaatagcagagagaaaggaaggcttgccaagggctgcttggggtaaggaagacagaatgcctgcattttgggcagcttttcacgtggagaccttgcacctcaccgggagctcagaaaccccactgactccaggactggctgctcaccaaaaagaaaattcacgtgagacatgtgaggctatttcacaccatccctccaaggtcaaagctcttcactaaaaatagagaaacatggtctgttggaacaaacacgcacctattatgctatacaagattttaatattccggtggcaaaatccagtcgctaggaacacaactcaatggaattctcagtcttaagcccctagaggagaatttctgagtcccagaggcagctgtggacatgaactgggaggagccaggatcgtgcaagggtccagctgcctgcaccccgcaccctcattagtgtatgactggtgtggagcagcctcgtagggctgtggagggcccagtgctccttgggttatctgtgataatcataatgcaggcgcagccctaatgcatctcaggaccagccattcctagaatactggaagtcagaggttacccagaatataaaacctgccccaaaatggcaaatctatttgcataccagaggttaaaagcaatgtcagaggaggtgcttagaaacagaagtgtggaaactctcaaagctccaaatttccacaaaggcttcaaaccgacaggacaggtccaccttctcagccccacccaggtgagcgctgcagccacagacagctacatcttctaacccactgaggctccgctcactgggcaagtgcagggcccacacacgtgcctcagcaggccacgtttctcttattgatgaggttatccaggaaacagtccaatgagctgaacaacgggggttgttcttgcatctgcagccctcttttattattgaaaatcaagaaccaagagtgacctatttcaacaccccccccaccctgcctgtcacacgtgcacacactcttacaccacctatagacttcagccctgctgctaggcccaaggccacgcccccccaacacacacacacacacacacacacacacacacacacagacacacacacacacacagacacacacacacacacagacacacacacacacacacacacacagacacacacacacgaaggggactcacatcccaactgcatcctacagaggatgattcaacccaggccctctgcatttccatgaaggttacaaatcgagttagcccacaaagccacagcgggctccaatctctgtcattctggtggtgcacccgacagtttcaacacacaagaacccaaataagctcatttctcattcaaaccaggttctgattggtcaataataatttaaatgcatcttccagcaaatcaaagagatcaacatgaggcactcagaataagtttaagcacctgctccatcttacctggctctccaatagtctcttcccttctgactttccattgccccgtaatagtcctgaggatctctaaggagatcactagcagaatcatagcatgaacaagaagcttgggagcttaggcctgattgggagaaatgatcacgggtagccctctcaccacgggtggagatgtgggctcctcatttacagaatgaatgtctgtctgtccagcccaatggcagggaccaccaaatggctggctggatgccacgtacccaccccttccacctgcatgtggagttctgatgtacacgaggctgggctcagggtgacatggaagagcgcgtgcatccaagaaatgcgcactcccaacgaggaccattcgagtctactgaacctttaaaatatcatctttttcaacctgtaacattcttttcttcttcctacttccaaagagtcacatgttcctttgcataacaagattaaaactgaacacctaaactcacaaaaaggcgaggtgatcagatgtactggggcctccgaacccctcgcacacaccaacgtgccaaccgtagggactgtttgcagagccggagcactcaaacctctattctctaaaggaagagaatgctctttccttttcagtaccagcaaaagttcattttcaaagcatctgaattcctaagtttcctttttgcaccatcgacaccagccatccctcttgcccgggctccttggtcttggaaggccatcgtccatctgatggggtggttaccacaacctgcaaatctacaagctcttagccatcaatgttacagacctcacgccagcaactgccacacaagagtggttgccgactcacccataggacacaagaagggacgatgactcctcttggtgcctatttagtcacaactaaaccacccacaggtctgcacatgtccccaacatcatggtgaccacatgcctcctctttctaccttctacttcaagaccaatgaccaaattccacagacttttcctccttccaacgggttacggccaaggcctccaagacaagcccaacaccaggtccacaggcagtggcacccacggtgggagaaactgaccaatgaaagttcatggcagcctccacaagcacccccagactgggcctcgtggctgtgctgccaggactacgaccctctccccgagagtcggcgctctccccaagcagaaagatacagacacctgtgtccctacctcaatcaagaagtccccggtccttagtccggcttgccacgccaccccaccttcatccacggactccaggtactgtagggctgggaaagccggtgttggtgtgaattcttcaatgggtgtgtcagctgggaagacaagcagcacctggttacaagcctgggagatgtcttccaagttcacattgcctgacctccccacaggaccccgggaggaagtgggcccactcatctcccattgcaggtggctagtccaggccaactctcccccaggaagggcttgagattcatactcatgggctgatgcaactcaagcaatgaagtcaattgcaccttggggccgccatcatatttcttggcctctctgctgaaaccacaggataatgtgctctgtggtacatgtctacacgcctgtcattttctttaaaagcatcagtgactaaacattttcggttctaaaaatggaaaagttcctcccctgccacacagagctacagaaacaccacactaaaccacttgccaaatttacatctacgtagactcgcaaccaagggaattcaacttggaacgcggacggaacatcacgctgacccagtgggtggctacagatttggaatgtgctcatgagtcctctctacagggagtccaggcctctgtgaccactctgtgtgtgaccagtgtccctgggcactggcatgtgtgtgtgtgggtgctgaaccactactgcccagcacagtgaggcttggcttctggggccccacacagctgccaggtgcaactccagggcaggagatggacttttctagggaggcatgagtggccaagggtgggtgggtgtggagataaagattccagcagggggaggggagagcaaatcacacagacaggcgtggatgctctcacagagacagatgcatctgctctttctctctctggacagctcgctatggagctgcctgagtctgaggcaggtgggcatgccagctggggaggaggcctcctgcagcacaggtgcgggacccctggcacagcgcgtaagctccaagatgaaacttccacatggctgagccacacacacagtgggcggatgtcccctctcatggggaggtgatgccattttgttttcttttggaggggaagctgcgcgtgcagggtgactggcaggtgcaccgccatggactgcattcctgagcctcccacgacgggccacgtaacgtgtgtgctgccggctcagtccacggcagaggggaccatcttgtcacatttcctttgcaaagtcaccttagaggtgagcacacaaatgcctgccgcccttggagccaaagcccactcccagaatggggcagtttctaggtgcctgaaactcaggccagggcaatcctggggatttgagacccagagctctgagggtagccacagtctggctcaactagaacacaaaatactgaccaccccatcatttaaaaacaaaaggtaggaggggcaggagggagagagaacccattcagaacaacatcatctacagaaaattaaaaacattcctcaaggaagccctaacgttttctgagtaaggcacaatgtgaaggaacatggttgtctagcaactgagtgcccccaggaaaaatgcttatttaatgcttattcctgagctggggaacgtttttcatgcaggcgtatacacacacacacacacacacacacacacacacacacacacacacacacacacacaaacatgggaacatattcaggctcagagcggctgctcttacctttggcccctcgaagcacgaatccaaagccctcattgtcttttttctgcaggaccaccgtcttctcctcaataatgcagtcactgtagagagaattccggggacagcgaccattattgtagcccgtcatcatcaccgcggccgctcctccgccggggacgttcatcatcatagccaattaatcaccccagctcgccagatccaggcagcatggaggaaaggaggcagcgagggtgcaggaggagcgaaggaagaggggggtggctaccgggataggcgagcgtggcacaatgagacttgcagggtgggggcaggcagagccggagccagccggaggaaggagtcatacatggtggggcggctgcctgagggatggctgagctggaggctcaaggggggctggccaggacgccgcccagggcaaagaaagtaagtggcccgaacggcggcggcggcagcggcggcctcagcagcggcggcgtcgggaatgagctcctccggcttgtcccgaccacacgcatcttccagggaagcccgggaaaatcagccagaggagaaatgaggcagcagttttgttttgcttttccttgaagggggtttaaaataaaatcaaatcctatctgctccccgcacgagccggcagcaggcaccagagacgcagggacctgcgcgtcgcatccagcgccccctccctctcccgtcccggcgccggcggtgtgcggcaggcaggagcccccacaatcatctgacgagcccacagtgcgcccggcggctgcctgggcgtcatcccgcgcgagcatccgcaggctgggctgggagagggcggggagggggagcggctggggctctctctgcatccccccctccagcgtccccccggtcccttgcagccttggaaggtggccggtggccggtcggggaggggtgggggctccctggcagaggactcaggacatttcggtgttaaagcccctgaggacaccagccccctctggggatgatgaattcattgctggggaactggagggggtatgtggctgcccctttgagatgacaaagctaaagccacaactgcttgcctctagccatggcattttttttttttaaggaaagaaaccaaaaaagctccaactttgctctagtggccacagtgtcctctcgcttttcctgctggcactcgccacatgacatccagcccccgaggcacccagagtgtgtgggacggtgccctgctcagtgagcctccaggctgcggctgaactgtcctccacccccaccttctgggtggcctgcgggggcagaaggggagtgagatgaaggctaccggcacccccccgccccgtaggactctgctgctgcccggaagttagtggggagctgggaaggcctctgtggaggggagcggggaagggagggaggcagcgtggagggaggcctctacagggtcttgcggggctgtgtgtgagcctcgggggtgaggagaaaggacaccaggccagcggcccagccggaaaaagctgcagatgggtcatgaggaacccaccaggcccccgtcgcacaggggcagtcccagggatgcaaatttcaaacaaggccatgtgctgacggactcttggtcccagaggagtgcgggtcagctctgcctggcaccagcaccaggttcacggtctacaggaagcacagggccccaggtgcagccagctggtgacagcacagccaccccggattggggggccctggggaggaggagggacggggcaaacgtggatgacagggctcagtatcctggacaagggacgagcagcggcccctcgatcctcccattttacagatgaggctggtgaggctcagagagatcggaggacccagctagggaacgcgtgctcttctcaccactccacgcacccacccccgacagcatcagagggtcgtgcatggaggcatgctggggtgaccctgtcttccaggaatagcccagcatgaatgatagcttcacagccgaagaccaggacaatccaggtgactggtcactcccgttgtcagcagctgggaggggggttctggcccctgaccttccttaccttgccccctccccagagacagcctgctaagtgcagggaggtccactctggggaactcggtcacaactgtgagcccctcttggctcatccctggaagcccacttaccctgctcagggccaccaaacaagggctgacacagggtcagaggtccaggaccctgggagcctgggggtgaggtcacatggttattgtgacctttagaaaatgatggggctctctaaacctcagtttccctgcacagcaagagtgggtaagaacaaacctacaggcctcttgggatcaccatggggtcagatgaggccatgccatgctggtgtggtgtaataggatgcctcaggccgctgtccctgtgacggctgccattaacctccagcaggcctggtaggtggccaggactctgcagccctaaggaggctgagcagggagagctggggctctactgccatggatttaggggtccatgaggcattgatgagcagaccctctaccaggtccctcgacctgtctccacggccccccacaacgagaacacagacttgtgtccctcatgggaaatgccttctagtcaccacccattttccctctgaactcctgaaaggggagtcagcccaccccggccccatggctcactcacggctggggaggcgcaagctgtgtgaccagcctgtgtgtctcctgtgtctccttcatggaaggttctctaaaggccaaggctgccaaagccaagagcctctgctcaaccctgctgtgcacctgctgtctgcaagaggagctgctgagggtgaccgcctccctgaaaccctggaaggatgatgccgaaccctggggtctggagctcagggccctgcactctccctggggacacatgggctgatcaagtccatctccacccagctccaaggggaacctgtcatgcgctccaggcgtgctcacttgcactgctgggcagctcctcctgcagtgcccaacgccatccaaaccttgcatctccaagatgacccagaccacttcctgccagcataccctgcgacgggaacttcttagggccaggggggctgcccagacacttgctagctgtctcccatagactagagaagggcaggggcattccagtgtggctggtggaggcacaggctttggcatcacacggagcgtggttcaaatcccagctttgctttgaccccaaggtcactgacctatcaggccccagagcctgctctgcaaaatgagaacaacaagatgcacctgatgggtcctgagctggaggccgtggagtcgtgcatccatgcctcagaaccagcccaggcaagcagcacatgttcataactccaacagttacaagtgggatccctgtctgcacacgccaccctctcttccccggacccccttcctcctacagggacccctctgatctcgacatccagggctaaaaccttttcagtgattcctaatgcacccaagaacttagttttttaaaattagagacggggttttgctctgccactcaggctggagtgcagtggtgccatcacagctcactgtaagtttgaaccccaggcagtacgtgatcctcctacctcagcctcccaagtagctgggactacaggcacacaccaccatgcccagctaatttttaatttttttgtagagacagggtctcactgtgttgcccatgatggtcttaaactcctggcctcaagggatgctcccttctcagcctccaaggtgctgggattatagacgtgagccaccacaccctgctccatctgagaattttctagcccacacttgtaactgtgcaaagatcttgccccaagactgtaatggccctgtcctgtttattcagtaaaacaccaaactgcttagtctctgacattaagaaggactgtttctaacttctctttccggcattgtttcaggatctaaacagcccccactccccacccaccatgaacccatctcactttcactggcagacagacatgggtttgaatttcaacccagacattgaccaccttgactacttacagcctcaatttcctgacctgcaaagttggggagaaacctctggcttgtaagttttaggaggagcaagtgaggcgatgcccagtgaatgctccatgagcaggaggctccttgtaaccaggggaagctgctcttcttagcatccccgtccaccttcttgagctgggtgaccctggagaaaatgtcccctctgagcttgtctcttgtgggggaggggacattttctacaaggtcaatgggggcagtgacctcatcctgcagaccaccccaaatgcccacagcaccccgcataggccaggtgccccatgtgtgcccagaggggatgcaaaatgggtatgaactcaagtcaggagcagagcagggagaaacggatgttgggtgggaggtgggcgaaggatgactacagggtttcgagtaaaaaggcaccagaacaatccctggattcctagttaaacccagaaggtagactcagtgctgcagaggacctacggcatgcacctggcttggcccaggaagtcagagaggaaacagaaaaggcagccccaggcccttagaaactttcaatgttttggggaattcatgaaaagcaatgggacactctagaagagacattccttgaaaggagctgcagtcactgtgtctgaaaggcggaacttggcagcaccccccatccccatgcaatcagacaggggggtctcacacgcaggccttaggaaggggcctttctggagacaagaaaccctcagaggctccttctgctggttcatgaatctaaaacctatcccaggatgacagctgcggctgggtccggaagttgtggcattgagttctgtgtgctgccctagaactgtgctgaagtccctgtgaaccagagtctgccctgaccttggcccctgccagcctgccctgcccctgcaccagcagacccactctccacatgcagatgagatgcactgcaatccagtttcatggggaaatgaccgaggcgcctacacgttccccacgctgtgttgggacagccttctccaagcccgtctcaccccctaacctgctcactgatcacgtgcctgaagtaggcactgtgggctccttgtaagcaaatgccatgccctgatcctctgagtatctccatgcaacacaacattgacccgtgcttattgattgaacaaaaaatgtaatccagcggcgcactccccaaatgttttctgagctaggtggaagggcactttgacatgccccaaatgtaccctcttttgccaacatctgcttgcagcaggagctgtggaaggtgaagggggtgggcaaccagccccaccaagtacagctgtgcaggttgtgcactgtacaactatggaggaaaccattgccatcatggccatcacggcacaggtactaatggtaatttcgtcacagagggaagaaaaacgtcttaaggaaggggcaagcaccttttcctagttcaaacaaagatggggtctaggctgccctggccatgctgccatggagaatgcaagaggtatccctatgggagccatattggcttcccggagacacaactacctccatgttgatgccctcctgggagccacttggaggagagagcatcaaaggtttgcctgtttctgctcacccacggtcccactgtatgctgcaagagagcttatgggatacacttggagcacttagcaccttgaagcaagacaggagggttgtggagacccagggatggccacgcagcaggccccagaggtctctccccgctggcaggcctaaagatgctcctggtgtctgcctcgcaagaccacaggtggccacacaccctgtggcttttagcagtggcccgggttccctttctcccactgggcgccatgacagactcacagggaaggctgcactttccctggtccagcgggcagcaggtgccagtgatgacagttggcgtttaggatctgtcagtcactttaacaagctcccttggcagcagcacctgatcctcgaggtgatgtccatttggaggcacaggaagccaggcctgagctggcccagacgtatgggcctgaggggctctgggtggctctgtgtgcctccccacacatggggtggatagatgtggacattttaactctgaacaccagtgttattggggtagaccagatggctttactcatagctctcaggatcccagctgggttggtggccccgtctggtgacagctttagttcttccgtgaccagctgggactgggtttcaaagttcagaagtaactggggccagtgtcaagccgccgtgtaaatcaataaatcaatccagctgttacatcctgaatacccactgagagtcaggggatgaactgggtgctgggcatttaggaaggaacaaaccaggcccagtctggtccttatagagttgtctggtgtggtcagttgaatggtgactcaacccacccaaaaaaatgtgtccaattcctaacccccagcgtctgtgaaagtgacgacacttggaatttgggtctttgcaggtataattagttaagggtcttgagttgagatcttcctggatttagggagggtcctaaaccaatgactgtgcccttacgcgagaaaagcagagggaggttgacacccagaggcagtgcagaggaggccatgggaaggtggaggcagaggctggagtgatgtggaggctggagtgatgtggcccagctgaggagcaccaaggactgcaggccaacagcagaggtggaggaggaagactctcccctggagcccccggagggagcgtggccctgctgtcatcttggttttggacctctggcctccagggctgtgacaggtaagtgacttctcttgttttgagccccctagtctgtggtgatcgttagagcaaaggccgggcaagtgaggaagataaacatcaatccacagtcacagaaatgtgtgccttcaacagtgcaggacgtggttctgtgagaaccatacgggcacctggaagacttcctggaggaggaggactgaagtatacataggagaatgggttggaggactggggaggggacagaagagaaaagaacattccagacagagtggggttggaaggtaggcagccggccctgatgtctgaagggccgtgatgaggcgggagggcaggagcagctgaccacacggggctgcagacgttggctgcctactcacccagggcagtctagggacacagcttggcggtgacgcacaagtgcaggtgtcagcagggccccagccactcacgctttaccccagtttcacccatgaggactgaaatggcagaagagctgttgccctatggcttttcctggcgttctttccggtgaggcccgaatccttctggaatgactcagggtcaacttgcacctgtgccaggaacttccatccaatgatcatgcttccatctgaacaatgcacaagcacgagtcggctgctgctggctgaggaggctccctggccatcagcgtgaacactgtcgtgctcctgcctagaagccctggctgttctcttaaagcggctgtgagtggtctgtggggaacggtggatgacagagttcccacctctgcctccatgcagggtggggcttccaaggtcagagtggggctgaagcgacggtggttcctctggccggggttggacatcggatgaggcactgatgtcagaacatgtgcacgtgtgaggtccaaggtccaggccagcagaggagggggctgcacatctgagcattcggtggggggcgttgcacatcccagcactgggtgggaaggcagaactggagcagccgacccgccctggatgtgcggaaggggcctccagagccaccgggcaggaggcagcggggctgtttccacaaccaggccctacaggtccagactccagctgtctccgagggttgcagggacccccaaatgtgtctgcaacctgaaaaataaaattcactggctccaaaatccaaagagaaaacaacagtgcggttaatctctgttgaattcagtgtctctgatatttaacacggggtcaacgtcacgacccatttaagctggtatccataaacgcatcacttcattgcgtgtagaaccactcggagggcaggtgttcccaccttgcaagaatccttgggtgtgctgatggcggctggggaatcacaggagctgctggggaacgatcagtgtatcactcacggccaaacaagttcaaaggcggaatgattaaatcacttctgaatgtttttcatggcagaaaggtacattgaacatgggctgtgggtgtgatgtctgatcagacccaggcggggaccgctggaatgcaggggggtggagcaaggtccatagaggtgggtggtgggacctgggaaagccaggaaggactccccacagagagactgggtggtgcgtttattgcccctgaaagtccttcccagagcagctggagccaggagatctgccttctccaaggcagggaagggcctgagagcagcttcgctaaatcattcctggtataatcgcatttcagtggcagggcctggtgaaggcaggaactggagcactatattagaaagaggatcctccagggaacggtgatggcagtggatgtcctagaaatttccgggctctgccaatcaggaaagatgaggctaagcagagagctttcagcagttacgtggggggtgttgaggtgaggacccaacaggtgtcccagctcagcggagatgccagctcgggcgctttggccgccgggtgcgggcagccagcccagctcaccgtggcagagctggctgcagggcagcacagagggccgctcgacaggcggggcaggctgcgggagaacaggagggtttccccgtcatctgtcactcccaaggggcatgggggagcttctcagcccatgaccacacgtgcagctgctcccagcatcctgcttcctggtcggagagttacagtgtgtgatgctgctctcttgcccttcctgcataactcacaggggaaatgatgcccaacgcccagtgccatcctggtgcctgagtgacagccccggccagcctgctcctggggaggccattgctgtttccagggcaggaggtgatgactttgggcaattcctgcacggaggggactcctcctggctcccaggagccactctcacccacaggcagggggctgcgtcgcttcacgtggcatcaggagggcagtggttctgtactcatgcagcccgcacacccgtgcccagagacgtgcgctggcggaagccatttctcaaatcggcaattatgaaaacgccctgcccggcgcttattatgaccattttcctcctcattgctaacatgataagcaatgcaagtttttcctaatagaaacaataatgtacaaagaacttgattcaaattaaattgtctcattactttgtaataaatcacccacaagcatttcctgagcactaccaggcatgttacctgccaggaacggctggcggaggagacagatacggcttaactgcgctcatgatcatgacggggtgtgatcagcgctccctgccgagacgaacggaaacgtcgtctaggagggagaatgctaggagggagaatgccggccttggaagctgagcaccccggtggaaccccagcttccccaaaccagcgccacgcccctggccaagttcctcaacctcgtcgagcgccagtatcctcacttgacgactacagatgtcaaccacagcctggagaccacagtggggtgggaagctccttgtttaaaaggcccctggccaggattcagcactcagcaggggctggaaggctattagcatgtgagaatgcaccttagaacttgcttcattctggagaccttatgcataaacagatattttcacttgtccccaggtaaaagactctcctactgagatcagcagaggcctgcccttgggtgtccttccttatggagagcaagacacacgggtgtgttagccaacaaggagaaagtccccacactgtttgtgtctcagaggtgggcgggtctctgcacacagggctgtgggcagatgggatgagggcagggggcccccaagcaagggatgccaggatgcctccctgtgcttccaaagctggcacggactctgcggtgccaggcagaacacccaagtgctggcccaaacccgaggagctgtcctgaagtgagctctttccttcccccacagccaacctgtctgcaagtaccatgagtatctctattctgagcccactgaaaagtctcctctgaattcactctttatgtaaaaaccttaaatcacactgtatctcccccacttaaaacaccccaacagatccccaccatacttttcttttctttttcttttttttttttttttagagggagtcttgttctatcgcccaggctggagtgcagtggcgcgatcttggctcactgcaacctccatctcccgggttcaagcgattctcctgccccagcctcctgagtagctgggattacaggtgcccgccaccatgcctggctaatttttatatttttagtagagacagggtttcaccatgttggccaggatggtctcaaactcctgacctcaagtgatccacctgcctcggccttccaaagtgctgggattacaggcgtgagccaccgcacccagcctccccattataatcgaggataaaatccaaattctccaccatggctaagaccttttgtgatctgattcatgccccttctcctcctgactcctcccattccagccatgctgccatcctctcttcctccagcaggtcacactcatctccacacagtgcctttgcgttgcctgtgcaattctcaggacactgctccaggtctccccgagccaggctgctgtccctgcaggtcccctgggtcacctccagagatgggccttgccgcctggtggctgccgtcctcctgtgtccccagccctccagcttttctctctgctttgctttcttctggccagttactatgtttgaaattgtgatttgcttgttcactcatttgctgtctgactcccccagtagcacatgagtgcccccgaaggcaggacggttctgcccaccacactctgcagccttggatggtgccagccaccggtgttatttttggaaggaaggaaaagtgctgttctaggtggagaaggcccactttctagtcctggctctggcaagagctggcagtgggaccctggacaggaccctcaaccaccctgagcctgggttttcctgtctgcaaaatgaaagaccaggatatctgagcagaagcttcatcagtgctcctgacgcagtgaaggaagcctgagctgggacctcctatgtggtctttgatgcaggctgggtgtccccctgtcctgatgtttcctgacaaaggggttttctgggatatggggctgtcagttttaaaaccaagatggtcctggacaaatggggtgagttggtcgcccgccactgaaggtccaggcagcctgcagcgacaggtttgcccagggcacatgcctccactagcagcagggccaagtcacactgaagcctcagcctttgactctgaactgaatgttctttaaaaaaaaaaaaaaatcaggggaacagtacaactgcctggcattttgctgtgagtgcaggaagggactgttgatgacttttccttcattcgttaattaaaatgacaggccaagcctgccccatctgtctgtctcaaagctcgcccacaaagaccatgctggcgggccatgggacaggccacaggggtctccttgtgaggcaagttcccaagtccctctggtgggggtggggagtagatggccccacagctacaaaaccagaaatgtcctcctctcccgggaaccagactcagtgtgacagtcacctgatgtcctgggctttgtagggaaggctgattctagggctgggggcccacctgcagcccgtggtccccccaccaggatcacctgcccaacctggatggcacagagctgttgagtgggaggccatgagaaacccaggccaggcccatgccggaggagaaggccactgctgccgtccacccctggccaccaacctccctccactcactagggccactgaaaagtttgcttctcttccaagtgctgatgcttcattaagagactggtgtcaccagaggggcagttgtaaaaacagttaaaagtaggaggctcatataatttggctatctgtcccctccaaatcccatggtgaaatttgatcccaatgttgttggtggggcctggtgggagctgtttgggttatgggagtggattcctcatgaatggcttggttccattctcccggggctgagagagttcttactcctagttcccacaagatctgattgttaaacagagtctggcactttcctcttctctctctttcctcctctcttgccatgtgatgccagctccccttagccttccgccatgagtggaagcttcctgaagctctcaccagaagcagatgctggcaccatgcttcctgggcagcctgcagaactgtgagccaaagaaacctcttttctttatcaattacccaggctcaggcatccattactgcaatgcagctgaactaagatagaggctgacacattgtaatgggaagtattttaatgatgtccccttttttttttttgagacggagttttgctctttttacttgccagcttggcatgatcttggctcactgcaacctccaactcccaggttcaagtgattctctgacctcagcctcccaagtagctgtaattatgggagcccgccaccaggcctgtctactttttgtatttttagtacagacggggttttgccatgttggccaggctggtctcgaactcctgacctcaggtaattggcctgcctcggcctcccaaagtgttgggattagaggcgtgagccacaatgtccagccaatgatgtcctttggaaggggttctgcaaatgttctagaccaggcaacggcccagagagtgaacattccaggctttgagggtggatgggtggtccctgttgcaactactcactctgctagttgtggcacagaggcagccatgacaatatgtaaatgatgggtggggctgtgttccaataaaactttatttacaaaaacaggcaatgggccagatttggcctgtgggctgcagtttctaaagataggctctaaatattctaacgacatttaagtccacacaaataatacatgtacatggcatataactatgtataataaaaactaagaaaagtctcaatcttgctgcagaagccatgctgacattactgtgtacaggtgtgcctggcttgatgtaacacctgagctctggaaaagaggcaaggagaacgcgttttagaaatgagatcatctgtgagatgcctgagaggttcagaaggatcacatggggagtactttctggaaaacaaagaaacacctctttactttgtctaggtttttatgctctggttggctccaagtggggatagacctgaattctggcttaatgagtaataattcataattagagtaattagtgtaattattatgctacggcctttgagcaccttccacacaccaggcgttgttctaagtgttctgtgggtttaactaattgaatcctcataatgaccgtatgaggcaggagctgtgatgacgctcactttacaggggagcaaataaagcagagaggttgagtgatttgcaccagaacacagggctggaggcaaagccaggctgtctgaaccactgtgggttactgaacgatagtgatactgaagcactgttgattcctggccaggtgggggccagttccccgacagctcacagccctcccaacccagacaatgacagagagaaaggaaagaaccctcaggggaggcgttggtcctagcagcatgttctggagaaagaactggagaaggaattggtgatttactgtcctgccagtatctgagctgctgggagggcaccctgggatgctctgagaagattttgccaggagatcctgctctgtatcaaaaaatttgaaattggaaatggtggaccaaatgctgggctgggtaatgccagggaggaaggacacggtggggtgagcaaggccaaaggcaaagcaaggccccacacctaaaaatgggtgcaggaacatctggataaacgtttacagttcacaccccatgctggttatggctgtgttttatgattcccatctcaatgaactggcaatgtgtcagaagacaaggcatctcctgggcacagcaggtgtgtgctggtctgtggttcacacttttactcccacctacaacactctatacctgctatctctatcagttgaactcctattcattcttcaaagcgcactgcaatagccaccacttccaagaggaccttaatgctgtccctcacgtgacactgtgtgcttagagggaggggactaagtcttctttctccaccacacccagctcctgtcacagactctggcactcttcccagcttgctgcctgctgcagcgactggaaaagccagacacttgctattgcagcctttcctgcagttatggatggtcatgaccctatggaatagttttggccaaggagacccaaggccaagcggacccgaggtctgctgggacctctgggaaaggctggactatttggaaagggagtgggggttggggaactgctccctggcaccccctcctttacgttcctgagtaggacgtgctatggggacatcatacttggagctatggctgccatcttgccaccatgagggagaggccaagaggccttcagagatgtcactgcccgtgcaatggatgctagctgtgccctcctctggactcgccattgtggtctcagccactgtgagtgaggttttttattacttgcagccaaatgctttctaatgaacataatgtgaatatttggagcttggagtgagggggcagggtagttattaattagaagatacgggcaaaacactgggatggcttcctgacaacttaagaggtctccgagttatattctgggttgggaaacactgacccagcccttattccttcaaggactctagtcattggcaaggaggattcatgagccccagtgacacagatgggggccctgctctatattcaactgtccagagaagatctagtcacaacccctcatctcaaatgaactttggttcagaaaacagaactaaggaaaagtggtttccttggactcaaccggtctgaatttcccactaaccacaacactgacttcctgagcaagctggctaatcccacgtatacaggcaattacttgtacatcacagggctggggacaacacacaccaaggctgagaaatctctaaaaagccaagtgaagtaaagggagacagagtttaggtacagaggggaacttagcaacggagtggatcagaagatacagccaaggcccacggtctggtctggacctgatgagtggatgtctgaggccagacgctgcctctgctaatgggtccctctgctagacctgaggaccagcctgtccacagactgggcttccagacaccccagacaagccacacagttgcaaagtctttgtcattcaatgcatccagctgagcggccaacatcctcctcctggattcagcacgtggtgccgagtctcctctatcctttaagtgttcctagaacccgggccaccacccacgattctgaaaattagcctcgctcgaatgaaaccctgccttccctctgaccttccatgacaccactgatgccctgtctttgtgaccggacccttggccacagcatgggggctgaagcgtctcccaatgaggtaaaggtaaggctggttgcccctggacaaccctgctcattgcacccacccaaggaagtccaccattaatatgaccacgtccactgctgagatgacctccaagaagcgggcaggcagggaaccctcagagcaccaggtccaacacagcacgtcccaccagaagccctgttgagggctccggaagccaggctccccctgagcccgagatgcccactccctctcacactgctctgcactcgaccaccaaagccagggtccttgcgtacccatttcccagatgtgtgcaaacttctcgctgaggaagacacatcttaagaacgagctgcttgtcccagttgtaggctcgctccttctttttgcagaaggttccagccctctgttcccttccaccatctccactggcatcctcactgccatttcccatggtgtccagttcatttattttgttagggggccccctccaaagacaaaagacaaccccttgcaccaattttcccaggtcttcagccccagccagtttctcactttaaatcttccccattctccaggacttcctgatttccttctcattttccttcttgttcttttgttgtgttgttgtttgtttgtttttgaaacagagtctcactctgtcacccaggctggagtgcagtggcacgatcttggctcactgcaaccttcacctcctgggctcaagcaattcttctgcctcggcctcctgggtgggaatacaggcatgcgccaccaggcccagctaatttttgtagagatggggtctcgctttgttgcccaggctggtctcaaactccagggctcaaggaatcctgatgcctcagcctcccaaggtgctgggattccaggcatgagccaccacgcccagcctcctgcctgttctttattaaagctggagttatctgtcctgcctctccctgcctctccctgcctctcgacctgctcatttccagtctgctaagaacaggctttttttttttttttttttttttgagatggagtcttgctctatcacccaggctggagagcagtgcagtggtgtgatctcagctcactgcaacctccacctcccgggttcaagtgattctccagcctcagcctcccaagtagctgggactataggtgtgcaccaccacacccagctaatttttgtatttttagtagagacagggtttcaccatgttggccaggttggtctcaaattcctgaccttgtgatccgcccgcctcggcctcctgaagtgctaggattacaggcatgacccactgcgcccagcccagaactggtatttttctaactgcgaactgtttggtccatgcccctgaccccaagtccaggctgcacaggtattcatttgccttgacatacatcctccagatatccccaggttacctccaagctccaacacactcactctccttagccaggggatctcagcatgctcgctaggacaaccttcctcccccgccctcacatgactgggaagaagaagacaccaggcccgtaacaggtgacggcacggggtcatccgtgcaaatgcaggtagtaaaacacggctgaccgcaacgctgggctctggcaggccgggtacgcacaccatgccaagccccatggggagcccctgccctcattctctctctcacacaacacactgtggagggaggcaccattttctttcccattttacaaacaaggaagctgcggctcagaaaggtccagtgaggagctcaaggtcacacagctggcaaatggcggagctgggcatccaacccccgaggccaactgcagagcctgttcccaccaccagcagccagccagcccccttttgaggagcagggcaggcctatccccggaccatcagggaggtgggagatctccctgcaccctcggccccctcttttggggtgtgcacctgcctggggcagtccctctgtgcctggcagcagcggaggcttccagccatcagctgtctccccatgaccagtacaaagggctgtgtcccattcccctgtgctggggagaagtgggtcagggctgggcctgggtcctgccgaggaacagagggcacctccactgaacgggaggcttgggaggcccggtgccatctgtcgtgctgactatacgccccagggcctggaacggtgtctggcgcattttggggtatcatgaggatgtctgtggcctgagcaacagaggccaccgctgcccgctgccacaccccagccaggccctctggcccatggagtgacaactagaaccggtgcccctccctcgggaccctggacgtccacctgccaacagttgtgtgatccattcccaaatccacagagcccagggtgactgtggcctttggggctgcacagtcccttcccagacccctgtgatcactgtgactggaaatgacttggggtcccacggaggccgacgggtgggacaggggtcggtggagcaggcagcatgcagtctgcacagtctgagagaggcggcatttcctgtccttttctactgcatgtcttggccctggggaagggagcagaactcctgcagcctcggtttctccatctgtaacgtggggccatcgcaccccatcccagggagttacacactcacagctaatgtcggccaaaacagcctctgtcagagcgggttctcaacctcttcagtctatgcattgaatgcttgcaagcactctgtgagtgtcctgtgacggctgtaacaacgtaacacaaacttggcagctagacacatttagcctcttacagttctgggggtccgaggtctcactgggctaagactgaggtgttggagggcgggctccccacccaggctccagaggaggggctgcttgtgttctctggtttctagtggccaccacgttccctgacccatgatcattcctcagatcactccagcctccgctcccatcgtcccagctccccactctctgcctctgaccccctgccctctgatgaggatccctgtgatggcacagggcccacctgcattcgccaggaccatctcctaatccaccaccagctgattagctgacaagtccccctctgaagcttcattccccttggccgggtgaagtcacacactcacaggccccaggggttaggacatggatgtctctgggctccacagttcacttggccatgccaccccagcctctctctctttccctggtgaggctcaaggtggatgaggctttaatatggagtgggggtgttttcaacaatctttcgcagattgtgggctgactcatccaactgcaggcaccgtcctccttgtggggactctcaacaggatgcaggcacacctcagattgggcaccagcaagcaagcaggcaggtcctgcggccgagatactcccacactcttcctagtaaatcacactctccctgggtgtgaaccatccccgtcaatgctcagaccacaggccagtacccacttaaaaggcaactggctctggggtgctggtggcccagctgacaggtgccctgacttgcaggaggactcagaggacactggctgctcggggatgcctctgcatctgtgccttggggctgccggcacctgctgggagggtcctgcctcttgaagcacacagcggcaccggctctgccaagtcccccgttctctctctgctgctcagcgtggggtcccttttctcttggcaaagtctgacggcggaaaccccctgaataaacagctcctgcacagagatgtttctccgcggctcaggattcgcactggaggagaattcagaagtccaagcccatcatttgatgctgccaaatttccgccagcctcagcggtaaccttctctggcaaggttaaagggtctatcagattcccggcccagaaactaattagataaagaggaaacctgggccccctggggtatctcctcaaaggccgaaaggtgcacatccaccacatccaccccaccatgcccagaaatgggacccaccagcggcactgcctcagccaccctggactgtaaccatccaggctctcagccggatccctgctgtacctccacaggggagaggccagctcattcgcatgaagggagactgaacggacgctggggcacgctgagctccccagattactcacagcaaccctcctgcccatgccttttggtttgggaggcgacccaagcccagtacctaatggagtgactggggtgggagcacgaggcaagggtatccaggctccacagagaaacccctttctggataccagagctctaggttttagcaacagaaaccacctccagagatcttgaacactgtggggttctgcacgggcttcaggtcaaagatgtggaggggcggacatcaccgggctttataataacagggtctgggcatgctcggggtgaaatctaagggaaacgcatctgggtgtggccttcccccaggcaaggggctgcggcttttccctttcagagaaacaggagttcgacaacctggagaagagtataaggcagcccaaacctgctggagggtgctttgtgagagggcctttgacccacaggccaggttccaggactgatccgacagaaacgcaccctcaagagcaccacaaggccgggccagggctgctgctgctactgccactgtctgaactggaaatatttgagccatctccaggggacatgctgggtccaccccacccccggacggttactaggaaggacactgtctacacgaacccatgggcatggaagctgggcaccaacagagtgcagaaacaaactgcaggatgctgtgtggcggagcccgctgtgccccacaaatacatgagaggaggacacaatgatgttgcaaaggctggcgggaggatcaccgaaggtcaggagtttgagacctgcctggccaacatggtgaaaccctgtctcaaacaaacaaataaataaataaggctggtgggcacagccagccatgcacagtggccccttctgggaagtgggaccaggaggatgatattgactttctatatttctgcattctttgaatatcttgagatggaaaagtgggcactgttgttttctaaaacagacaatgaagatgggagggagagagggaggaaatgggggaggcaggtaggaggaagtttccggtttgcccaaggccacagagaaggaggcctggagcccttgtcctcccaggtcggggagcatcctggttcctttgttgaactcactctctcaggacccaagagcagccgtggatggaagaaaatgaaaagacaaaacgcaagtcctaagcacaggaggatgacgtgaggatggggaatgacactgctcttcaccgcaccaccgaggcatgggtcaggtgttaccctgaaggtgaggaaaccgaggccaggggttaggtgacaagtctaaggcagattggctggagaagggcaaagctgggacgtggccgagagggttggtgtgaccgctgagccacatcccctgtaagacgctgtctccctgatggcctcagtttccctgctggtctctccaccaggctcaccgctggctcaggatttgacaattaccgctccctccttttttactgaaattttttaattttatttttagagatgggatcttgctttgttgccctggctggtctcaaactcctgtgctcaagcaatcctcccaccttggcctcctgaagctctgggattccaccgtgcctggccacttcctcctttcttttccttagtcctaaccttcttcctgtctctggccagctctcacctcagcgagctccactctgccgtttctgtgtaattcagcaacatgccctcttccccacccaatccgtgctgcttttaacactttccttccacccctggaacttgccgccttctaccgatggtgcatctctgtgtctgttagctcactgatatgctgctacatgctctcagagtttcctgtggacactgtaacaaattgccacaaaccgggtggtttaaacagcagaaatgggttctctcacagcgctggaggccagaggtgcagtatcagcatgaccactgtggtgaaatcaaggcatcggcagggccacgctccctcaggaggccccaggggaggaaccctccttgcttcttgccgcttctggtggctgcagcaggcattccttgtcttggggtcaatctctctaatctctgcctctgtggtcatgtggctttctcctcttctagcttcatgatctcctttttgttttttttttttcagacagagtctccctctgttgcccaggctggagtgcagtggcgtgatcttggctcactgcaaactccgcctcctgggttcaaacgattctcgtgcctcagcctcccaagtagctgggattacaggcctacaccaccacgcccagctaatttttgtatttttagtagagacaggatttcaccatgttggccaggctggtctcgaacttctggcctcaagtgatccacctgcctccacctcccaaagtgctgagatgacaggcgtgagccactgcacctggccctggatgcatagttttgaataaatgaatgaaaagagagagagagagacctgggtccctgtccctgctactcactcttcatatccacggcccctctcccagggtcttcactgtccccgtccccctacccagtcatcacccttgaagtgtgaaaaatggctcccagagcctgaaaccatgaaggttcaaaggcacactcctggctgggcacggcgcatgcatcccagcagtatgggaggcagaggtgggaggattgcttgaggccaggagttcaagaccagcttgggcaacctagagagaccacatctctacacacacacaagattagccaggtgtggtggtgcacacctgtactgtggccccagctacttgggaggctgaggtgggaggatcacttgagcccaggaattcaaggctgcaatgacctatgattgcaccactgtgctccagcctgggcgacagagggaaaccctgtctcttagccccctacccccaccccaaaggcatactctctggtttcctaggagaatccggtttggtatctcacactcccttcacccaggaagcacaggctgtggaaagagtgtcaaggtgggagcaggtaaacccttggcccctgtccgtcactcagtgtgactcagtgagtgcctgagtcacactcagggccagggacagtgcccctggccctgccaatccagtgagcgttgttggtcccagccctgccctgtctgaccggctgcagcccttctgataggtcacatgcctcactctgcctcagtgtaccctttaggaagaagaagggactccagagatccctcttggctcaaatgcaaaggtgaggataatttgggaaaagaggcaggacaattactttgtgcattttggcagtgggaatgctgtgctgcagaaaggtgaggcaaaggaccctgggcaaggcctgaccccaacaccaccttagtccctgcctgaggtccctgacctcagtccaagccattcccccagatggtgtggccagaggactccagttccttaatccctgccttcccatctgacagtcccagaggcttggcgaaaaaacccccaaaaaacaaaaaactggcaaatgaaacccaggaaagaaaaaagctcccaacctccagtctgggcccctctcttccaatctgcttttgaactcgctttttccaccctcctcctgccgcccagaaaagagctgccatcttcctggctcctccccttcactcatcttggaggcctcagagctccacggggccaactccaggccaggggacctgggacacatggtgccagctgttataccaggcattagaccaccgagccagcctccaccttgaccttgggggcagtagagtcaggttttaatcagcacatgccctgaagagctaagccctgcttgttggttggcagggcctgggagtgcagcctctagtcctgacccatctgaccaagctccctgacagggaaagagagggaagcagattccaagctggaccctcccgaagacttggatgggctgcatctctttgtaatcctaagcatggggacaggtgcccagtgcttcattctgtcctggagagaacggggcagcagagccctagggaggacagggggcagtctcaactccttagactgccctgagcacttttcatgacatactccttggcactggggacacaagtctccttctcactggggccatgctatcctctccttcccatgaagtgaaaatttattgagtgctgacaatgtaccaagtactgcctatagagaggtctgagcacactgcccaactttggtccccacccttaccccaagtcacagattcagtcagccacccacccactcacccatccatgcatccatgggtccacccatgcactcatccatccatctgtctacccattcattcatccacctatccagccatgcccccacccacccacccatccacacacccatccagctccccttccttccttccttccttccatccatctatccatcacccatctacccatccatccatccatccacccatccacacacccatccagctccccttccttccttccatccatccatctactcatccacccatccatctatccatccatccatccatccatccatccacccacccacccacccacccatccacacacccatccagctccctatctatccagccatccatccttccttccatctatccatcatccatctacccatccatccactcatccacccattcacacacccatccagcccctcatctattcatccatccatccatccttccatctatccatcatccatctacccatccatccattcatctatctacccatccacacacccatccagctccccatctatccttccttccttccagccatccatcatctgtctatccatccatcttctcacctctctctccactcaactctccattctctgagagctggacatttgccagaccctgtgccagatgccagggagaaggagacaagtcagtcagtcctggtcctatctggaggagacacaggtgtagaaggacaggggtgggcagagaaaaggcagtcctgcatggcccaggtaatgttgagtcagggaggtctgattgcttctcactctagctctacaagtcaggcaccaaagacacctccctgcttcctggaggaaggcccagagcaccaggctttgggcagaggcggggatcagtgtgagcatttcccgaaaacctgctgcttcccaggcacagccttgggtacccctccagaaccagtctcctcatctgctccctggagaggcaccccttggccttgtatgccactgatggcccctgtctggaccccaactaagagcactcctgcccatcttgggctgccctctggatacctctgcccactctgggtcaggccctggaatcccaaccctgcccagcctgtctcagggtttgcagttttgtctaaagcgcattcattcatggtgaccactggccagtggttatggcagtttcaggcccaatgtgtagaattttatattcacaagagatctcagcaatgatgtaggcattttacaatgtagccatcttacaaatggggaaactaaggcccgtgcaggaaggtgatgtcagaactgggaccaggacccctggcacctgaactcccaggcctaggcctatcaggcttgaaacctgcttgctggagcttcagatcagcacacttcattaccctgtgtaagaccccgactcagagcacaaggttggagcaggggtgcagaggcacggatattgcccagggatgagccgaagctggctcttaggagctgccagggctgactgtgggcgcctctttccagcttgctcagtgacctcacgttggcagctcggaatgggccattgtggggcaatttacaccactgaaatcagtaaatgctaccaatcaaggtggatataagacaggagcacgagaggggccaggtacagtgtgggggtaggggggtgggcgggggcggtgtggaggcagaggtcagctttggcagctattgtcagaacagctccagagagaacatgactaactcctctcctttgcctgccggcggggctcagggattttaggagacagaagattcctgcgcagctacagagctcctgagctctgggggcccctgccccatccaggtggggagcaaggcaggcctctgggagtgccctcagtggggccctgcctgaaggtgctgaatcccagccccccaggccctcctctgctgctgctccgatggccccacccaccaccggtgtccccaccatccacccactcgccacctgggaaatgtactaaacgtggtctgaggctgctctgagccaggagcctccctgtggtgaggaactcagctcccagccccaaagcaggggacttgggtccagaacaaagcagccagaccttcctgcctggccccacagaaaaggccgtcatgagggtgtccaggctgctgagagcttggcctccctgctctccagccagagtggtcctggagccacttaccccaacctgaagaccaagtgcgcccagccccaatgcagaacagttgctgagctggatcccccctgcagggcatgaggaggcccctccccttctccaccctcagaacccatccaactgctttcagagggtctgagcgtacctccagccagaaaaacctaccctcaccttggtctggggccaaggtccaaagtccccaagtcaggtgcttgacgtcataaaactgcaaggggaagttggccgtggccaggtcggagcacacctaatttcgtgcacctaatttcgcatcactgagtactggagaaggaggagtccaggcctggcccagccaagccagcagccccggccatcccaagagactcatgacccactgtgcacccaggaaacatagcaagtgtcagctttatgcttggctctttgaaattatatatttcacagatgatatctaagaaatctgaatctcaaagctccgtgacagaggcagaatcacaaatgctcatttgcagatggcacaggcagagctgagagtggatgatcttgtcatggggctggcaggtggagaggctgggagggaacacgggcttgtctaactcatgagtctaggccctttgtgcctcactgccccctttcccatcagagagcctcctcccctttcatgactcggcagggacactgcgctcctgggaccatgtctccccaccacagctctatcacctggccacctgtgcaactcacttcaagataaacagaccagcacttcaattttcaatttggatcctactacttgtcccataggtatgcatgagaacctatgtctatctttgcttagaacttctggtgggagtggggccaggagcatgtctctaagcctctctttttggtgtttgacctgaggaacgtgcagttcacctgagctctgccgtgagagcagttacgtgcagagatctgcccatacctggctggctggtttgttcacaaagagatccggaaaccacttctctcaagctttagaagcttatcccattgttgaaaggaaaagctcttggacagtaacagtgtgattgacaaaataataacttacatagacaggttggaagttaaggacatttcccagaatacagagcaagaaggcaaagaaaaaaatcttgagaaagaataagtgacaaatggggagaacgtaaatggtctaatagaggaaatccagaaaggctgaactgaaagaggaagcgatggaattgtcaaggaggtaataaaataccttcttgaagtggaagctgcttcagtctggaggggtctccagagcaatgagctcaatgtgcaaaggaagcgcacactcacatccaccatcagatttcagaacactaagaaaaagtagaaaatatgacattcctacaaacttctagggaggaaaataaagggtcgctacctacagtggaatgagaatcagacagtgctataacttcttactggcaattctcacctgccagggataaacaggaacattgaataatgagaaaaagatcaattcagaactgggaacagaacccccagacacctgaacttccaggcctaggaccatcaccaagaagacaaaacagtcctgaatgagtacaaacctaacatcagaacttcaaaatacatgaagcgaaatccgagagaactgaaaagaaaaaatagacaaacacaataatattggagaatttcagcattcctctctcaaaaattgacaacagaggacaagtcagcaaggctctaagccatgagtagagacgggatggtgatgaagcaatgcctggagagttttgaaactggagttctacaacctggagaacatttgataactagggaatttccagacagggaggttacattccagataccttttgttgaagtggaggatgtatcctgacagaataagggcaaagaaaagaagcaactcacgtatccactagctcagtgaagtgaagttgcaggatgatcgtcgtgtactgagagctggagttcaaattggagcagaatgtcagaggactccaacaagaagaggacagattccagtgatacatcagaaaaagaatgatattttagtggtatgctcaagaagccataatttttctcccacgagaaaaaaaaaggcaatcagaaactccaggaaaaacaaaatcttcatgtgaaaatcatgatcctaatattaagctgaaatgtagaattactctgaaacactgatagagtggaaaaaaaactcattgggttgtgatactattagtacccttcttctcataggtctgtaaagaggaattggaatactaaccccatttgtattatcatcataatgtaatacttcccatgtttttttttttttttttttttttttttttttttggtgtctatgctggtctcgaatgcctgggttaaagcgattctcctgccttggcttcccaaagtgctgaggttacagatgtgaaccactgtgctcaccctccactgttttttaacttctgagtccaacttggagacaaaacttagaacccataaatataaatataaatataaatataaatataaatataaatataaatataccaaagggtcgagtgatagtgtctaaaatgtattaaacaagagagagaagtttaagaatgttatttaaaggtaatccattagcatactggcaagaactattcaaaattggaggtgagggtcaaactatgaaagcctcattttttccagcaatgtgtcaaggatgtttcacattttaaaattaagaaatacgggagtaatcatcacgttgggaagatacccaccagaagaatgaagcagacataatttaaaaacttttttttctgccaagtggggctgtgtggatgaggctgggtcagagtgggcacataataatttatttctactcttggccctatctctgtagtttaattaattactttcattacatgcatgcagtacttggatgaaaatttatggagggaggaaaaatgtgaaactgagagttcactgagaatggatgaggggaggggtccctggggcagccggactgtggggtgctaaggggaacagagaacatggacaagagccaaggggccagcccagggaaacagcaggaggacgaggagaagacaggactccttgacccttgtgatggactaaaggagggaaggagggagaaaggcaagggagaatgaggagggggacactcaggtcccccgtttaggcactgggagggctgtccatcacaatagagaccacagagaagagcagtactccctggagaaatggctcacccaaatggagacctggttccggccaccatctttaccatgctgggagagcgcaaaggaagagctgggccatctgtggttgtgatgccttcctttgcctatgcccagagaaatacctctctgtttcaaaaaactacaaaagaactatatacttgcaaaaataaaaataaaaatatgggccaggtgcggtggctcacgcctgtaatcccagcactttgggaggctgaggctggtggatcacttgaggtcaggagttcgagaccagccaggccaacatggtgaaaccccgtctctactaaaaatacaaaataattagccaggcatggtggcacatgcctgtaattccagctactcaggaggttgaggcaggagaatcacttgaaccagggaggcagaggtcacagtaagctgagagcatgccattgcactccagcctgggcaacagagcaaaactctgtctcaaaaataaataaataaatagtaaaaaaataaaaatacagaaaatgtatgaaataaacagtgaaataatctcttgccctgccccaaactatgcctcaaagaagccgccatgggggcttccaaattaactgcgaggcccagccttcagttgagagtaaggaacaaatggggtgtgcttccttctgtgtccagacagtagacatactcagggataaagccttcttttcaagtctaagaaataagaaaaaatatataaaaatacaaaataatggcggaggaagaatgagggaaatcaatgtttcttgccattcagttcttacaacctacacactgaggcagtcttctagagcgcagagttagggtttcaaaggaaagccagctacccacacacactgctcacaactcagcacccctctggatttatatagcacatgcctcttaggagctgcaagtactaaacatattttctcattcatccttaacacgaacacaactggagatacagaatgagttggaagcagctctactttgcaaacaacaggaactgaagactcagggaggggaggcgagctacccaaggttgcatagtgacttagctggaaagccagagagataacttaggaccggtgatttctcagcgtctttagaacgcttcagataacatgcatatatgcttctatttgcagggcccttctctagaaagagcctcaggaacccagcaacagagattctctctagggagaagaacttggggaccagaaggcaaagatgggagacctactcttcacactctatcaatttcctgcatatcttgaatttttaaaccaggtatatgtatttcttattactgatttagaaaagataaaaattgggctgtgaggctcgaaagccatgaaaatagggagctgtggacagtggatattcaatggtgagcaggcatactttgccatccttctaattcgctctctaagagaaaactggttttctctaagggagaacaaaaaacagatgctcagcaccttcttaaaccttttccttgagtggcattaatggacatgttccttttgagcagaccttgctgccagtaaggatgtgcctctgggagctcctcccggcaaaaacgaagagaaggtgagaactaagtcctccatgctcttcctcacctccatgtccatgcccctatccaatctaactccatcctacccctcagttccatccacctctctaccccacctcctccaccagccccaaccaccattgttgcttggcctgaataatggcaatgggctcctcactggtttccatccatcctgccatctgctttcctccagaaaagtgattcagatgatgtctcttctgcctaacgccctccaatgcctccactgcaagtgcgagaagacccaactcttttcatgaagcacgaggtctttctctgacattactgcctctaatctcttctaggccatggctattcctgcagtgtcgaatcttctcatcaccccagtgcttctgcacttgctgaaccttctcttgaggggtgattcctcctcaatctttgtgtttcaactcaaaagtcacttcttcagggagacactccctccctggcatccctacataaagccggcatgacccaacctcccaggattctatgacagcactcatctgcttcatagcattaactacaaagtgagatcctctgcttcatttgttaactttattgtgtacctttactaattagactgtaatctacttgaagtcaaagaatgtgcttgtcttgtttatatcctcagctcccagaatagtcagatcttgataaatattcattaaacagatggacagatgaatgcagtggttgggtggatgggtggatggatgggtgggtaggtaggtggatggacgggggagtgaacagataaatgggtggatggatggatgaagagatacatatggatggaaggattcatacatggatggatgaatggatagatggatgtgtggatagacggacaggtggacaggtgactgggtggatagataaataggtggatagatgagtgatagaaagataaatggctgagtgagtggatggcgggaaggatggatgtataaatggagtccgttcagcctaaagtgagaccctgagttctcccccatcccaccaggtagatttctctggagtatcccatgatgaggctggggatttggttaacgaggagtgggaacttaagattcccattccctgagtggagacatgtttttaaaaatgacattgaaatatctgtaaagtcccaagtagaaatggcccttagggcctctgctgtttgaccttaattaatgtggccatttctagatccttctctcactgttttccgggtgagtggaggggaatcccagggagggaattggctggaacagctgaatatgttcactaatgaattggtgtgtttcaacatttggctctccagctctgagactctgagcagtttttgacataagaggaggttggaaggggagaaacctcctgactgattcagaaaatgtctccactgagtctcacttcccatggcattttctctcattacacttgcatcggcagtggggtggcctcagccctgtgctgtctgcccagattgtgaccccacagcctactgtggataattggcccacagggctggcactgcacccaggtttctgctgctcattagtctacttgcaacatgaatgccaacaagggtttgtgagctacaagctgttctgcacccatgccctggtgaccatggcctccagatgctcctcctgctccattggagaagctggcagtcagcctctcactccacacccactccagagttatgccattccagggttacaggggtgcacaagacctactcatctctgtccacaagctcccatgctgcctgccctccttccatgctgcctgctctccttccacactgcccgctctctgcctgcactgcccaccctccatccgtgctgcccaccctctgtcagcactgcctgtccccctgtccaccctgccatgctaataggttcacagtctagctgaggccagttctgctggtcctgggcagggtggcctccctcaggctaaccctgcacccgttatgaaccagctcagacagtcagggatgaacaacgataataccatcatcctgaatacgtcaggattccactcatctgaggttcctagagtcatcaaattcatagagacagaaagtagacaggtgggggccagagtctgagggaggtggagcggggagtttgcgttaatgcagacagagttccaactttgcaagatgaaagacctctggagctggacggtggtgtcggttgcacaacacagtgaatgtcttaataccactagactagtgattcacttaaaaatggtcagaataggaaagtttatattatgtgtattctaccacagtaagaaaaaatgggggggtggggaaagaatgaagtactggtgtgtgtcactgtgtggatgcactttgaaaacatgatgcagagtggaagaagccagacacaaaagaccacgtagtggctgattccatctatgtgcatctctcccaacaatgctttgggaggtgctgactgttaccacaagaaacactggccctcctcctcgtcagtttccctcaacccaggctggctttgggcagtaccatcctcaccgcgggagggtggggcctgaatgccagggctctactgcccacagatcaggccgcatactcaggctcagatgctcattaacttggccttcctttccctccatcagtgtccctctagcaggtggaatgtaacacctgcgttaccaggttgctgggaggctcagctatgaacagggctgtgctccatgcagggtgggtggcgcacgggaggagtggataagcagggctgttgtgactcttgtttctttcaatgaaccacagggtcacatgaggcccacagcttgtctgatccctcgccatgggagtactggagctgactcctaactctgatcaaggctgaagctttttcaccatttgcttagaagctaccagttgaccccagtgtggtctgcatgttcctcctctctgaggtgaggtcccaggacctggcagaacaggtgttcagtacacatgtaaaacaaaagcccttgactggacaccaaaacagggatgcagagttggtggggatcttggaggtcatccagtccaatcttctgtgacattctggcaagagaatcctcagccctgcttggctccttctagtatggggagctcactacctcctgaggcagcctgaacagccacaatagttctgcaagtcttctcttggctgaactccagcccatgtccctggtattttctggccctgctgttagccatgtgtcacacctttactacaacaccctagccagctttgcccacagatgtctctcttcccaggcaggtccttcctctgctcctctgtggggagactcaggcactatgtatcattgtgcagactctgcttgctatcacagatcctatcacagtgtgataggcccactgactatgaccacctgcccagggtccacttctacaggcagccttctgctgctgcagaaacaattcatctggctcaaataaaggctcatcaggagaagctgtggtcagtccctgacctgcctttagggctgcgtttgtggccaggccatggatcacacttgggcttcaaggtcacaaagtgggcgagtgtagcaagacctggaaagtctgtgacattccctggaggggtcttggctcctctcctggctatggcattccttttacagcacacctcatttacaagagaagcggttgggacaggtcagcattataactgagtccaatgagcaattctgctcctaagtgcacacacatacttgcatgcaaatatcaacagcaatcaataccattcacaacaaccaaaaggtggaaataacctgtgctcactgatggataaagggatgagcaaaatgtggtccgtccatacaatgaaacattattcaatcctaaaaaagggaagaaaatccagacacgctacaacacgaatgaaccttgaagacattacgctcagtgaaagaagccagtcacagaaagatgaatacttcgggattccactcatctgaggttcctagagtcatcacattcatagagacagaaagtagacaggttgggagctggagtctgagggaggtagagtggggagtttgcattaatgcagacagagttccaactttgcaagacaaaagagctctggagctggatggtggtgttggctacacaacactgtgaatgttcttaataccactaaactagtgattcactaacaaatggtcggaataggaaacttcatattacatgtattttaccacaataagaaaaaattgggggcggggaaggaatgaagtactggtatgtgccaccatgtggatagactttgaaaacatgatgcagcgtggaagaggccagacatgaaagatcacgtagcggctgattccatctacgcgcagcaccgaggcaggcagagcccacagacagaagcaggtgggtgggtgcgaggggcaatgggagtgggagtgactgctaatggggtgacaaaatgttttggaagcagatagtggtgatggttgcccaatatcgtaaacgtactaactgccaccttattgtacactttaaaatggtaagttttaggttacgtacattttacttcaatcaaaacagacaaacaaaaacaaatcaatcagctaacccaggttggatccctccacaggcaggtctaagagtcgagtgcaggggtctgggctgctcatcacagatatcctggaggtcggggaagaacccagcgtagggcttccggaccctcccacctctgcaggagatgagtggggtcagcttctgagaaggggctcctcagccagcagggccgggcacaggaccctcacatccccggggcctgcacctgcacctccttctcttttctacctcacacactggcccttgttgagcttcaacatccaggaagaaccctctatctggggctccccacgtggaggggcctttccccacactcggggccagcaggacacctcccctgcccagcctcaacctcccctgcaggcaccccccagcctcaacctccccacagagacccaaggacttccccacagctggtgacacacaggtgtggtttctgcagaaaaatccaaccacgtgcctgtgccagtcacattgtcaaagatgcagggctctttccacacatcagacgaactcaaacctgctgtgcttagaagatctggctacctggtggctcgcctgcccccttccttcacagccattccacctaagcagaagtggcaggaatggatgagaacccgaggaccacagagaaggcagaaacccagacctgaggcatccgaaatactcccccgggggatgctgctgccccaatactgcctcaaggctcctgtggcccactgccgtcatccttgacatttgcatgctttcgcaaaaacaatgctacccagccctctccctggggccaccacacaggtgtgctctggctggacacaaaccaaaggtggcaccaagtacacctctcaggcaggggctccaggagatggtggcttccatagtcctagcccggtaacaggcacagggaggcagacacgaggggcctgaaagctgcatgcaagatggtccaaagcatttgcagcacagacgaacagctttgaccagagggtcctggaagagaaagcagcgcgtcttacctggaagtgtcgaagctgtcataggagcccacggtgtagtgcctgaaaagcttcttgctgcggtcagcgcgggtttctgtacagagagggaagagaaacaccattcagaaaagtcatggtccccgaacgcggaacccacagcacatgaggctggtgggccctctcacctactccccaaaatgtgagatgcactgtcctggggaagagtctggaggaaaatgaggcctggttctggggctcaactttgtgaaatttggggaatgcatgtgcacctcaatgctggctactgaagagtcaggagcactactccctaagggaggcagagtcccacaggcctcagctcacagaggaggcaggaggaagcagcctgcaaagatgagagggccaggccagctcagaccccaacagggcagcccgcttggctcatggaatccactagaacagcattctgccgtggtgctgctgagccttccagcaaaactgaaaacctgcagacaactgccatttgggaaagaaagaacatttattgtcattttcctgattatagttcctttctcctaaaaaaaaaaaaaagcaccaaacccacatgattaacatttctaattaagtcctctgcttgctccccttactcagcagattgagacataaatttcatgggaaatgatatgagtgatgtaattagatttaatggatagctcagtgctggagggagaaaaaaaacacacacacaacaaaaagacataaaacatagcagctcacgagttcctgtttactttcctcccaaacaggatttcctgcatgatctcctacctaagccctgcaaaacatccaaagaaattatgcaactgacttcaggaaaatggcccaaagtttaatctaaactctgtaaacaaccttctctgttgttagcctcctccatcccaaattctgaggtgaaatcattttttcttccactcaaaccccaaaatgcacatttgcagttcaaaagtaaataagggaattgagaaaggtctccacacctttcatgtgcccagaggcagccagctgttcaccaaaagcacatgttccaagaaccctttcccttttccagcagtgtggtgttgcccttgagggcaggaaaggaggcaggtgttgagcccaggactacatttcccagcctcccttgaacccagatgtggccacgtgactagttctcaccactgagatgtgagcacaagcagggtgggaagggtcccttccaagcttaggctttttagaagccagtgtgctctcccgactctgtcttcttgcttctgccagctcaacgctcaggcctctgagaccctggggtcaacagctgggtctctgtgccctggactcttacgtaagcaagagtttcatttctaccacattaggctgcagcctcggattaatttgacacagtggctaagtctttcacatggaagctcccagctgtctccaccccttccacactgctccccacaaacccccgaggctcctacaaaacacaacaggactccccaaacagccacatcatcaccatctccatcatcgtcactgacacttattgagcacttactctgtaccaggccctgctataaagtgttgcccgagtattcaatagtttaactgccatgaccacccagggagtggggcacactccacttcgcaggcccctccagtgcagccaggggcaccctctgccctccactccattgaatgccactcctcaaagccttgctcagggccgtgggagccctccttgtacaaccaaaaagacgcattgcacgattaccagataaaaacacagtatacacaatcagattggtcagagtgcacagggccctcaccaagccagcaccggtccagccaagctgcacacacctcccctttgcttggcatctgcaacaaatatgcccaggtgcaggaggacacctgtgcccccctcctccctggcatccagcatcttgcacaggtccaattccaatcatcatttatgaagtctgcctggcagccaggcccgtgcctcgactgcagggattagaagaattcagcagggcagggcctcaggatcccggggatggggcgaaggaggagccccagggtactgagcctccacaggctggatgaggggcccagcacgtgggtagctgtgaggtgggaacacatggtcaggcaatccctgtgacatttatgttgggccatgcatgtgcagggacaagtgagacttgcacctttccctagggttaaacagagtagctcacaatgccaatgaagggccacagggactggctgttaattgctattattacttttaattgtctctgctccttacaccctcatgtggcagctttgtgctggctgtctagggaactgctgggtgctaccagctgattggtgcaggatcctggctgaaatcggaggccggggccagaagcagagaggagtgtgtagtggaatgtgtgcgtgtgtgtgtacgcgtgtgtgtgtgtgtgtatttaccagaaaaaaagactatttcagtaaaggaaccatttctaggctaggtaaggtagccagtgtgtcccagactggagtttcatggaccaacaaaactttaaacaaagagaaaaagggtgtagactaacataacattcaccaagttttacatttggctcagtaaggatattaagaacagtaaattcccctctgatatcaaaattgtaagaaaaaggaatctttttttttcttttgagatggagtctcactctgtcatccaggctggagtgcagtggtgcgatctcagctcactgtaagctctgccttccaggtcacgccattctcatgcctcagcctcccgagtagctaggactacaggtgcgtgccaccacgcccagctaatttttatattttttttttcgtagagacggggtttcaccgtgttagccaggatggtctcaatctcctgacctcgtgatccacctgcctcggcctcccaaagtgctgggattacaggtgtgagccactgcacccggccagaaaaagaagcctttaaaaggacattatctctgactgcttcatgcaggaatccccctgcacaggccttccctgtctcctggttcccagaaacagttatacttgggctctgggatatggtccctaagggacaggaaagggaccctaagggacaagatcattatcaccatcaccactcccatcatcatcaccaccaccctccatcatcaccaccatcatcaccaccaccatcaccaccaccatcaccaccaccaccatcaccataattactgccatcatcaccatcatcatcaccactatcatcatcatcagcatcaccattaccatcatcatcaccaccaccaccatcttcttcaccatcattaccaacatcatcaccgccatcatcatcaccatcttcttcaccatcatcaccaccatcaccacatcatcaccaccatcttcttcaccatcatcaccaacatcatcaccataattactgccatcaccaccaccatcatcaccactatcatcatcatcattaccaccaccagcgcattcttcactatcatcaccaacatcatcaccaccatcatcatcatcaccaccatcttcttcaccatcatcacaatcaccatcatcaccatcatcatcaccaacaccatcaccaccaccatcaccatcatcaccaccaacaccaccaccatcatcaccaccatcctcttcaccatcatcatcatcaccaccatcaccaccaacatcatcaccaccatcatcactatcatcaccactaatcatcatcatgaccccatcaccatcatcagcaccaccatcctcttcttcaccagcatcatcactagcgtcatcaccaccatcatcaaccactatgaccgccacaatcatcttcttcaccatcatcattgccattatcactgtaatcattatcatcatcactgcagcagaagacacatttatctactgtcaagtgtggaatgctctgctaaattatctcatttcattaaaagtaagtctttacccttaattggtactcacacaatatcccaaagtaagcagatttcttgtccctggtttacagaagtagcagagtgcaatgataagggatgtgggctccaaggccaggctggctcgattcagaacccagctctgccacttactggctgcaagtcctcattatttcatctttaaaaggatgatgatagtaacagtccctccttaaaggggaaggattgaggaatcaatacatgtaaggcactagaatggtgcatggcatgttgaaagtgctatgtaatgttaactaatgctgtcgtggtcatacattagattagaaacctctgcctcccaaggtggcctctcaaggtcatggagtctgtcagcagcagtgtgggcctccgacctcagatctgtgcctccacaatcagtgctgacagcaaccaatggccatagttggtgatccacttaccaggggccacacgtattctaggtgtgtgtgcttcacctgtctgagctcagtaacgttgctgtgtctggtttacgggtgaggagggggaggctcacagagtttgagtgagtcacccagccaggaagtggcagagcccattgtggtgcagcctccgggggtagtacccatatagggctcctgggaggtggcatctcatgagcgacccgtgtaaatccaggtggtcttcttaactctgccacatcctgtggaggtgccctcagcagcctcggtttctaacctggaaaaagcggggtgggctagacggcccttgggaccctgcccccagtgttacagtgcacacctcatggcatgtccaggcttggccccctgggacttgctgtgcactgcgctgagaggcaagggctgctgggctgccccttcccaaggctccctggatctcactggtgaaaacgtgggtcacaaataaaacaccctgaggcagacgaggggaggagcaggaggtcaggggccacaccagcctccctgtgcaccagtgacaacaaaggatgctggctgtttcctgccgctgagaggtcagcttcccaggtgccggggcccgaggtcaattctgcctcagagctgaccacaccttcagccgcgcatgcacctgctcacctggctggccacatcctccctgtcttctgtgggaccagccctttctcagctccagccatgtggtcaggtgatgccaccctgccccctccccacctgactgcccagccctgggctcctgcagttcccatgggagcctggctggaatgtccctttgatcccagtgagtgacgggctcaggggaggggcctgggaccacagcggggacaatgccgccctactcctgctgctggggttcccacgcctcaggccacagagggaggccagcctcctgagggggatacccatgtgcaggatggcacagggctcgggaggaagaagggcaggaacagagacagagagacccagagagacgggcgactgccctagagacacagctggaaaccctggacacagccatgcctggcttctcacttgtacaaactaaatgcatatccttggtggtataaaaaaacttggctttctgttgtttacaatggaaagaactaggaatgatgcagtaatgcatttaatagttgtgctgctgcactgcgtggctaagaaactgccgtggctacatagcttctctggggacacagccgcttcccttccccatgggaaggtcctggtgaggctgaccctcaggaggccaagcagcccacccggcacacaggggtgcatatgtgggtgtggtctagggatcctgctggactctcctgggccctgtcattagcagtaagtgacccagggcccacttaaggacaggtggctttttttctgagatgttctgtagtctgactgctgagaaaggtgatcttggcttccttttagagatgcgatggaaggacacgggctatggccaccattcaaagcacagggagggagtgagtccagcaatgaagccagctcatggcggaagacagaaccaagttcaaggtctggggtcagggagagatggacacaaaagaccttgatgctaggagtccctggattgtggcttgtggtggtcactgaggctactaatcaaatacttctggctttccaccagggcgcatgtggtcagacactacttcttagctctcctgtggttgagtaggcccttgaaattaattttggccagtgaattttgagaggaagtgaattctgttatttcctggctggaggttttaattccaaatgcaagacccccacccaccagcattgtctttttgtccttgggcatggccaccaaaacatttgagaagctggtggttctattagtctgggtcctcaagtcaccccctgttgatgtatgatgggcataaggtgtgaatgagaaagaaacttttgttgttccaaaccacagagattggggaattttttattttttatttttttaaggctagtcaggtgaagcagtgggaatggagaaggaacaaacaaaatctgtaactggttgtgatcaatgagttgtaaacactgctgcactcagagcagccaaggggaatgcttgttactgcagcttcatatagggcaagctgactgatacacatctccatggccctcttagtcctgtgggccagtacatcctaggcagagatgggtttctgtcaccagcaaccaaaattgtcctagcaagtataggagggaagaccagacaaaatcaaggcaaaggctgagtttggcctcctctgagagaatggctgtactttctaggagaaaaggaaaaaaccacctactagacaatggaaatggatcccattaagcatggccagaacacagcatagcagcaggcactttatgtgtctcagaggagacccctctgcctgtgataaagaagccagggaagccaaccatccaagagggaagtattgacttgtctgcttccttaaccatggagaaacttcttgacgtcaaaaccaagcttccaaccaggccttcctcccagtcagtgctgggatcagtgcatcatatagcaagggctcagcaatgtttgtagtgctccacatacatggaggctagcagttactaccactctagtctgaaccaccatgatcttgcacctggactgttgcagcagcctcctgcctccttgcttccatgcttgcccttccctttactgatacacattctatagagacaatagaatgagcttttaaaaaatgtaaatcaggtgattttcaactctgctgcttaacgttttccaacagcttcccaatgcaaccagagtcacgttcaagctgccttctatggcacaagccagacaccacgtggccctgcctgctccctggctcatctcccaccgctcaccacgtggccctgcctgctccctggctcatctcccaccgctctcccctcctcggtccccccagccgtgttagcctcctctttgtctcttgaacaagtcgagctcattcacacctcagggcctttgtgtgtgcttaactctgcctggaacattccttccccagctcacatttcactgcaatgctagctctccagatcctacaacacagcctggtgcatagcgggcactcagtaactctggagaaagtgagcgaatgggtcaaagccacacacccttggaccctttgctcatattccaccgttggccacgtcatctccttgggtctgaatggggcaagttggagatacaggaagctggatgattacagctccagctggggattgccgaggcaggggacacagccctggctggggcagtggctggctgtgacctcctcactttgcatctctgggccttccccttctcagctgtgaagtgggccggtgggactaaacagctccttaggctcttgaacttgtcaacccgacacatccctctgggtgtaaggcgactcaccccatgtcccaggagagggccatcggtccagacacctcacacatgcagcatttgagcatgcagggcctgaaagctgttttctgagtatggcctagaaaaatctacactgaaaggaaaaaaaaaaaaggccaaacctagaaatcccacttaatataccttttgggactcacgagaggcagtgacagattgcatgacaagcttcagactgtcagcatttaaaatagacctttaagcagggctgctggaaagaggatgctgtacagcttggcaaggaagccaagatggagcatctggggagattccagtggcctctgatcctgcgctctgactgtttctggaaaaggaaataagaggatttttctcaaagaaatttactaagacactgaaaggccaaaagctaatctttaaggatgggttgggaggaggtgggctatagaactaagagatagaaggtggggcaaggtgtggtggctcacacctgtaatcctagtactttgggaggctgagatgggtggatcacctgagatcaggagttcaagaccagcctggtcaacacggcaaaaacccatctctactaaaaatataaaatttagctgggtgtggtggtaggcacctgtaatctcagctacttgggaggctgaggcaggagaatcgcctgaacccgagaggtggaggttgcagtgagccgagattgtgccattgcagttcagcctgggcgacagagtgaaaactccatctcaaaaaaaaaaaaaaaaaaaaaaaaagagagagagagatagaaggtgagaggtgaggacagggtcctgtgagcatgctgacctctacactccagccacattccatgggcagtggtcccctctgttcatgagacacacgtggacagacagaggcaggaaggatacacaacagtccatctttagacaagacaagctcgagcttaaatctctcgctagctacacaaccccaagcagcaaaccatctccctccaagcctcagttttctcaactgtgccctgggccaagagcagagtttacagggctgcactgaggacaagatgaatgcacacttctaaataaatcctttccccagcatccggcctggggaagccgtcgagtcacgttggctactgttgtctgtccaggaatccagcttggacgttctggtctacaagtctctctgaaaacatccccctgccctttgcagacaggaagctctgctccctgaccacctctgtaccacctcaccccacgccccagttacagagggctgggccatgagatggcacctgtgtcaagccaggccaatcatcagaacctcccctgggaatctggagtagatgtggacagtctgctcccggtgtgcaccgaggacatcacagctggggcgacaaggctgtcaccacacagcaccagtggagggaggcatgtgcttccagggcctcaggaggcagggccctgccttctgccctcgatgaccaggaaaagccctggcgtccctagaccaaggtccatttcttcatgcaacccagctcaggcaagctttgtatttcttgcaatgggaggagtgccatctttcagtctgtctgtcaagctgggtggaacctgttatacccaagacgtcatctcaggtcctggctcggtggcccatttctcccgatggactgccctggacactgcatttctcctgatggacggccctggacactgcatttctcccgatggactgccctggacactgcagggctttgggcatccttgcctccaatctctaaacattgggattcaagatgacaaccaagtaacgtcccctccacgtttccaatcagtccccgcactcccccaccacgagagccacatgccgcagacatttctgggttactttttgtcaaagggcagtgacaatgaccagacagagggcactgaacaggcaggggtcagatgtctcctgtgtccatgacaaagacagtgaggccccgaggtttggccaaggaccttaaggctgacttcaaatgaccacagagcacttccgggtcaggcagccttggatcgtctgccttggctgggagccgctcctccaagccctttgaggggtcccagatgataatatactgagctttttcattcttttccccaagtgctacgtcccaaatttacttttgtaaattgacaataagcacagatgccacgggagagtgggaagatgatgccatgcgtcctgaagaggggattgaaaggccttctgatgtgtggaccccccctgctgacctccagggcaggttttaaaatacacaagaagggcagggcgtggtggctcacacctataatcccagcactttgggaggccaaggtgggtggatggcttgaggctaggagttcaagaccagcctgaccaacatggcaaaaccccatctctacaaaaaatacacaaattagctgggcatggtggcatgtgcctataatcccagttacttgggaggctgaggtgggaggatcacttgagcctgggagtttgaggctacagtgagctgagatcacatcactgcaccacagcctgggtggcagagtgagaacctgtctcaaaacaaaacaaaacaaaacatactaagaattccgatgtaggcgaattctgaatgggacagttcaaaaggtgactgcagagagctgagtcacatcagctaaagccctgaacacacatgaacacgggcccaggagcctgggcaggttatttgactgtgtcctctgccacatggcaggaccttagctaatgctggctattgccaagtctcctgctgggaatagggagcaggggagaaccctgaaggttgaggtcaggtctgacctggctgaggaaggaggaggaagtctcagcagagatggggaaatatcatatgtcagctatagcttgacagagcctactcggtgaccacagccatcctgacatcccatgggtaaatgctcaggacaagccctagaaaaattctgtaggatgcccatttcacagacacggacactgaggcagagcatagttaagggaaggcttagcgcacacactcagtgttgggccgatggagcgtgtggccgtggcagagacagctggcaaaggtacgcaagtatcatgagatttggggttggggaagagacttgggggagccctggcgagcgagtccatgtgacggctgagcacagaggctggggagagaggagagaagaggagccagccgcaggcctcaggtcaccagtggggcgggtgggctccgggggtccagggtaggatgtcctcggagctgagtctatgctttcagggacggagggggacaggtggtgagaacggttcccacggagaagtaaaggaggatgaacactgagattccctggccgctggacttgaaattcagaggccaggaaagggtggggcagcagaagaggttttctaggcgctctcccagatcaaaacccaccaccacctttgcactgaaaacccctgtcctgagatgaacgcgattttagggctgctgagcgcctcctcagtggccgtgggaagacagggccttgacccctactggctctccccacacctgggggctgtgccgtcccctcaggcaggcctggctccctcttcacaacggcctaagagctgccgcacgacaagtgaccaggctctgaagtcaagggtgagcaaccactgcacacaacctttgacctgcagagaggactgtaggagactgtgtcccactgccccctctcggctatggaatggggtaggagggaagcttaaaacccaaggagggctgcagacaccctgctgaatgcggactgtgccggagcatatgaggccggcgagggaggcagaactgacaatgccccctagaccttcgccccctggcatcacccccacagtaatgtcagggttgatggtgaaagggggattatcaggtgggaccgaactaatctcatcatctcatgagccctttgaaagcaagtacttttctctggcgggtggcagaaggggaagtcggagagactagaagagttggggaggccagtcccatagactcagggagccaaatcctgcccacaacctgaatgtgaccagaggcagactcctccccgagcctgcagctaagggcccaggcctcagacccctccaccggagccctgtgagagcctgggcagagaacccagtccagctgcctgactttggactcacagagcctcggggtcgggggtgtgagcagacacgcctgtggtcacgggttctgcagcacaggaaacggagggaactggggctgcaggttccttcacagatcttttttttcttttcctgaagatttatctgcaatctcacccaagacagagattgaaaaagagagagagagagggagggagaggcatgtgggtgaagggaattcccagaacatcttcccttcttccctcccttgaaatccatcatcctctctgaactctcactcttcactcttcatcccaaagaggcaaaaatcacagcagtgggctctggggcggggtggggtccccaggacttccgtgtcatcctggttgtgattgctgagctcctgcaacgtgcagccttgagtccgctctggccacccttcctgccgtttagagggctcagggtcacccgggtggcaacgtggctgggctgtccagctccgaatccccccagtgctgcacccgaacgcctccctcccacgcagcctcctgccgtctccgcaggttttaaatcagacgccgctcaggctgtgcccaggctgctgagccaaaagcgggatcagaaccacaaggaggaagaaattactgatggggatgaaagaccgaaataacttttcttttttaaaaccaaagatgctgatgggctccttgcaaggcagaggaacacacaggcagcagtgccgcaggcaggaatgctaggagtgtgcggggcttggagccagcacgcccgcccggcctccaggctcaggactccactcttggggcccagtctctgctctggcaagctgttgggtatgggacccaccgcgagggggacagaagggcggggaccctggctctcagaactacccaactgagaggcacagagctttgatttgaaaagcaacacgtatcacaaaaatgccgccaactggctcggctcacttgttccttttctcaatcagcagcagatcattcatcaagcaccttctgggctcccgggactgaccttgcaggggaggggaagagaaaataaggaccctgtgcagaatgcccaggcacacgtcacagcacacggacctcgtggggatggtggcctgggctcctgcagctgccggcacagacgaccaggctcggtggcctcaaacaacacaaacgtctccccttacagagctgcaggctggaagtctgaccaggtctctgggctgaagttagggcgtttgtggagcttccttcctgctggaggctcctggagtgtgggggatccacttgcttcccccgcccggcttccagaggctgcggtgttcctcggatcctggccactgcctccaccttcaaagccagcaaaagcgggacaagtccttccccccactgcattgcatccctctgactctcagccctatgcctcctttcccacatttaaggacccttggggtcacactgaacccatccagataaccctcagctgacagcaacctgagttccctctccgacctccactccacgtgaccatgaggctgatgtattcagagcttctggacattaggacgtgaacatctctgggggccgctattgtgcccaccataaccacaaagagaccatccctgtcagacagcacagctgggcaggctgtgctctgaaaactgtttacctccccatcagcaacagagctcagaactttcaacaggacagaaactatgagggtggcagagaagcggcttccaggaaatgcacttccctgttcccagatacaaacaacactcagttccaattcggattctgccacttatggtgagccctagggcggggcccagttcctggagactcctcctgcaatgggtgggcgtggccctcactcagactgagccgccagcacgatggttcctcgctcggctaaaagcgcccagctctgcaccaacagcccttttcctggtctgcaccacatgctcagggggccacgctccccttcctggaatcacactggtttccagtagtggaagctgcctatctgctggaattcagcaccaacaagcacccgagtccatagttccacttgttcccagctccctggaagatcgtggttcctcccatgtgcgcacatgtgtatggcgtgtgtcatccgccctgctcctctttgctcgatgctgggaagaacagcctcgtgtcacacgcctgggtaagaccccagcagcgaggtgcaggggaagtttgccaaaagaatcacgtgctttgaattcccttaacattggcatgggtttgtgtgtgggcaggggaggcaccagccctgtcgggcacgtgccagtgggtcctcagcactctgacaccacacaagggccagatctatggactccaaatccaggggccaaggaagcaggtgccagcatgctgggctgtgtttccatcctccaataaacagaaatcacttcagagagccggctccgtctgctcctggcacagttggtttttcttagtcatctcaggaaattgttggttgtactgcaagatgagtgaagcaccttaagaagaacacgggttacagtactgacttgccactttacgaagcagtctttttgccaagcgtagctgtgtccgctttcacagaacccccgtagcagcagggcttgggcgtggagcagccaaggcccacgtagcagtggcttcatgtacggagccgagggggaggctcacaggttggctgagggtgtccagcaaggcagtggctcagttgcatgttccactgatcatcggaaagccagggtgaggtgtcagcctccaagagtctgaggaagagaatgggagggagatgcctccaggcggcagagctgtcacagcgccgggtgtccgtcacagcaccgggtgtccgtcacagcgccgggtgtccattgctgccaccatgtgatcttgatctgtccttttccaccatccgtcatgccttgccgtgtgccacacacaccatttaagtgtaaaacacactctcttctgaatgctcccagcaacactacaagaaaagtgctagcagcgttggcctctgctgtacaggtgaagaagctcaggtgcacaccagcgatctgtgccagtgtccaagctctgggcactgccttgtggccatgctaagtgccttcttccttccaacaaactgctttggctcactcaacagctatttgcaagcagcagctcctccctctaccccaggggccaggaagctcagcgcttctcccagcctccctccaggagtgcctaggtcctggccaatgagacaggagcaggcgcctgccaggaggggcttcctttccccaaaccaaacctccccagagcctgaagcttttcagcccttccttcttccctgtctggaatgtggaagtggctctacatctatgctgcccccagagcatgctgaggacacggaggagaaggagagaaagagccacatgcccagatcaccgtggcgcagctatgcccacctggcccctgcagcctggcccctgatgtctgttgggtgagatgagtaaagccctgtgtgtttaggcaacggtttctgtttctcccagccaggcagggtcctaactgcaaggccttatcttgtttagccacaaagagccccatgagacaggcactgtcattataataatcacttatcagatgtggaaatcgaggcaccggaaggttaaatggtattcctctataacacaatcagcaactgatggagctggtgattacattaatatcttaacatttctgcagtattgcacacagagactccacgagaggactcgacccaggagaaaatcaggtgtgatctgatcatttccaaggtcacctggctgctgaacatcagagctgggatccaaacccaggtcctcctggctctgagagtcaaggtcaccccatggcctctggctacatcctccctacggcatttttcttccttccttttttttttcttttgcaaaagattggttttacctgtagcatttctgtcttataagagacagaatcttgttctattgcccaggctggagtacagcagtgcaatcatagctcactgcagccttgaacttctgggctcaagcaatcctcctgcctcagcctcccgagtagctgaaactataggtgtgcaccaccacacttggctttttttttttttactttctgtagagatgaggtctatgttgcccaggctggtcttgaactcctggcctcaagcaatccccccacctcagcctcccaaagcactgggattacaggcatgaggcaccacacccagccccacctataacatttttgaaaggataaatctcagaggtgagtggtgccctgtagataatattttttacaatgctacacttgagaattatccgggaatgtgggaaaaacctggaatcctaggttcttggaggaaggaccctcattggagaatgggacgggctgtgcccagggtcacccagccgggaagggaggatgctcagctctgccctgctgccctcccgccactgggctcctttgcctgctttgtaagctcagtggatgcctcccaccctgggcacccagtgcctatggggagggcagtgtggacttctcttttgcccacactagcccttcttgcagctctcgggccaagccaggctggggacaccgtaggaggggaggctacactcagtctctggtgatgcttcccaattaccaccctcccaaattggctggacaaatgaatcaagctgttggctgtcactgagttggtttctactctatagtaattagaatgttttaaaaaaaatcagcccaggagctcagtggaagcatgtataccaatacatcgagccaaactcacagtttaaatggaaattagagtaaatggatgaatctgtgcctgatttgcatttgctgatgagctcggctgggagtgtccatgccgaagcaggctccgtttccagaatggctctctctcctctatctgtccagaaggatgcctggcgaatgtgacccacatgcccctggacccggcagcccagggctggagtcgccagtggggaggaggggtggggtattgtggccagactccaaaagacttgtccacggctgagctaatccggcctgggcccagaggggagcagagcctgcctctggctgtggacagggcgtctggaggggcctcactctgtgtacccctgccccctatgcctgcccctccaacacccactgcctaaccccaaaactgtcttagggctctgccccccatgcctgcccctccaacacccgctgcctaaccccacagaacatcctgtcttagggccctctttgtggtcggcctctttccccggccaatcagagcacctcgaagaaggccgatgataatcagagccaccattctcagagcaaacaccccaagcatctcctggcacgaggtgctcaacactgctcccggccaggctttgttacccccaagagagggcccaggagggggccatgtccaagggcacgcagcagagcctggatttaaatctaggaatgggtgggggcgggaggattctttttagctttataatcttttttaaggatgccggcagctgaggcttcggaaataggacatctagaaaaaagacctgttgagctcaaggaaaccgccctgatcgtgtgggaagacagctgcttctttattgctcgggtttcggtgctgggaccttggccaaccgaagttcttggtcaaggggacccatctccatcagggtgccttcttggggaggatgaggtgggtcccactggtgctaacaaagaccacccgccctccgcccctggccgtgaccttagcaagccagggccagatgctcagggctcattccctgccactcaccaacacggggcacccccaaaagattctacacgtcgctgacaaaacccagagttgccaggcgggtgaagaccagcggggagactgggcaggggtcaccgtagtctcgacagctcatggctcacatagatctcttcaaccgcaaagcaacatctgggagggatgctcctcggtggcaggcgcctcacatctcactggaccgggtcccggagccccccccccgcccaactggacccctcccagcctggccattcctgctctcctcggcctttgtgggcaagagggagcagttggtgagaagctactggagaagctgatataaaccattatgcagcctgcaaacgcacagggtgtttctccctctccaccgttaccacgcggaaggagcacaccgtccacttggttaaaacaacaacggaaatccacccagccatgctgtctttggagaaaggcaggctgcactcgggagcaggcacgctgccccaggccagccttgcagggactttcaatacagtttgtcgggttaggaaagaacacgccagaaaatgaacaagccacatctgtagccacagcacctcatcatgcaaccgacctccctttgaggttaaccacagtgcttactaggaagagatgtatgaatttgtcttaaaaacccactagccgctcaaagggacccttgagactataaacaggatccctgggattctggatgcaactgagaagcctgtttcctcccgaatgatctgaggctatatctttatttccattctaaatcagaagcaggcgaaagccgtgatggaaacaatagcctcggggcgcccagcaagcaggacacagtccccctaaaacacaccaagtgcaaagccattgccaccccgtctcaccaagcgccggcaggactgcccaagtcccacggtcctcccgtccccgcagctctcgtaaagaacaaaggctccgcacaccagcccacagcgtacctccaaaatgaactttcttcttgaaccgtgaattctcggccatcctttctaacctgggtgtgaccatctcactcggaccactgctcctcggggtctccacggagactgagtccgtggggcggcctcatctactactgcctgttaattcaacaggaaaaaaaaaaagttgcagccctctgggggcagaattgaagaagaaaagaaaaaaaaaatcagatgaagaagaaagatggctccgggaatgtttcatccatgaggaagttcacaaatttgacttctggggactgaacatccaaatcagctgaaaattcgcttctttgacacaagttgtaagccccagactggagccgcgtccttccacttcccactgtaccagggacttttttttcccctagtgccagtttccatggcaatgcatcagtcactagtctaaataagtacgggtgaaggacgcctgaaaaaccagtgcaattacgcatgccattagcagggagaggcagtgattcaacccggctattaggatgggccggaggtgtcacttagaggcggcagctgtcctcgtccccagtaattgctttctcattttgcaaggcttggtgtttcctcggtcttggccgttcagagccctgctttctgtgaaggggcagccgggcagccaagcccgttttggctacacagacgccctgagcctacgctggagggaaggaactgcgcctcggtggaggtggccctggcccaaggcgtgcactgtgccttcctctgggcagtgggtccttagcggggcttggggcatcaggaggcaaggagggatttggggaaaaatccatggacatgctgcagattccatctgcaaggtcacggccagcagtccaccctgcatcagggtcagggcacagggctgggggctgagcctccttccaaatacctgcaaggacttctcggctttcaaatacttcccaatcggtacgtcccgtgagaaggcgaatgtcacagcagggcagggagggagtgctcctccctttttgatagagctcattctctttttttttttttgaattgctggcctgaatgtccatcatggcccgggacagaagccctcaccttcctgagctgcaggctttcagtgggttagaaaacggattagaaggggttggggatactcaatggatgtccttcatccccctggagaggcagagtgtatggcagggaggcagcctggactgaatcccactttgccggtcactggcgctatgagcttgggcttgtttccagttatcttgatttgtcagctggggataatcacgaattatcggtaagatggaaatcagggtcatgagaatacaatgaattaaagaagggtgcctggcatacagtaggcacgcaaggaagatcagctttgttcctgttcttacgttcactgcccatgtgaagagcacgtcaggtgccatcacctgcaagctcgccgtggcgcagtgaacgctgcctggggttccagatagcgtggggtgtaactcactcctttgattcccgttagcccacccacgttggaatagacactttgtgacggttcaaatagacactttgtaacagttcaaagatgagaagcgtggacctggagaaggttagcgactggctcaaagtcacacagccaggtaagggtggacttggggctagaacccagcgctgtgcccacccactatccatgcctgctgccccagcactcctggggacatggacgtcatggtgctgtgtgcatgggcacccagtgggttgctggggatgaggatggagctgggcttcactctcatgggtggcctggcagatgctgaacctaaccctaatcctgcccgcatgcagcatggtggaggggtgcagaaccctgacctacgtgggatcctggtttctgtggccctttccttctgcccgtggtctgatgtgatctatgggcaaatcggagggtcataaaaatagccctacctggcacgccaggggcccagggggctgctgctgctcactgggatttcagtgggaggcagaagctgcggagacaggaggtaaaaatagcaagggtttccacaacagccccgcgctcccctgctccagcatttgacacggcagcacacgagatcctcttgtcccactgcgctggaatcttaaaggttcctgtccttggagacaccctatcttgccaggaaaatgaggagctcgcagctgcacacagcagaggctccaccttccctgaagtccttaaatcccccacatcaggctgactaggaaggccagaagtgggtgagggctgagcttcaaagcaaaagggttggtcccttcccagtgggtgaccccaggcaggttcctcaacctctctgagattcagcttctgcatcaagaataagcaggcagaccagaacagctcctgctggaaggcagagccagaaccatcggaccgctggaaccagctccatgagggcagggtccacgttgcccctggacacagctgcacccccagggcctggtacctgggagatgcccataaacaccgactacctgcacacacgtgcttataaactgtagagtactgtacaaagtgccacggtcatttctgatgtaggggtcatcacctcgtctaactggtttatcacaaaatggatgtgatccagggacatctccagaggctacagagaatgagcctggggtctggtgtccacagcccccgcctgtcaatctgctccctgatgccatgggtgatgggactggaggaatgtccctggcattcttggccctgtgactccttcgttggtgaaaaagtggggatggagaaagtgccagctcccagggggccatgaggagaacccatgagggtgtgtggaaagtgtctcagttgaaatccactcatccgtcacacccccatggcagggaggccctaagaggtccccaggagggagggctggagatagagttgtttacgctgttcttggcccaacaccagtctctaattacccagaaacatgcaggaatgacaggtgggactgatagctgtgtgttcttgcggtatacatgtgctgacacacgtgaacacgcatgtgaacatacacacacacattcatgtagcacaccggcatgcacaatgcacacgtgtgcatgcacatatatacacacatgctcacatacatgcaaacacatcttcacacacacgtacatgtatgcacacccatgcatgcacacatacacatctgtacacacatgttggggaggaacagaggagagactgggaattgggaattcttttctttggaaaaataatctcaaggctttctttccctctggaacccaaaggagtccagtcctcattcccccagtgacctgagcccgggcttccgtgtgccaggcaggcctgaggtgagatccctgactgaccggcagtccgggcaccttctctctgtgcccctccctttcctccagttaacacctggacatctctccaccgacgtctagggagacaaaggtctccctggcacgctctgctgctccttcccgaaagaggcaagcagctcttgagtttcatttcaggcgcatcacacctagtggggctgtgagggtttccctcagggactgcagccgctcctgggcacactctgaggcttcctccgcagtgtctcacatgggcatgcctgaaggtcggttctcaatgaactcttgcccatttggatttaatacatgagtcaggattaaatgcaggggtcagagatgccaacatcttggggcaggccgtgtgtacaggagctggtgctccaccacagggaattgtaggggctgggctccactgaatattggaggtgtgtacaccccactgttggggaaggcctgttctttctgaggccagctgtgagtggggctgggctcagggcaccactttgtgagcagcgttcttactgaggcagttctgcccccagggtgtggtctggaggttcgtgggccagctagtgctgtcccagtgctggggaggtaccactggcatgccacaggcagggctgggatgtgggaccgtcagcagccagttaccctgcatgcaggacttccaaaggtcccacccaaccctagacaggtgcagtgtcttttcctaaccatctgagctcagagcctaaactcttttcgcaagaagcacagcgtgttttgagcacggcttgaatacatacaattcttcaggaatgccaatgacttcaacatcaagggaagaatgtcctttgtttagctgaggctttgaaagaactgctcaccaattcccccaaatgatgccactggtggcagggcccgtcgaggtgtgagtgcacctcatgtggcactcaaggtgactgcaggatcatccatcccatcctttgttttcccgtccagtggcacccaagtgcatggatctggaaatcatcttcccgctttgtcatgccatcctctcctctgtcctcactgtcactgctgggatgtgtgctgtctcttggtactcagccccattcctgcccttcagtgctctcaggggctaagtatgcacactgcatttcccactctcttgccagggcagcagtcaggctctgctgatgggaggcatttgtgcaaagttggccttagtggctggcacaggtggccactgaggaatgtcaataggatgctcctcacgctctcagcaatacctcttggttctttttactcctgtaaccctaagggacatgaaggcttcctgcagtgaccaatctctgggtgacatcacctgtccctttctgctcctccagcctttccaacagttttggaaacaatttcctgattcaatcccctctgtttgaaatacctacataggcgattgttttttctgactgcatggattcataaaaggtattagcttgagttttttgaaattacgtatattgttaattttattctataagaatttcatttaaagataacaaggggaatccttgcacatcattgtttgaaaaaatgggtgcaatgtgtctattagaggtgagaaccacagagcaaaaatgagagatggtttcttaaagggttgaggatggtggagctaggaataaaggtcaaaaccactacctcctaacatagtgtacctcgaaggctgctggtgacttaacctggagacttattaaaagaatctcttagcttaaaagcaggacttacgacttatgagaagtggcaggagaataatgtgctcagaaagattctaagcctcctgaaaaagagggttttgaaataaccaaatgctttcaaaagaaacctactttgttagataaaaatctcactgttaataatgaataagcctcagttttaacttttctgcctggtccctcatctccttacctttatgggacttttttacaaagcaccgtcagaccccatgtggggctagaaatatgctcatggtccttgtggtagacaaactcataaggtggccctggattctaccttctggtcttcaggccctgatgtgattctctcccaatgagcatgggttgggtctcagacttgcttcttccaagtagaatacagcaaaggggacaagatatacatgacttcatgcacatgattataggattatacgattatattagatagtagcaattttcttgctggagggtctgtctctctctctctctctctctctctctctcgctggcctgatgaagcaagcagttgccttggggaaccccatctagcaaggagacacaggtggcctctggttgctgagagcagtctccagcccccagccagcaatgaagcccttactgataaaaatacaaggaactgaatttctgccaacaacctgtgagagcttggaagtggacccttccccattgaacctccagatgagaatgcagcccaactcacaggctgagtgaagccttgcagaaggctcagctaaagcatgcctctctcctaacccaaagacaccatgagagagtaaatgcatgttgttggagccactgattttatggtaatattgtcatgcagcaacaggtgactaatcaagtcccacactgtttagacttatgagccatgccatatagccttacttggtgtaacactataaaatactctatgggtgaaactgtctctcctagacctgaggaagaggatgtagagaggcaatatgggagaagcaaactgaagaaagaaacaagagcaggtgtcctcaaatagtaatgaagcagctccaaggagccagcactctcctaggtgctcttctgagtactctagggacagaaataagagcagttccttttcacagctcaagaccttgccaaatccacttaaaaaaaaaaatcccgcatcaaaccctgactcctcaagaggtgtgttctggaggccccaaagttcattcttttttttttttttgagatggagtctcactctgttgcccaggctggagtgcagtggcatgatcttggttcaatgcaacctctgccttgtgggttccagcaattctcctgcctcatcctcctgagtacctgggattacaggtgcacaccaccactcccagctaatttttgtatttttagtagagacagggtttcaccatgttggccaggctggtctcgatctcctgacctcaaatgatccacctgcctcagcctcccaaagtgctgggattacagaaatgagccaccgtgcctggctcaaagttcattcttacactttgctcagttaaggaagaaccatctgtgcagcaggttttgttgtggtggtggggtgtgtgtgtatgcatgtgcctgtggccataggtgtaaaaatgtctccaagcactattgctgtcagaggactccatgtcactaagcatcctgctaagagcactgtgagctcttctgggtcttttctgagtcatcctctcctcctttgatctcatcaagcatggtatccttttggaaatatcagacagcatccaatttagaggatgcaagaggtccagaattcccgagctgggaggcttagaagagttgtggtgaccaggtgactgccgccaaccacgtcctgtggagagctgtgtcgacacctgcagccaggctctctgggcagccttgtgtccaaacaccagctcagaggcagcaggaagacgctaactctgcgttccggaaatgtcacctgctcagtgtttgggaagggaaacctctcaagatctaacggggtgatcaggtagcagactctagtcagaagaagcaacttgcagctgatgcccatacaccctacaggggaggagacatttgagatgggtgagataagaaaagtcctcaaggtagttaaaaccagtcccaaccaaatgtcggtctaaaaggaaggaaaccaacatttgctaaatgcctactatgtgccataagctttcacaggtaagaaaagattttttaaagtatgttttaaaaaaggaatattccaaagcttgattctttgggggggaaaacacttaagctaaggccattataagactatctttagcgtaaataacatgggcaaaaataagcaccgtacagtgtactaaagggagggatgtttttctactgtgtggaattttagtgagtaaatgtttccctacaatattcataaatgccactaacaccccaaagcagcaacatttaacttatttgcagctggttctgtgtcatatttaaaatgaatcatttttcaacatttgcggactcttaaaagctgagcgtggcaggaggaatttccttgggtactgggacaggaaggcacatggcgctgagggcttgccagggtgcggtggcccagacccgctcctcccaaagggcctggggcctttgacagctgcatgtcagctgcaactgctggctggagcccgaggctaatgaggtcagagcaagggcctggtgcccaaagaggctcactatggaccgagtcacttggaccagtgggtgttgttcagatgaacctcaccccaataccgcacgatcccaagaggatgcgaggagaaaagatgcatccatatcaacacagaaacactgctatccacagcaacactgagaatgtcatttatcaaaggcccacttcttgtcagcacattgtcggtaactctacgtattttattccctgtcttcatggatgacccggtagacctctgaagacaactgaaagatggtgtacaatgaatgaaaaaatgtgtacagaagcatggggggaagaacagccaccttctaagctgcatcatctctgttcctcacaaatacctagacaaagcaaggcagacgtgttgttctaactgctctgcctgacagtccataaaaacatgtcgaagcagctggatgcccaggagggtatgcgtgaactcacacacacaggcagtggagggacagagctcaactcggagcaccagctctctcctccatgtaagcttctccatgctcagctgagtttctcagagctgtacttggtaagtgcattgaggacttttacacctacttccccgctttagggatgggtgcctctttttcagtgaaatcttacccggaacctaacacagaagcagcgagtacagaggccctgccccctcacctcccaccagcatcttggagggacctgagctccctggggctgggtttggaagctggggataaagagctcttgcctgtctgtaccaaaagcaggaagtgcagaggtctggccactaaaaggagcaccagaaacctctggtcaaggtgcactttgttaattcaccaatgccttatggagctcacatgccaggctctggtcaggaggctagagatgtggggtctttgccctgaagctgttctgagtctggtgtgggtgggtggggtgggcagataaattagacccccttgggatcagggctggaacggaggtggacaaagctggtggaagccaaaaggcaggggcaagtgtctctgtctgtggagatcaaagattttcagagagggagaaagtaagctcatttgggaaggcaggtgggggttggctgtggtagatggcaacaagacctaaaattattcccctccctgaacctacacccgtatgcgatatgactttgcagctcctcttatcaagagacaaagcctgtctgcccagaccttaaacttggtctggtcctgtgatactggccaatagcatgtggtgcaattgaccagttctgagtctagactccaaaaggcctcatgtgcttctgctcacccctggaaggctgtacagctgccatgtcagtaagcctgggctagcccactaaaggatgagacccagatgccctggtcatccctgccaacttgctgagagctcaccaactgccactacagacacaaatggaaatctacctgggaacagaagaccctccctgcagaacccaccctaatttgacttacagaatcatgagacaaatgacggttgttttaagccactaacttttgggataatttgttatgcagcaacagctgactaatacattatgactctgggcaagccacttgataatttagcaacagttttaccatctacaaaatggagatgacaaatcttgcctctggcacggagcagttgtgagagtcacatgggaaactatgtaaaaatgcattgcgaattttaaagtgcaaggtagccggggtggaagtattactattagaataacctggaagacaaaatgtgggaggttggccaatacttcacatatgaactgctatatttggggtctttctccagagacagcagaattccctgaggggttccttcggggatgccaagtctccactgactcttgtgtagtttccagggctttctggcaactaaggtggtaggtaatttgttccctgatgtaagaggcaccatggtagagcaggggtatcctaggagctggcatcccaggcaaggtgttggtattctggccctattgctttgtagcttacgctctaagctaagactgttcctcttgctaggtggtttctttgtgggtaaatggatgctgctacccctgctctgcattccacatggggcaggcatacggtaaaaatgaggtggcccatgtcaaaaattggtaccaccctgggttaagactcaggatagaggacctcccaaggtcccgggttgggggccccagccctacccgcaagcattcagatggtgtggtcagcaacacagcctctgttcccccaagacgctggatgggggccatgggctgtcctcagtttctgtgcacaaacatttacatcaacaaaagaaaacttccagagcagtaagtaattttcctcaagggacaaaggaggcgagaggtgttctgatgagttttgttggctgacatttttcagaagttatttacgggctcagcaaaggcatttattgtgtttagtgttctatgctataaatgctttggaaaaggagagtaaatgaatatgcaagcacccagtgtcagggcaagaacaggcaggtgtatgcggagcctacagcttccctggcggctccctgttgactgtcaccatagaaaccgagccatggggttaaaccgactcccaaagggcagtgcttggttaggaacacagggaaaagtactccccagttggaatccaacaaatgagagtgtcccacacctccccagatgcagatgggtccttgtgggatccaaagaggatccctctgggatatgtgagaagggacagaggtttgtctgcagccagaggccggatccgaggcaccgtgacttgggagtggtcacactcggtttacttggtagaaggcagcccccttactgccaatataactcaagacagcctggcagctggactggttcatcacgcagactcaggaagcgtcctgggcggaagcaaagtcatcccagggcttcaaggagccccagatgaaagccacaggtccagagcttctgagtggaacggggctgggctttttgagtccgatggacagagataatggattcttacccaaacaacacatcttcctggaaacaaacaaggcacaaacaaatacgcacgcccagaacactgaccatgggtggtctttcttctgcccaaggtgctgtttgaattactgtgttacccccaattcaggtttgctttaaagaaaaacaaaaaaccagttccaaacactttcagtgacactcacaccttctcctacgcatgccctctgatcacgtaaggaggcctgcagctaaacatacccataaggggttcaagaaaatgatcctcccagtgggagatggtgcagcacggactgactggtgttggcacctgagaaggaatgaagggccgggcgtggtggctcatgcctgtaatcctagcactttgggaggccgaggtgggtggatcacctgagctcaggagttcgagaccagcctggccaacatagcaaaaccctgtctctactaaaagtacaaaattagctgggtgtggtggcgggtgcttgtaatcccagctacttgggaagctgaggcaggagaatcacttggacccaggaggcagaggttgccgagatcgcaccactgcactccagcctgggtaacagagcaagaattcatctaaaaaaaaattaaaaaaaaaaaaagaagaaagaaagaaatactgatacacgtggcaacacagatgcgtctcaggaacttcctgctcagtgaatgaagccagacaccaagggctctatctacacatgtccagatacacatgtccacagaggcagaaaacagactggtgggctccagggactgggggctgggggaaatagggaggaagtaactgcttcatgggcacggggcttccttttgggatctaaaagtattctggagtgagcgagagagaggtggctgttgtacatacctgtgaatgtactcatgccactgcactgtgtactttcttcattttttttttttttttgagatggagtctcactctgttgcccaggctggagtgcagtggtgcgatctcggctcactgcaagctccgcctcccaggttcacgccattctcctgcttcagcctcccgagtagctgggactacaggtgcccgctaccacacccggctaatttttttttgtatttttttttttagtagagacggggtttcaccatgttagccaggatggtctcgatcttctgacctcatgatctgcctgcctcagcctcccaaagtgctgggattacaggcttgagccaccgtgcttggcctgcactgtgtactttaaaaatggggatagttctggcgtttgagaatgatatctcaacaaagtgttactaaaaaaaaaaaaaaaaagccgataggtgcctgagccaggtggtctaagtcccaaacctgctccaccacctaggggttcatgatgtggggcaagcaaaaccgcctctccctgcctcggttttctcctttgtcatgatacctaccattgcagatgtgtcgggcctggatgtgtcaatgcacgtgaagctcttagaagggccttggagaggaggaagtgggacctgtgtgccagctgctattatgtgtttcaatcttatcatcaatgctatttgcagcatgaggccccaggagctggcacaggtgaatctccttctgtggagttccccgagctctttgaagcaggatgtgtacattggttcaacgaacacctagactgtgagttcctggcctgtcagttccttgccttctccactcctgcccttgcacctgcctagtgcaacaggccctgagattgcaacctccccactcacgcccaattgtccccatgatctcatcacaaatagatgcccaggactcacccccgaagcccatccctataaagctgtgcacacccctaactggactgcatctcacccgactatcccagactcaaccccaatgcccacccctgtaacgctgagtgtgcccctaactggaccgcatctcccagcccttccagcactgtcctcagagctgcctgatgagctgatgtctcctcacatccattcctaccctgggcacctggtccctgcagatgagcagccaggctcctggccaggccagcatctcctcctctccctgctgaaggatgaggctgctgcggcagggccaccaactcccaaatcatccaagacatcttctctggactccatgtcttcatttcagcaactttccttcccaaagtggcgtctgctcactgctatgcctgggacctctcttttttatttcttttttttttttttttttgtaatttaggtgaaatttacaaaactgaatactaatcattaaaaaaatacaatttgttggcagttaacacatccacaatgctgtgcaaccagcacttttatctagttccagaacatttaaatcacccaaaaagaaaatctcatacccatgaagcagtcactccatgttatggactaacctgtgtgcccgcaacacacatatgttgaagccccaacgcctaatttgactgtatttggagatgggacctttaaggagataactaaggttaaatgaggttgtaaaggtggggtcctgatccttaggattagagtccttataagaagagaaagaaacacctgtgcaccttcttgctctcagcacacacagagaaagactatgtggggacacagtaagaaggtggccgtctgcaagccaaggagcgaggcctcactggggactgaatttgatggcacctcggcctatgacttccagcctccagaacagtgaaaaagtaagtgtctgttgtttaagcaacagtctgtggcattttgttatgaaagtccaggctgactgacatactccccgctccttctcccccatctcctggcaaccactcatctactttctgtttctacggatttgctaattctgggcatttcacagaaatggaatcacacagtacacaatgtgtggccttttgtgtctgacttcttttactcagcatcctgtttcccacactcatgtgtgctgtgtcagtccctcattccttttaagggctgaataatattccattcactggacagaccacagtctgtccatccatccacctgctggtgggcatctgggctgcttctgctttctggctattatggatagtgctgctgtgaacatctgtgcacagggacttgtctggacacctgtttttaattctctggggctctcttctttcttgagccctcaaaaccagattcacaccagctaccagcaaggtgcctgtggcctccacgctgcgaggtggaacggctgatgagcagccctcgtctcagctgacacagccgcctcctcctcctgcacgtgctctgccgggctggggtgtggccaggctctccagatgtcccctttctcacttcctggatgctcctggccactcctgtggcctcctcctcagctccccatcctctgaacgcagtcctctgtgtcttcctctctggccacacacacccccagggtgacctgctcaagtcttggcttcagatgccatcagactcctgtggccccagcctcaccctccagcccaacccatgcaggctccaccctgacacactacaggctgctcaaatgtaactcgcccaacatcacacgtaacatcaccccatctctgccctggcgcctcatccagttgctgaagccgcaagcctcgcctctgctctcaccctccacagccaatcagacagcaagtgcctgcaggtcacagacaactccggacccttcttgctgcccattcacaatctctgctctggcctgagccaccttcctctctctcctgggccctgtgcctggctctggaccagtctccccacttctctactgctctgtcctttctccacctggccccaaagccatccttagaaagccgaacccatcacatctcttgcctgctcagacccttgcatggcccaggatttttttctgtgtcccccagcctcactgagctgggctcagcctatgtgaccacacctccccgaccctcccctccctagaagctacagccgcgctgcccttcttgctgttccccaagcacaagtccattcccgccatggggcctttgcacctgctgttcctgctgcctgcagtgccccagcccatgcccacgcagcccatgcccttgcttctgtccggtctctgctgacacatcccacctctaggtggccatttttgtcctgcctaggaagcctgccctcccctctccagcactccccagccctgcagctgcttcacatccccagcagctgccatttccctgcaggggacaggcctgccggctctgtgagggcagggactctctgttttgcttccggctgtaaccccagctctggaaatggtgtctggcacacacagcccgcgcgaatagtgctctgtggaatgaatgaattctaagcttctcctgcatgtcagatgctgccgatggagtgatgactaagcagtggcgagggcacaggctgggcggggtgggagagacagacgcggagcagatcatctcaactgagtgggatcgtccgcgacagaaagacgtgtcacatgctaccggagccactgagagtgccgggagaggactttgcttgaagcgtggagaggagggactgtcacagctgggttttgcaggatgagtaggagttgggtagatggacatgtgagggaagggcatcccaggaaggaggaagaacataagcaaaggcccagaggtgtgaaaaagtttagtatgtttacacagaagcaaggagttgattcatattaacaatttatgtgtgatacagaatgtctcattcaatgcacatattagccctgtgtggtgggtacagtgatcatcgccattttaggatctgaaaaaagaatgtgagaggctccatccctttctggaggcttcacagctatgggtgactgagctgggattggaacccagggctgctgcctgcttttgtcaataaagttttattggcatgctgccactccattcatgggggtactgtctgtggctgctgcctgctacaaaggcagagctgagaggctgccacagggagcacatggctccaaaggctaaaatatttactctctggcctttacggataaactctgtggacccctggcctaggtcatggagaggggggtggcaggtaagttagggtgggccgtgccccactagaagagggacccgggaaggagggcctggcaggtctggggaagagggaggcccaagaagaggggcaggctcagctcccatgaggtgtctgtgcaggcacagggaacggtgaggacagggactcagctgccaaggcggggagggtgaccccccaagcacttgctacccctgggtgcctttgctaggcccacctcgtgcctggccaaggtgggacctggagacaaagcgaagccatggctctgtgtacttgctcgcgcactcacacactcatggaagacaggggagggtgtgcagtgactggggagaggggaagagtcaccaggggctgggaggtccctggcagcagggagggggcaggaggcaccccctgagccgcgcatctgggaggagcaggtggagtatgcagagcagagcccgcgggagggagtgccgggcagcaggtgcggcaggggcaagggtgtggaggcccttccagggcaccgtgacgggggaactggctatgcgaggagatgttttaactgggttgttcgagaatgttttgcctgatgcttctgagcagggattgaacgggcagaatagttaaaacccgagggaggtcgagtgaaggtgtgtgaaggtgacttcaaaggtgaggcgcatttcatgatgagcgtgagggcgccagtgggccgcctgactcccatacccagtccacacgctccacactgacagctcagggtgcctgtagctgggctggcaaaattcagccaggcttcaccaaccacaggcagagtccaggagcccagcggacacagagccctcctgctgtgtgcttcaaaggatccaatgggcgaggaccaaggggtggggtggggaggacacaggcccagccagggccccccgaccaataccaactctcctcccagccagaggctgccctggcccaggctttcagcaggggccccacagcctgtgccctggaggccaaggggtgtcctcaagaccgaagggtgctgaggggtggcctggggaccagccagtgttacatagccacaggaatggctgctggccccgagggcctacccagcaaccacctgagcgatgaggacccttggggacggccctcctgccaccaccctcccccaggcttgggaaggaaagagaaattctgccaagaacagagtacaaggcccatgaagctgggaatggcaggatattttaagcagtacaagggggattctgggttgccctggagacgagcgggcccaggcctcggcggctgtagcacatctgtgctctgtgaggccagtcccgtgtctgggctcaggggcgaaggggacccctccatcgcggggtcagtgtgggaaggtgggcgaggccgtggcctccccccaggtgggcaggttttcgggactctgcccaatctgtcagggaacccactgccctgtgttcaagggactatcttccccaagagaggcggcggggactgaggacagaggcgcaccttgtgagtgttctgcaagtgtcccaggtggagctgggcaaccaggcagggtcttgggaaggcctggcttcccgagagatccttcctcggggaggagggatgtgcagggaactccagagaggaagaggaagccacacctgtggaggcttcctggggtcccgcaagccagcctcacccagcatgatagaaaatgtgcagagggctgggtgtggtggctcatgcctgtaatcccagcactttgcgatgctgagacaggcagatcacgaggtcaggagttcgaggccagcctggccaacatggtgaaaccccatctgtattaaagatacaagaaatagctgggcgtggtggcgggcgcctgtaatcccagctacttgggaggctgaggcagaagaattgcttgaacctaggaggtggaggttgcagtgagctgagatcgtgccattgcattccagcctgggtgacagggtgagactctgtctcaaaaaaaaaaaaaaaaatgtgcagagggagggaagtgggaggccgagtactccttctcccagtgctcactggccccaaggtccacctccccagagcaccatgcactggcccaacttgaggttcttgtagctctctcttcagcgtgtccacccttcaggcaggtggctgcgtggtcatgctctccaaaccctacacccatcaccatcctagctgctcacctccacaagctccattcacctcccttgccttgggtacacactccttatgatgtgacctcagatcctgccacttgccatgttttcctgatccaggccatcgccttcctccacagccactagagtagacaaggatgggcaaactagatccaagcctgacccaggtctgaggctcgggaacaagaacccagccaagcccagtggcagaggagccagtcaaggcccctggctgggttctgaaaccacacacacctgtgttcacattcaggccatgcatggcctcctggtggccaaccgctcgtttcagagctcactcattcagcaaatagttacagtgtgcccctctctagttgtgaggatgtaactgtgtgggcggggtgagtgctggtccccaaaagatgtgactgtaccctagcccccgaaacccacgagtgtgacctgatttggaaaacagctccttgtaggtgtgattgagttaaggatcttgggatgaggagatcaccctggatttcccaggggggtcttaaatccaatgatacgtgttcttctgagagtcagaagagaagacacagacacagagcagaaggccatgggagaacagaggcagagatggggaaatagggccacagccgatgaatgcctggagccaccaggaggtggacgaggcaggaaggaccctcccctagcaactgtggagggagcacggccctgctgccaccgtgatattggacttctggactcctgaactgagacaatccgttctctgctgttctgagccacccagtttgtggtcctcaggagagtcacacggcttcattccatggcggctccccgccacgcaccccaacacaacccccaccccaccctcacacccttcagatcccagggatgaagcaaaggacagcaccatctccctgggggtgaagtggcttctccagaaccaaacggtttgtcaagatgtggtcagggccagggactgaacgtgaaatgggaacggaattcagcctcttccttgcgagaacctgggggttctgaaacgtggcctctagaatcccagtttctgtgtgaatttcttgtaccatgtgtgttcccaggggcctggggaacctgtccctactctccttcacccgcggccaaagtggggataaaatcctttctgagccaaagtcccgagccgcgggctacacccctcagagactcctgggactgccagccctgcccagccaccctggtggagtcaggtccctcacaggctgggtgcagccccccaggggtaggggactggcttctgggtgcagctgcattcactatcatttcccagccatgtggcgcatcctcccgtttcaatgttaaaatagaaacaagttcaaggaagatgcattcacctgcctgatctgcctgccagcttcctgtgaggtggcagccccaacggctctgaaaatgatcctcacccatcagggtcccgggctcagctctgtgccctctgcacctgggacacgccagcccccaggtggcctggccttctttgagatctgtccagaaacacgtgccaggcacaggtggctcaatgagactctgtccgagttccccagccctgcatgcatctcgctccagacatccctggccacctccatcgcattgagtccaaacccacatgatacaccccatttctctccaggagactgtctgcaaaggcttccgcgctccctgaccctctagagagggcagcccaggccccagtgggcagccagtataggacgggcagcccggggcagggctgcagcctcagccccatctggaatgcgagggtggtgctcctcccacagacccttacatcgcaaacattttgaggacaaatgattccagaatgaaggcttcttggggccggttttccctgcacacagatggcaaggaggcccgtcatttgcaagagctggcacttaaatgaaaaaacactaagtatatttgctaataaggttccagggtgagcatgtgtgacaatgacaagtgtgaaggtgccctacggtgagccgcggagacgtgggcatcacaccagaatctgggcccaggcctcatgatgccaggagccgggtgccgggctcggcaactactgcaccggctggctgcacggtgacaaagcccgcaagacggtggcaagagctcccttgcatatcgcatggttggctgaaagccccgaaatctgtcctgacaccaaagcaaccatgcatcgcacaagagaatcagcacacattccaggaggggcttggcagcaatgccacgagtttcaaaactgctaagagacctggtagatgctcgagccttacaacaaccgaagcttccgaggaaaccgcgtctggcctggcagaaagccggactcccatcaacaatgtgcagggaaaggcgctcccctctgtcttctgtgcaccaaccccaaccataaacactcagtggaggctgcaccacagccctgaggggcgctgtgcttgtttgcaggtcacaagttggacgcccaaggctccgagcagtaccgtggctgaggctgcacaggaagaggccgccatcactgcccctcgtgtgcggggagcaagtgcattcccagggcccattgcagggaagtccccggaatctacaaagctgccccatggtgttctggtctgtttaggcccaaacttatccactgtttcagctacccaagggaccaatggaagcacagccagccgctggacccctcgtcctgtctttctgcagtggccaccgtactcattcttataacccccatcagtgctgacccgtctccaggctatgtcccctgacaatagagccaactagccagaacgcccactgtgccagaagccgcccgcctctttggagggaagtggtagtttacaacaaaagcagtaagcaaaccacctcacggcctccagccacgtccatgcactgccaccagcctgcccaggccccagagggttctgctgcccccctcgaatggagatccggcccatggagaaagacagcggggtcactggactcaactttcccatgtagggagggggtctgtggcccgacggaaggacctgtggtgttcagacacccctctggattcagtgagtagggctggtgagtttctccagccaagatgctgcatatcccaccatctggccccattgtctggggacaggacacactccactttatctcctggccagtgagttaggcaggtggcatggctgagccccatcaggagcctgacccaccagcaaccaactgaacctcagccagagggcctgatggtggggatgcggcatgtgaacttcaggggcacacaaagcccagacgcagacccggggcatctcccatctccacccatctccactcatctccacccatctccacacatctccacacatctccacctccccacagaagggaggaggccaggaggtggacaatgaagacaatcgtgtggagcagctgctgcggtgaggccaggcacagactccagccttgacgcccaggctgccccgtcctctcctcttgcccctgaagtctacctgtgcccacgtggggagggtgtttgtgcctgtgccttgtctggggaacacctggatcatgacctgtggctgctgggctccaccagatcatgtgatttgtcttgttctggtttcagattctgagcctggtgaggttggtccagggtcccaccaccagccagggtcagctgggccccagggaggctgtgatgggctgaacggagtccctccaaattcatatgctgaaagcctaacccctgctcctcagaatgtgactgtatttggagataaggtctttaaagaggtgattaagttaaaacgaggtactgtgatgggccctcatccagcatgacagtgtctttgtaagacaaggagagccagacacacgaggcaccagggaggcacccacagaggacggccacgtgaagacaggccagagccgccgcagaggatgatgatcccgaatcctggcattcggtggcacgcaggtagggcacagaagtccagcttggctccttcgccatcaggagaccttggacagtcacacgacccagaccaggggcccggcaggggcaggaattttgggattgttaatggctccgtccacagcacctaggacagacagtgcctgccacacagcaggtgctcatggctccgtccacagcacctaggacagacagtgcctgccacacagcaggtgctcatggctccgtccacagcagctaggacagacagtgcctgccacacagcaggtgctcactggacacaggaggtgctgaatgaaagactgaaagggcttctctgccgctgcagcccacatctgtatgaatgaaaaccataaaggttgtccgcaatgggttctcgtgacaacccatgagaagggctccctctggggatagaaacactgtatgtgttcgacaaataaatgccagcccgtttatcctgacctctgctctgtgtctctgtggcctgagattcccctaggctgggaccacccaccctccaccttgagttcctgaagcttccccggtcttttctgggtctctcaaatcctcggttgtaaacagggagtagctgaagcgccctcatcccctggggtgatgcgtcagaggaactgggactgaagtcttcctgttcctccccctcaccccctgcccggttggataggccccagcaagcagcatcagtcagcccaagtttatttttaatcacatgattacccggggtcttttgtcacttaagcagtttaactgggagtgcagcactcccacagcagagcagccagaagaagcgtcagctggcacagcctggtagcagtggacagagggagccagtccttggagccagcctctccccagaggcagttctggatgtccaaggccagtctggtcctatccagcagatgggaaagggcagaatccctcactgagggaacatcctgagtacctgcagcccctggccaggtggtgcccatgtgtgttgatcaaggggacaaactatgactgagactgatttgatgggcagcaaggtggaggggatgaggttatttgtgttatctcttgcttaactgttcatccattcaacttccgctcatcccatctgtctatccatccatccaatcatccatctcataaactgagctattgctcattgagcacctacctgatataccttctcccacttttgaactccctcaaattctcagaggtgtcgcctacccatccatccatccatccatgcattcaaccacccatctatccaaacattcatgcatttaaccatgcatccatccatccatccatccatccatccatccatccatccatccatccattcatccatccgtgcatccaactatccatccatccatgcatccaactacccatctatctatccatccatccatccatccatccatccatccctccatccatcccacccatacattcattcgctgttcactgagcaccaacaggtatcttcttctaccttcagacccacttagcttcccagaggcattgcatagtcactcatccatctgcccacccatccaccccatgtatctgtctgtacctcactgagtacctaccaggtaccttcccccactttcttggaggtactgcctactcattgttcccagctgcctgggtaccctgtgtgtcctccccaggcccctgacatgtcccctgccaggtttccagtctcctctgcaccctatgcctcaccataacttaagtggttgatgcttacctcctcggagaaggaaggaaactagcagaaaacctactatgtgttgagcacacaggctgcctctgttttttcattaaacagtcatcacacgtccataagggaccatcctacttttctaagaagtcacaactggcaaggagtaaggaacagaaggcatatttaactctagatccaggattccttctgctgcccccagcagtcccacaggaagtagcccccatgctggtggaccctgagaactgttaaggaaagagtcagtgtccagaattccagattcccacctggttcccctgctgccccagctacaggactggtctcttccgagtccccacctcctcatctgtaaaatggagtaatgaaaaccactcacaaggcaaaacattagatacactggctgtccacctaggaaactccaaattctgacaacttccaaaccctggaggccactgccctgtccctgagcccacatcccctgtggcctcatgggccagggaagcagacagcttgcagtcctctatgaagcaaagccccttcctcctccttctgctggcaatctcctactcatccttcaaaacccaggtggactgttgcgcactctgggaagtcacagctctccagaccctattgtctcttggtttctaccgactgctcttgaacccacagggtgaagaaaaagggcctgtccctcaggccactgcacaaagtagaagtttggaatgctttttcaaaaggtaggcatattagttctctgcctaggtccaggacaattcttggcaggtttctcttactagtaactacccaggccaagctctgagagggacggggaatcctaagcagtcatcacatatttaactccagatccacagtcccagtccagttcacgccaccccccacccggctctgccatcccataatccagcacttccccgcatgacagagaggcaggcccaggacgcggaatgaatgtcagcactaatctgtttaggctcaaaaggaggcggattcagagctctccatgcacagccaccccactgggcagcgtggctgactggctgccggagataagaggcaagggggcggcctggagcgcaggcatggccactccctgctgggggcgggggctggagtctccctgcacaggtgtgaccagcactgataaaggaaatggaaagaaagtttgccttgggctggaagtagaaaattcacacctctgacgccttgcacatatttgatgagccggctcctggcctggcgtccttggatgtctggcatctggaattctgcagaagcttcgtgcatattttgctgaacacaccatgtggctgcagtgctggtgggacctgagaggggatcagaacctgggagatgggaggtgcctgaggaccagcgtgcatctgccggtgctgagcggtggggacacaaaggcacagggcgggggctggaggggaaacctgcagaatgatcgataacagcacagccaggaacgcaggagctgcaggagctagagctgccagatgccaggggcagcgctcgagctgcacgtctgcgtgccccccccagttcatatattggggccgaaatccccggtgtgagggtgtctggaggtgggggctttgggaggtgattagggttggaggaggtcatgagggtgggctctggtgattagtgtctttgcgagaatagacgccagtacccctcgccccccaatgcgagcacatggcacaaaggctgctgtctgcagaccataaaggactttccagcctccagagggctgagaaacacttctgttgtttgagccacacagtctagaggatttttgttacagcagcctgagctgactcaggaggagacgtgattcctactgggactttattcatcaacatttactgcacacacactggatgctttgggataagcacacagctacagaaaagcttctctatagagcgacgacagcagttaccctacacagaggggccgggagagcccccacgggaagttgctccatgtccccctcaccttctcctccctcctccaggcgggatcctcagatcctggtgaactctgcccagctcctacattccctgtccaccaattcctgtggattcaggctccaaaacgtctttctttctcaggtctccttccctcctttcctacccggctgctgcgacacccccacatggctctttgtggctctgtgaggccctgccaaaccctcagggtcctcttcctaagaccccgtccactgcacctccttctgcctgcagagactcagctgctcccgggcccaagccctcagccccacacctggcctcagccttccctccggatctaactccagctgggcatcccgggccacacttcacgcagcagccaccctgagctgccaccaatgtgtggctgcaggcccctgcctcctacccaaggggaggaaagtggaagaaccaggaacacacagggccccagagccacattcacgcacctggcaagtcgccacccccatggccgaggctttagcccaaggcacagggtgggtctctggcctcccccaggaagctcctgcccttgtgggctcgggcgatcagatcccagggaggtctttccatgactgcagtagaggctggtcacaccctgcagcaagcatcactgagacccatgtggggaaccctgccgggccctccttcctcacctctaagcaccctctctgcgctctgcaatgtgagcctgcagtggggcctggcaggctatgcccccggccccctggggggttcctgctaggatctgcctacgggaggaatgaatgagcccagaaggttggaagagggcaggcagcttcctccctcctccttgctcctttccaagtccctctagggcagcccacagcagctccagtggtcctggcatctctctgtgcttccactgcccacctggctgtgcccctgcagcggtgaccgtggtggtggaattgtgatggctggggaccgaagtgccagcgtttctccaagcactaggacatcgcacagccagacgaagtttcttggggccaatagccctgggctgtgggagccctggctgggccacaccccacctcaggcatctgaggggccccttggctgcacccctgcaaggtctcagcttggtcaagcacacaggccacctcttgagcgataagcactgtcttgctccccaccaaggcttgagtccaggtagccacttcccccagcccaggcagtggcagctgcaccctgcagctctgaagtgagagtgaaggcacaagaggacagacaccacgggggacaccggcgccctgacccagcatctgcggcagcaccaggaagccaagcaaacctctcagcaaaaagccgccccaagcggccaggacctcctcatcaaggattgtcattttcaccccaatttctacccgacctccaactcagggtcaaccagagaaagccaaatctgctaccccaaccaatgacttagaaggccccagtgctagtgagccccgcctttctctgctacaaagcgtttccctcactgcctgcctttgagcctctgcctcatgtaagtagcagggcctggctgttgccacagcaagctcgtgatacccagcctctgcttactctcggttgagtggtctccacgtatttccatgccagccctgggtgcccacatctctcatctatcaccctccttgggttgaaacacccgtgtctcagccctggggctcacagtccctcaaaacaaacctccgggcctccgtcccctcctcctgctgccttgaaaacacagtcttggctgtgtcccttggctctgtcccgcccctatgagtggtcctgccactgtggtgactacccttggagtgtcctgccctgcgctggcctggcctgaggtaagcctggaactcagagagccccaatcctctccggggaacgtgggtctcgtgtagagtaagcttggatgggtagagctgcttggagctggcctggcccccacctggcccagggtctgcctcctacttctgtgagccgtcccactccctgcctcacctgagctgtccctaggtcacccgccgccttggaagttgcagagccttggtgggaaacgcattgctgaggatgcaaatgcaactgaggctcaaaaggtggcctcatgccctgatccgccacacctgagacctcgagcgagcgttattccttcatccgtgtccttcacggttgtcaaaaaaggcctcggatgtgaaaccatttgggcgcatttacggaaaagaaggcagctgagcacatgcatgctgcaccctcctctccagcctccagccaacccagggcctgggggctttcatgggagttactgaagggaaaatcacacaggtgctgacccgagacagggctgaggacctgctgggtcagaatctcacacccacgcttcaaaggtgactctgacacggtccaggaggctgtgaactcacccagcagatctgggggcagagcccagggctgggtagcgtgcccagccacacttgtagcacagaagcagcctctcccaccacactctcccgcctctccaggacagggaaggctgggcctcccttcagggtgggggatgcgggctgccccatgctcacagcccccatctcctctcccaccacactctcccgcctctccaggacagggaaggcttggcctcccttcagggtgggggatgcagggtgccccatgctcacagcccccatctcctctcccaccacactctcccgcctctccaggacagggaaggctggaccttccttcagggcgggggatgcggggtgccccgtgctcacagcacgcatctcctctcccaccactctcccgcttctccaggacgggaaggctgggcctccctccagggtgggggatgcagggtgccccgtgctcacagcccccatctccccgctgctttcagggtcacccctaggaggggccgatgggagcctctgggtctggtccctgccctccatcttgttgctcccctttggtcatcagcacttgcaggtggccttgggtgactcttctgtgtccccaggcatgtcacacgacctcccacctcagctcctctatgccccgctgcccccacactgggggagggctctgccctaccctttccatcccagcctcaggtctgggctctccagatctctctgccacagcccctggggatgagggtggcttgtctgcttccctccaccgctgtactcccctttacccctccacccccctccctccaccccagcactcccctccctccatccctgcacccccctacccctgtactcccctccctccacccctgcactcccctccctccacccctgcactccctgctcagtctcttcccctggctcatccatggtccccacgagtgactggggactgggctgcatggggacaagcccgaggtggtaagactccgcttgggttcacagaagtaggagactgaagggctgggtggggtacaccaccctgaagtggaaaccggtggcagagtttgcagcaagtgcacagggaggtggcaggcggggaggtggggctcggtgccatgcttaggattgccctgctctccagaactagccctgggcagcagggatgggagggacccgggcagttaccagctggctacccggagaacacagtcctgttttctgctggtggaaaagtcttttcatggcctgacattctcaggctcctaatcaccccaggccaggagccatgggggccgggtttccttgtcacatcctggaaggacagctgagtaactgaagattggcttacagactagtgttgggatttggaagcctgtttccagggcagcctttagacctggcactgctggtggccaccaggcttgcgttggagatagcactgtttgggtggggctgacctggccctccctccatatccccaggccccaattccatgctgaatagcagagacaacagcatgtgtgtgcacatgagtatgtatgtgtgtgtgcatgcttgctgcacatatgtatagtgtgcatatgtgtgaacaggcacgtgtgtgcatgtatgccacatggtacatgtatgtgcagtgtgcatgtttgtgagtgtccacgtgtgcatgcatgctgcacggtgcatgtatgtgcagtgtttgtgtgtgcatacatgcacacatgatgtacatatagcacacacatgagcatacgtgtatgtgcacatatgtgaatgtgtgtgtatacatggacaataataaatattagacgaaaaaagaggagagggaaggaggcaggagactgcactgctatatggaacagtggagctgaaacgggggttatcttgtccactctgtacacctcctagtcaggaaaactaaagaagtcacatgacttgtctgagatcacacagcagagaaggaccctgggtcttgactcccagttcatttctcagcccactgcaccacaatgcctggaggctcttcctgttcccaggaattctgagctgctcccaggatacccaccacagacaaaccctgaactgaggaggcctcgcccagacataaatcaccaagagacacgctgttctgaaagccaccagtgccgcaggtcccccatggatggaatccctggggcaaaaggtccttttggcaagagtgaggaagtcaagggtgaacatccactaaccagaaaaagggaccgtcccctgcccacccccacaaccatggtgggtgcctggctaatgcctggtgctccctggagggactgctggcaggagggcaggaaaagacactccctagaatcagggagggccagtgcccaaagggggccccatcagcacctaacccatcagctcctaatgacctcagatccaacagtccacctttaaaataaatattttctaatgccaccccgatattgccaggaaataaaattcacagatactagaaactttcagtatacccacccccaatataattccttctaactgttaaggtgcagacaaactagaagaaggacattgtttacaacacaaccgtctgcatctccatgtgaaatgctcatacctacacagatggagtgaccgtgaatgtgaagaccactagtgccgaataagctggcgaccccctcccaccagccctgctgcttaacagtgaagtggagaaaagctcttggaaaagttccagattaaaagccagcactggagagtgctgcccttaggacactgtagaacaaccctccactgacagcaatcagaacactacacaacagaaacaataacgaatcccccccatcacacacacacagcgaccgacctgagggttctgaagagtaaataagagcagtcagatgggctcaggtgttagtttgcatttcatgggggctttgtcctgaggacctgctgcagacacacaaccatgtggcacaggcgactaaaaccccagtacagctgacatctttcaggctgaaggattcaggggaagaagtgcaggcaactgtaggggaactggggagtgagaggagagccctggagggagaagagccagaggaagggagtccccagttctgggtgtgcatctgcaaaagccccaggctgaccccgaagcacgcatgtgtaggacaggcacaaaggagtggagcaaaagcttaaatgagtgatctgagactttaaccactgaaggcaagatggagattccagtttgagtctaatcatagtagctgtcagctcaaacaaatcataaacatcctccagaggaatataacacaacccacaatctacacaacataatactcacaatatcaagcaaacaatccaaaattcctgggaaaatatgaccccattctcaagagaaaagacaagagatagcaggcttgagatgatgcagatgctggacctaggaggcaatgagtttaatgccactattgtaactatttcaacaaggaaaggtaaatgtggtgaacattttcataaaaaggaaccaaatgaaaatgttaaagttgaaaaacacaacatctgaaacaatccaatggacagccttagtaggataaaagtgacgaagacaagactcagggaacttgacaaatcaatgacatttgtctaatctgaagaagaaagaaaaaaagactgaaaaaaaaatagacaatgtcagggttccaaaggacagtattacaaaaaatctaaggattggataatcacagtcacagagaacgaggcagaaaaaagtattttaagaaataataaacaaacttctcaaatttgatgaaagaaacgaatgcacagattcaagaaactcagcaagtacttctagttccaggaaagatggagtacacacaccacactctgtttccctagttaacgcagctagcaaacctgggcagatgctgttatttatggactctgaaaaataaagagtagcaggcaattggagaagaaaggcagatttccaagtaccactaaagaagctgtgagtttcccattttttcccttgggctgtcacctggctgggactcaaaggtagcctgaaagccacatgtgtataacaagtgtggataaaaagagcttcaagaaaagggagccccaaggttcagagtgcatgggagatcttccctttcattctttattgccttttctcccacccacagcctcaagcaatcctgtggtggcggaggttgggcaggcacctaaaactctggaggaggggatccttctttctggccagaggagctgtggtccacacatgtggaggaatccccattgcttttggcctctctctctctttttctgccatttgaccgtggatgaaggtccatttgcagtaagtttatggcaaagcagggaaattaattaaggtcccagtttttcatccagaagcctgataaaggggtctccatggacacggaaaatgtcagggagactgtagtgaggagggagcagaacagggatcgtgtgaagtggtgtgtgaacttctaggctcagctccaagttgtgcacaggtggatctgacctcgaacagcatatcaatgatattcagaaaagaactaagagataaaaaccaccaccatctccaagcttggcgagtgtctgtgcatacgtgggacagatctcaatcgcaagccaaggggttagaagctcatttgacgttggaaaccatgcataaaagttctataaaaggaatttagggcttgatctcaaccaagtgctcatgtcaacctattccatcgggtttaaacaagacccagagtatcttaacaaaatattccaaatgtccatgatacaggtttcatttacttggcataccaagaactagaaatatgccaactctcaacggaaacaatacaaatgaaaaaaaaattactagatgtgtcaaaagcagaatatagaagacagaggaaacaaatagtgaccttgaagacagatccatagaaattatccaatctgaacaagagagaaaagcacataaacttacagattcaagaagctcaatgcatcctaaacaggattagctcaaaaaatccattcccagacacgtccaaatcaaattgctgaagactaaaaacgaaaaaatatatactgaaagcagctagagaaaaatgacatatttcatacagaagaaaaaccacaggaattactgcagattcctcatcagaactatggaggtcagaaggaagtggaacagtatttttaaaatactgcaaatgcaggattctatacccagtgaaaatatccttcaggaataaaggttaaatcaagacatttttagatgaagcaaaaccaagaacatttgtggccagcaggtcaactttaagaggaatgccaaagataatgcttggaatggaatggatatgataccagagagcctttgaaagtcaggaataaagaagtacagacaaaatggtcaatatcttttaatagactatacttcacttcttacattcttgaaaatacgatggttgaagtaaaaattattatattttatgatagtagtttcaatatatgtgggtttaatacacgtgatagctacaccaaaaaagggagagaataaagcgatctatatggtggtaaggtttccatgttctacttgcagtggtaaagcattaagtaaactgggaaaagctacatatgtgtattgaaatcacagactaattgctttaataaaaaaaaaagctatataattgttttaaagcctccaaaattaaattaaaatggaaaagtaacaagtcaaataataatccaaaaattatcgggaaagaaaaatagagaataacgtgcaaaggaaacaaatagaaaataagaaataaaatggtagatataaatactaacacattaataataacattaaatttaaatgctctaaacacatcaaataaaatagattaccagatggagttttatttttttatttaaaaagttgacttctttattatttttttgtagagatgtgatctcactttcttatccaggctggttttgaactcctggcctcaagcaatccctccccccttggcctcccaatcagatggactttcagaaaactaaccaatgacatgcagtctataaggactcaaatttacatataacaacatagggaggttaaaaacaaagggatagaaaaagacatacacacactaataagaagaaagccagagtggctatattaatatcaaagtagtctcaagtgcaaggaaaattgccagggataaataggaacattgaataatgattaaaaaaaatcaattcggccgggcgcggtggctcacgcctgtaatcccagcactttgggaggccgaggcagacggatcacaaggtcaggagatcgagaccacggtgaaagcccgtctctactaaaaatacaaaaagttagccgggcgaagtggcgggcgcctgtagtcccagctactcgggaggctgaggcaggagaatggcgtgaacccgggaggcggagcttgcagtgagccgaaatcgcgccactgcactccagcctgggtgacagagcgagactccgtctcaaaaaaaaaaaaaaaatcaattcaccaagaagacacgccagtcgtgaataacctaaccagtataataatacctaatgccagcataaacctacaacctaacattggaacttcaaaatacatgaagcaggccaggtgcagtggctcacacttgtaatctcagtaccttgcggggccgaggcaggcagatcacgtgaggtcaggagtttgagaccagcctggctaatatggtgaaaccctgtctatactaaaaatataaaattagctgggtgtggtggcaggtacctgtaatcccagctacttgagaggctgaggcaggagaatcgcttgaacccaggagatggaggttgcagtgagccaagatcatgccactgcactccaacctgggtaacagagtgagattctgtctcaaaacaaaacaaaacaaacaaacaacaaaacaaacatgaggcagaaaccaacagaactgttaaaaaaaaaaaaacaaaaaacaaacaaaaaaaaacaaaatggacagccacacgatgatactggaaaatttccacattcctacgttctcagcaatcaacaacagaggacaagtcagcaaggctataaacacttaaaaataccatcaaaaggaccgaactgacatttaaagaacaccgcactcaacaataacgagcataatatacattcttttcaatgtccacagaatattcgccaagatagaccacagcctgagtcaaaaaaatagaaaaagaacaaaatcaactcaaagcatggagaaggaagcaaataacaaaataaggacagcaatcaataagctaaaagcacagggagaaaggagaaaacttaatgaagttcaaaggtagttctttcaaaagatcaataaaattgataaaaattttagtaagactgacaaagaaataaagacagaagacacaaattactaaaagagatgatatcactacagggctgactttaaacagataatgagggaatactgtgaccaagtctaagataaatttgacaatttaggtaaaataaactaattctctaaaagttgcaaacttccagaactcacctaggaaggagataaattgtcttacatctattaaagatattaagtgtgtgtgtgtgtgtttgagacagagtctcactcagtcacccaggctggagtgcagtggtgcaatctcagctcactccaaactctgcctcctgggttcaagtgagtctcctgcctcagcctcctcagcagctaagattacaggcgtgcaccaccatgcctgactaatttttgtattattagtagagatggggtttcaccacgttggctaggcttgtcttgaactcctgacctcaagtgatccacccacctcggcctcccgaagtgctgggattacaggcgtgagccactacgcctgacaattgtgtagtttaaaaagcatctgaaaaagacttcttgactccagtgatttcgctggtgaattttgccaatcatttcaagaagcagcaacaccaactctacacaattcctcccagaaaagagaagtggagggaacgcttcccaaattaatttataagggcagcattattctgatacacaaaccagacaaagacagcataagacatcaatacaccaacatccctcaggaacatagacacagatccttaaaatattaggaagtcaaatccagacatatattagtagaaagggaatcatgagcaagtgtgctttatcctgggagtgcaaggctggttcaatatttgaaaaatttattgatgtaagccaccatataaacaaactaatgaagaaaaacagataatcatagcaactggtgcagaaaaagcctttgaggaaattctacataggtgacagcctccccccggtgagctcgagcagagcccagcctggaacttgtggcccatgccttccacatttgggttctgagtagcctggcaaaggcagcggtaggaggaggtggaaataaagagctttctggcccccatggtctctgacattacttgaataccatggacccataagagttagtggcggggcctcagtggcaggagagggaggacaaggatgaaaagtccaggtgtctgggcaatgctgaacaccttccagacagcacgtttccaagaaatgctgacaaaaccgaagagctgggaagtgctgcttcaaatatctagatttaacacggccccagatgcagagagacatcgattacagggaggcacctgggtccctaagaagatactaatacagcaataataacggctatgattacaaaataataagtaacgatactagtaaaagcaagatcccagaagtacttcgaaatgtcccgcacaattcctatgtatgaaaaccctgttcataatcttttttttttttttctgagatgaagtcttgctctgttgcccaggctggagtgcagtggcgtgacctcggctcactgcaacctctgcttcccaggttcaagtgattctcctgacttggcctcccaagtaactgggattacaggtggccaccaccacactcagctaatttttgcatttgtagtagagacagggtttcaccatgttggccaggctggtctcgaactcctgacctcaggtgatccacctgcctcggcctcccaaagcgctgggattacaggtgtgagccactgcgcccagcgcgcaggcagccttcttcctgtgggtgtccaccctccaggggcttcctgcagaaactgtgtgcaggggtgcactccggcccctcatcccatccctgccctgtgagcgtccaacctcttggcctctctggtgccctgtgggcacccgggcagagccagtggctttccaggcacgtccccagccccggccccggcctgcagtggtggcagtgggaccacagtggagattctggggacaaggcccagcaggttctcctggcaaccggcctttctcgtgcggaagggactcactcctggaggccgccctcggctccgcaccccgcggctgccatctagtggccacaagcagggacgccaggcagtgagtccgctcctaccaggcgagcgacaggccacaagagggaagacaccgcgccagcagattcctggaacgccgcggcttccggaggggcctcccagtgctggggccatcgtagggccacttttgcatcaccctccgattgttggaaatacaagtttatttccatcttacaggatggctttccgttgcccagctcttgaatacccagccctcccagctgtgcctgtgcagaaagccaagcctatgacttagccgcttcaccgagccccggaccccactgacgtcctggggccaaaggcctctgtgatcttgcggagatggctctgctgctctgagctcgtttcctcactggccgcagcgggttcagggtgacagctgcagcccccgtgcgagcaggtgcaggagacatccccagctcccccagaggcaggttcccagagcgaggcagagaaccttccagactccaggctggaggtctctcttccaccctccagccagggaaagctcccttcctgaatgtccaggctctgatgggaaagatcctttacctgaaaacgctcaaatgctggcctgggttctctgagccttagaggcacattttctgaaacagggataataagggttccaggagcactcactgatcctgggggctggccacggtgctgggcctagggatagacaggaggtgaaccggagaagagcccaggttagcaggtgaagcccccacgctgcctggcacagagcacaccctctcccagaacaggcatttgaatccaccgccgcctgcacgctccttccctccagctgtgtgggcaggggctgtggctacctctctaactagtctcacaacccctgctgccctctctggggtccaggcaggttccatggcatcatactggaccctgctttctgccactagcaggggaagacggggaggcttggagctgctgagggcagggcctcggctgcacactctggggcaccaggcagccccacacccctatcatctcagtggccacgcagcgttgaacatattctgacatacggaattttgctttgtaagctgctttgtctttctgggaacgtgtcctctaagctcacctttacacagatctgcagcttgtcttatgtagatcagcacagaatgttacaaaagagaacggatacatagagcagaccctgggctcagacccaggctccaaacctcctgggccaaccactccacttccccaggtccttgcgcccccgtctgcaaaatggagcactagcagtttccatgatattggacgtttggcaaggattatggaggggagccgtgtgaaggtcaaaggctggcaggtaacaaatgcttaataaatgtgactattcttatttttattcctccatgcatccctttagtagacaagtatctactgagcccctgccctgagcaggagagacaggaagcaggaaggttaatagcagtgttaggagctggactcctgggtttgaatcccacccagctttgccatttatgagctggctgaccttgagcaaggggcttacactctctagcctcggtttccttatctgtaaaaagggataacaaccatatcaacccatgcagataagagtgagcatagcaggcctgtggctgctgccctgagaaagtcctgcccgcagggctggcccctagctggcatctgggagctgaaatgtcccctacatggagaggccgggacacccagccctgcggcagcagctcccatggcgtgttgagccaacactgtggtgtatgcaagcaaaaccccagctttccttccagaagtcgggaattgtggcacgtgccaggctgagggtgcctacgtgacaggattcccaagggagaaatatttcacacatgtggctgcattttttcctagtgggtggggaatgtgctgtgtcccctcaaggagagagggagggggcttcagtctgctcatggatgcctgcagactccgcctaagctgtggcactgttataaaccttagacaacaggatgactctatatcgagtcctgcgagtccttccagaggaccccagaatgtgtgggtggggtcccccgacacaccatcccataggcctgcatgaatgtcccagggttgctacaacaaatgaccccagaccaggaggcctggacaacagatgttcattctctcagttctggaggctggaagtctgagatcacggtgtctgtaggatgggctccttctggaggtgagagacagaactagatggatttcctaggcagactaagaatccctaagcccagctgggaaggtgaccgcatccacctttaaacacggggcttgcaacttagctgacacccaaccaatcagatagtaaagagagctcactaaaatgctaattaggcaaaaacaggaggtaaagaaatagccaatcatctattgcctgaaagcacgggggagggacaatgatcgggatgtaaacccaggcattccagccggcaatggctacccgctttgggtcccctcccgttgtatgggagctctgttttcactctattaaatcttgcaactgcacgctcttctggtccgtgtttgttacggctcgaggtgagctttcgctcgccatccaccactgctgttcaccgccatcccagacccgccgttgacttccacccctccggatctggcagagtgtcccctgcacttccgatccagcgaggcggcgcccattgctgctcccaattgggctagaggctcgccattgttcctgcgccagctaagtgcctggggttggtcctaatcgagctgaatagagctgtaacactgactgcatggcccaggattccattccttggaatctgtgaggccaagaaccccaggtcaaggaacaagaggcttgccaccatcttgcaagtggcccgccatcatcttgggagctctaagaacaaggatccccagttaacagaggctctgaggaagaatctgccccaagcctctctcccagcctctggggctgctggcacccctcagcagtccctggcttgtggccgtatccctccaacttctgcctccatcttcacatgtgagaactaaaaataaaatcctaagcccccgactgactggaacaaggggacaccacagaagccttaaaaactgagttctggccgggcgcggtggctcacgcctgtaatcccagcactttgggaggctgaggcaggcggatcacgaggtcaagagatcaagaccttcctggccaacatggtgaaactctgtctccactaaaaatacaaaaattagccaggcgtggtggtgtgtgcctgtagtcccagctactcaggaggccaagacagagaactgcttgaacctgggaggcagaggttgcagtgagcagtgagccgagatcacgccactgcactccagcctgggcaacagaacaagactccatcacaaaaccaaaccaaaccaaaccaaaacaaaacaaaaaaactgagttctggccgggcacagtggctcacacctgtaatcccagcattttgggaggctgaggcaggcaaatcacttgaggtcaggagttgaagagcagcctggccaaaccccgtcactagtaaaaatacaaaaattagccgggcgtggtggcaggtgcctgtaatttcagctacttgggaggctgaggcagagttgctagaacccgggaggcggaggttgcagtgagcccagatcgcaccactgcactccagcctgggctacagagcaagactccatctcaaaaacaaaaaacaaaaaagcaaaactgagttccaaccatgatgggacaggaggttgggcacgtcttgttatgctgctccctgttgaggtttagccacaactggccggcgttaacactaaaggagagattgtgagactgatagaatgggctcctggtggcaataagagactggattgtaagcaagacctaagactgtgtgaggcaagggtgaagtcatgcaccccacacttaaataaacgagttctggctgtcatagtgcttttctcttcctctagcagccagcaagccccggccttgggatggacaacattaaaaccattgcagctccaccagatgctgataacagaccccatgccagcagccataactataactgtgattggataagaggctgatttcagtagctttctcttgataagaaaccactggccaaagactgaggcatgggacggattctacctcggagcttccagaaggaacccaccctgcagacaccttgatttcagacttccagcctccagaactatgagagaccggctctgccggtttacagaggctgctcactgagcggctttacgttcctgcttcaccttttgacatacagagcctgactgtaatgcctttaaatgtgaagcctccaccccaggtgaacatgggacgcatgtaacacgcatgtgtgctcagtgcacatgtcaggacctgctttgtgaatattcacagctcctcctgtaacctgctgagtatgcttaacctgccataaccttagccaatgcattcagcataaagccccgttccaccctcacctcctcgaagcgcctgcctctggttttggctagaggcccaattcccagctcacaggttgtaaccctttataatagtctcccttctaaatttataaatcgtgcaattcttgggctgacatgtgactttctgctccccacgtttgttcctcctctcttctaaggtcacctgccattggatttggaggccatcgtaatctaagatctcatctcaagatccttaactacatttgcaaagatgcttttattttccaaataaggtctgactcatagcacctggaagttaggacgcatactggtcatgggtggggccagcattcagcctgacaggacccttgaggggactcgatgaatccctaccctacagtgctgtgggagtgtgcagcacagggagcggctcgggaaggccccatggtggctgctcccctgagcattgcacacctgtccctgcctaggcagtggcctggaggcttccagctgaaggcagttgctgaggctgcaggtaccccaggagcaaatgaagggattaacctggagggtggtagtcagtgtaggaaggctcccgggaggagtgacctgtggggcagaggctggaggatgagaagagccagcaggaggcgggtccagagccatgtttgcagggcttcaatgcagggaggtgatggtcccctggaggatgtgctcagggagctgcaatgcccaggggcagtggtggaggtgccggctttccaggctgcaggtcgggtgggagaggccccactgggaggagagcgtgggaccctcctctatcagtgtgctgggtctctggataaatgagacaaagtcgtctgctgtggactgaatggtgtctcctccccacaaattcaaatgttgaaacccaaacctctaacaggatggtatctggtgatggggcctttgggaggtgactggggtgagataaggtcatgatggtggggcccctatgatgggatttgtgcccttactaggagagataagagagtcccagtctttttctcccttggccacacgggggcatagcgaggaggtgtccatgagccaggcaggctccctgatctgggactttcactctccagcactgtgagaaaatcgatttctggtgtgtgagccccagtctcgattgtgtttgtttcagcagcctgagctgagacatcagccttccccagacccacagaacgaggcaccatgtctgcgtgggatgatgatgatggtgaagggtgtccagtgagtgacgcacctctatgggtcctctggctcatcccgggtgcaccagtgttcccctcacattctggagaagactctgaaacactccaaggtgcagggcttccccggctttgccatgtgttccagtccctgggggtcttgccagcaggcaggctctcattcagtaggttctgggggcctgggagcctgcattcctaacaagcacccaggtgaccatgcccatgctgtgctccatgggccacgttgagtggcaagatcttcacgagtggcccttgacctcagccatccttgtgcagatacccccaaacctgagctgccccggagggctttttaaagcatagaacttcagattccagggtggagtctgggattctgcattcctagcaagttcccggctgctgctgctgctgctgctggtctggggcatccagctggagcaacactgcccaggtggttctcagccccagcggcttttctcaatgactgctgccctggccccgcccactccatcagcatctgtgggcgtggggttctttttgcagcgccccagagattcagagaacccctgacttcgctcctgctctcttttcctcaatctgccaatgctcatctcatgaatatttcatctttaaagcagacagaatagagcaaagctccaacaaagcaaaacctaagccaacgcggtagttctcaaaattctgtggttttacaaacgtggcctgaaattagcttatttttaagccgaaggaaaatgaagcccatgtcaatcgcagacctcccaagtgtcctggctggagacagaagttctccctgggtgggtactgtcaggctgtcggttagtggcatccagggccccccagaccagcaggatgcagaggaaatgagaaggaatgtcagtggtgggggcgcctcttttgagtctgtattctggagttggtgggcagctggtctgagggccatggtgagagtcttccaccagggtttttgtggtgccaagtgtccgggtgcttggagaccaccccagggtgctgcccctccagtctaagcccagccactggatgacagggctgatggtccagtacagaggtgcacagaccccaggccccaggtccacagatcccacaagcagtggaggtcatagctccttcctcagtatgagccatctggatggcctagtgtctaccttagggcaggtgcccctgggtcctctcaggtaagccacactgacctggagaggcaagaggtgaggggcattaaggccacctggccctctacagcggccacctgaaatgtgtgccctcatttcagcccggaggaggagggaagcacagacaggtggtggccttgttagagaagctcagaatggaggcgggagagatgctgtcacttttcaaagtcatggctggtggccaggccacgtgatgggagcacgctcacctgcacaccaccatgaggcccggccatactgcattccacctgggcacatccctcccagccactcaactctttcctaaccaccccctttccctgccaaggagcctgatctgaaggagcagggtgtgacaggggaactcattggctgtgcgacctggaacaagtcacttaacctctctgagccttagtttcctcatgtggaggatagagcgaaaaccaatctgccttggagggtgggtctaagttacaacaaatgcaacccaaatgatgcatcctaatgaacaccagtgatgaagcacctgccacgtgcagcagccacgtacataaccatctttgagacagggccatgggatgggaactcccatccccatgggacagcaggggacacaggggcacagagggtttgctggcaggggtggagctgctccgggataactgtgctgccctgaggattgggtgagtggatgtgggtgaagcatcagggcctggctctgcagggaagtgtagcagaagttggacgttctcatgactcccatgcccttctgtgctctgagctgctcgggaccaggctgggctcgcagtggtcagtgaaaggccacctactggggccagcctcatgaaggggctgagggccatgtgctttcgggccaacagcacccacagaaagcaccctgtgacctggacagcagcatgcctggctctgagcctgttgggccatatggatgcccgatgcataatggtctgcagctgactgcaataaagagcaggcaggcagaatgcatttgacaggagggtgtcacccctagaaccacacccagggagacggagaggcccaagcttcaagggagcacagccccattgcaggcttactagagagagaggctcagctgtcctgggcctctgggcacactgtgagtggatgtgactcagcatcaaccacactattaaaccgctttttaaaagggtggaatgtatgaaagttagatgctgacatgaaatcataccacattaaactgcatgtatttattcagagctgtgggaatcatagagcaaagttttccattgctcaaactatctgattattaagtcatccatatacccaccaatccatccatccatccatccatccatccatccatccacccacccacccacccacccacacatcaagccttcctttatctcttccttcccctctctcttttgtccatcaatccattcacccacccacccatccacccatgcatccacatatccacccatccatctatccactacccacccatgcatccatccatccatccatccatccacacatccatgcatccattcacacatcattccatcctttatccctccctcctccttctatccatctatacattcacccactcacccacccatccatccacatacctacccacacatccatccatccatccatccacgcacccatccatccacccacccatacatccacacatgcatctatcatccatccatccattcacacatcaatcgatcctttatccctccctcccctctctcttctatccatctatccattcacccacccatccacccacccatccatccacctatctacccacacactgatccatctacccatgcatccacatatccatccatccatccatctacccacccacccatgcatccattcacatatccacccacccactcatgcatccacacgtgcatctatccatccacacttgcatcaatccatccatcatccatccatccatctacccactcacccatccattcacacatctgtccatccactcacacatccatccatccactcacacatccatctgtgctttatccctgcctcctctcttccatccatccatccatccatccatccatccatccagttggtcacatatttattagcacctgttttatgccaagttctatgcagggcaggcactgatgaatcagagagggtgttacatatggcccctctcccaacagattcttaggcctggagggaagtaatccattaatgaaagacaagccactgaacaacagcccaagggaagaagactacaccagttctgttttgatcggggagagaagtgtcagggcaggaagtggggaggtgcagaactgaggtggaagggaagagggagttgggcctgccttccatccatttcctgtttcctggggaaacattatagcccacgtctgtgtgccagtctttgtgacccaagtggcatggctggccgcctccaaagatatgcatgcaattcaggtctggtcaaagggttcatccaactcccttggccagcatgattgggtcagggatgggcagtgattcaaatcagtccagtgaaattagatcctgaaccttcttttacaatgactgggaaagaggcagtcttgctcttatgtgactactaaaacagcagaatgctagcctggtgctgccggtgaccacctctgaatggcatgggggagttcatacagacaacaccagagaaaagagaatgagagcttcttaaggctccctaagcacctggatccagccaggactgaagctgttattcctaaacttaaaagccgttaaatttctgtttggtttcagccaggataggcttgttttctgtcatctgtaactaagtgtccttaataacatggcagggtatagcctcagcaaagagatccaggagctcccaagaagcaagaactcccatgaggctctgaaatcccctgcgagagacccagggtggctggtgtaacattaagtgggcacaaatgcatctggggcaagtccctccccagctcaggcttcagtttccccatacatgaaataagttttgttttctcacttaaagcttcccaacacttttcttgaatgacattttgtaccttatatcctgaactgctctgaaattgggaggaagtagaggacatctgtacggggtgagcaccttggaaacgggaagaaagccattacctaggaggtactgtgacagaggtggccagctgcctactctaacatcagttctcaacttactcatccatagcaggttatctggaataaagccaacagctcagcctcctttgagatgatgttatggctgatcatccataattggaagcagagtggacaatgtgcatgtccttaaaagagggaatgttttcttgaacctttcgctcttcctctattggaacgcagatacaatggctggagtctaagcagccaccttgaactgcgaggcagcctattaaggatgttggagcagcaagaaaggcagaggccaggtccctgtatgtttgaagccctcatatcagctctggactgctgccctctgtcttctttaatatgacagagaaatatgcctctgtgtcatgtaagccatgttctttagttgtttttctgtcacatgtggctgatgggactctgaataacagcacgtcttggataatctggctgggaggaaggagaagtcagaggggaggaaggggtctcttctttcaagatatggatatttggatttttgtgttaatttgaaagcatcttatttgatgctttcgaattacagaacatttccctcaaacacctccaggccctggtttaagtcactaaaatagtttccactcctaagcaaccgcatcaggggtttaatcaaacaatagagcagtgtacgtggatatcaatgcccctcagaacagacggggccggaatgctccttgccgctctaacaggtaggcagggattgctcctcgcttgttaaaatgtacctgtcgattttcctcttgtttcataacaactccattttgtcactctaattttagtggcaatgtttttgttccaatcagcgatcattttggaaaagtaggctgctggaagagctcttggcatacaaaatgacaagcaatttttaaacggcataagacgggtgatttttaaccacacggaattctaaatctgttttgagctggttagcgctccttagaaaataactagctgtccgggagatgtgatgtccactctgctagctctggtgtggcaggcctactgtgtgccaggcacggacacggggaggcatcagacagggtccctgccccaaggagttgcagagtggggacacagatgagagaagtgaaaatggacatgggcgctgggcttttgaactgaaggctggctgtagagatgatgttaggccaagcagctgggagagcctcacctctgccttccagcccagggtcctgcccagccccaggagagggccaggcagcagccagactgacctcattctctgggctcaagatcccagaatgtaagaaagtttggcggtttttcgaaaagttaaacacagagttaccatatgacccaccaattccattcccaggtaggcacacccaaaagaaaaagaaggaaaaacaggtaagcatatccttacatatggacgttcacagccgcaccactcacagatgcagcccgaagggtgggagcaacccaagtgtccctcaacagatgagcacataacgaacatggtccatacacaaaaggaagcactactcagccttgaaaaggagcgacgtaccaccacaacgccacaatgtggacgagccttgagaacatggcactgagtgaaggatgccagtcacaaaggccatgctggaggatttcattgataggaaatgcacaggaaagggaatctgcagtgatgagaagtagattagtggctgccaggggtggggggggcatgaggagtgactgctaatgaatatagggtttctttttggggtgatggaaatgtcctcaaattaaaaagtgacaattcacaactccaggagtatctaaatgccacaggattttgtactttaaaatggttaatgtcaatttcgcctgaatcaaaacacaaaaaccttccagaatggtctgctggggctcagatatgccagtgctccctttccctctgcttcttgcactcagattaccaccaggggtcctctgggtctcccctgcctgactctgcagggatccgtgcagaaaggcggggcagggtgctagaaacaacacccagatcccctttagatccaagctggccactttctagctggggtgggggggctgaggatgttgctgaatttcttggagcctgtttccttctctgtaaagtggcgacagctgcacatcctggggccaggagtggcatcaaagagaaggtgcagcatgcagtgtagatgtgagttccctccctgcctgtctactggggcagaggccatgtctgatggacagggtagttctgccagtggcgatttactgagcaggcctctgcaccagacagtgaagtagtgatggaggaagtcgtggacagggaggataaagtccccagcatcacctgagagataggcaagaatagagctccccaaatcagccaagtaattctggccacaagagtgtcaccacaccaagaaaaggatgaggtgaggaatgtgacccggaggcagttcagggaaggcccttggagtggcggcacagtggggaggtggcctggccctgtggggaagcttgttggcagcagagagagctgggtgcctgcaggagtgagggccggaaggaggggccatctctaaccactttggcatctcaggagtctgtggggcacacaccacagcctgcacccctgagttatttatcttgcaaaggaagggagtagccatttgcaggaggttttccaggcaggtttccctcatcaggagaaacaaggctgggggaagcctcaggccatggggagcctggagatggagggaggaggcgggcagtggtggctgcaggggtgtgagggtgaggccaaggacttggctgctgaggccttggctctggctcctggcttccaaggttctcaccctgcacatgggaagaggggccaggtgggcaccagtggcagtgtcaggtccagagacccactccaggggggtggggaaggcaggtgtctccagctttccccaaaggtgtctgcacaggtggccgaagcttcccaggctttggtctcacatccgcatcttgggtctgccttgtcggggtctgtccacgctaggccaccactcttccccaggtgtaattcgctgagaggctttattccctggaacgcagggcctggcatcctacttgttctagtaagaggttggcggggtgaatgaatgggtgggtgggtggttgagtgaatgactcgcctgagaagttccagttccggtctccttcagcggagcgagtgcagcccatcatcagggcccgtgctcctggcagtaagtagggcagccctgcttcacgcggtggccccagggacggtgcccactgccctcctttgctcgcagacatgtcctcgtttggatgataaatgatgcggtcaccctggcacatagactccttctaggaggatccaggagaaatgccaggagcttcaggaacaacaaataggtcaggtcgccactggggttttctatctgtgccagagctcaaggacagagcatgtccctgaacaacgctggagctgcagggtgacctgagcttgtgctcaacagacgtgatgcatacctggtgcacacggcagggggtggggcaggggggctctctgagccttctgcgagagcacatgaaatggcatgtgcgtgcatgcacatgtacacatgtgtaaatgtgagggtgtacgtgtgctgagcacaagtgaagcatgtgcagcatgtgtgtagtatgtgcataagcacacatgtgcgtgtgttctatgtgggcatgtgtaggcatgtgtgtatgttctatgtgggcatgtgcaggcatgtgtgtctgtgtgcaggcatgcacgtatgtgcacatttgcacgtgtgtaggtgtgtgtgtatgggtatctttcatctgctactcaatgaggtctgtggttgcatgtgtttgtgagagaggcaccagccagcacaccctgggtcctgcaggtgctggaggctgaagggggtgggcatccatcatcttcctccgccatctcctaccctatccctgggccatggaggaaggccttacgtaaccttgtgttgagcatgtaccttcccagtggcccacggacagtgtgacctgggccctctggctccctctgattctggtcgcaaagcagctgaggggaagatgaatacccttctcagctgagtatgtgggtcagataaagctctggtctaggggagaaagttctagtctctgctgccgcccacttgatgtgtgacttggagctcggctgtgtctcctgctctttgcctctggtgtcctcctgggaatcagcaccaccagaccagcctggtctctgatagtaggaatcttgtatacacagcagacttgggaaggcccctgagggtgactggggtcatggccatgggcctgtggtcctcatgcctctgctcatccgcctgggtgggaactttctgtgcccagcactgtagagaccagctgtccagctgtgttaacactgaggcccccagctggcctgaaaatgcccacctggacagaagccactgtgcctggagcggccaatgagccggggtcaccatgtgatggctgggaagttacttaggcccaggggccttctctctaaaacgggtcctcagatgcaattctggccctgtttatccaatggacggctctgggaaagggcttgggcaccttgagaagttgtaaccgtttacaaataaaaagctccacagtgatgatgaaagtgacacccatttcggttctctgagaatcaactggagcatgggcctcctctctccgaggaaaagtaacctttcccccaggttcctgctctgggatcagtccctctccgacacacagagtgctccagaagttaacaggcacagttaatctgtgcacagatctgcaggaccctggtagtcaataagagatccctccttctctccttccctccctcttacttcctttttttttttttttttttttttttttttgacagggtctcactctgtcacccaggttggaatgcagtggtgcaatcttggttcactgcaacctccgcctcccaggctcaagcgatacacccacctcagcctcctgagtagctgggaccacaggcatgtgccatcacacctggctaatttttttgtatttttggtagagatgagttttcatcatgttgcccaggctggtcttgaactcctgagctcaggtgatctacccttctcagcctctgaaagtgctgggattacaggcatgacccacggccttcggcccagagacagtttctataaaagacggcttcttgccatctcagcacaccatcgcgaaggagtgacgggctctttcagagacatggagggccaggcaccttgtgaccacatgcacaagtgaccagcacacagaagtggtgggggcagctgggtccctgggcgcctgacccaggtggggcccatcccagggcagtggcatctggatggagatgcccagtggcagctcatcttcctgcatgaggactgcagtgctggaaccttctgagcacattctcagggttaaaaaggtgaagggagcagctgggctgggtggagtgggtgggtatccatcgggtcggacgatggctccaggggatctggcagtttttggcagttacttcacaggacagaggctctcacccaagccacctggaggaggggcgtggagccgcgctgggggcccagcgagcttctgcctccaccgggaggggtgactctaagctcattccaggagcagctgggctgccggccagcctgccccactgtggccacacacggccactgatggatttaggatttggaggttcataaataatgaacacttcctggagccaaatccccgttcccagttgagctgccaggactccagaatctgcccctggtctgtgccatcaaggtgaggaagccaggaaatcgctactgggcctgggggttttcaccacaaggtgtctttgtttaaaggcagcaaagctctgaggtctaaaaggtgaaggtctctaaggatgaggacggctcaagtcagtggaacccactgtgtaagctgtgagaccccgggcaaaatgacaaagagccccttgtttaaaatgattcagagtctccgggtgctgacagcagaacattacacaagcatggggcccgtgtaacagtgggtacaagcccccctagtttgagaagtgtattggtgtggtgcctcacgcctgaaatcctagcactttgggaggctgaggcaggtggatcacttgaggtcaggagtttgagaccagcctggccaacatggtgaaatcccatctccaagaaaaatacaaaaattagctgggggtggtggcgcgcgcctgtaatcctagctactcgggaggctgaggcaggagaatcgcttgaacccaggaggcagaggttgcagtgagccaagatcacaccactgcactccagcctgggcaatagagcaagactctgtctcaaaaaaaaaaaaaaaagtatattattccatgcctctgaaagagtgaaggacaggccatcctcacatatgcctgattatactgactatatcatgttgaaacattggagaaactatagtttcagaaagggtgagctgacctgtcgcttcctacatgcagccagtgatagagatgcctctggaaggggtcccctctctgcaccagggcaagaaaatggcccttgtcaccagaggctgggcactggaggctgcagtgggcctgagtaaacatacataatggagtagccctcatcttccactgctttacaccacctgtatatgtcctagggactccactagaaaatttactgtcctagccagattttctttgccctgtcgtttcttttcaaatttatcattctttgtcaaaaagtacaaaagcgtcttgcttgggtcacttctctgcatttcgctctcttgcagaagatccccatgtatatgtaaaaccaatacaattggtatgctattcttattaatctgcctgctgtcaatctggtttccagatccagctgaagagcccactaagagctaaatggcagttggaggtgacctctggctcctctaatcccccagtctccgcccatccccagggctgtgggcaggtcttatctttactgagctgccaagagctgaaccagagagaggccttctagaacttgtaggaggagctgggggtgaggcaaccacactactggcctggatgccagtgcaccgctcaagaacagctacaaggtgatgtcttgctgtgcaaagtagctgggcgagcggctcacagggcagcgtcctaaagacaagagcaaagctttgagatgatgaggccgttcctgaagcgttattcacaagagggaaacatgcgaacaactgcagtatcataagtcagaagtggggggaacaggcgacaaatgtcacacatctgtgacaactggaagagccattagcaatggtgctttggaaggatcttttcaattcatgacatctcttttcacttggaaaaatgcagattcataatcatagagaatgagcttaatgttgctgaatatacatttatgctcaaaggactacagcctcagtggtgactatgaacgtgggatagactcaggagtgattttaattttcttccttatacctttctttattttccaaatttgctacaggactagatattacttgtataataaagtattagtttaataagtgaccttctctccaaagaagatgcacaaataaccaataaacacatgaaaagatgcttcacatcattagttattaggggaatgcaaatcaaaaccacaatgatatataggtctaatacccactaagatgcctataacgataacaacaaaccagataataggtgttggcgaagatgatggggaaaactggaacccttcctacactgttgtcgggaatgtaaaatgaagccactgtggaacacagtctagcagtgcctcaaaaggttaaacctacagttcccttgtgacctagcaattccgctcctagatatatacccaagagaagtggaaacaggtgttccaacaaaccatgcacacaaatgttcacagcagccaaaaactggaaacaaccaaagtgtccatcttctaatagaaacaaagtatggtataaccatacaatgaaatacaactcagccataagaagcagtgagattctgatacatgctatggcatgggagaatctcaaaaacactgtcctaactaaaagaagctggtcataaaggaccccacatggatgatcccattacatgaaatggacagaacaggcaaatctagattgagaaagtggagtcatggttgccagggctccggtaaaggggaaatcggggagtgacttttgtttttttttttgagatggagtcttactctgttgcccagcctggagtgcagtggtgccatctcggcttactgcaacttccacctcccaggttcaagcaattctcctgcctccacctcctgagtagctgggactacaggtgcataccaccatacccagctaatttttgtatttttagtagagacaaagtttcatcatgttagccaggctggtctcgaactcctgacctcaggtgatccgcccgccttggcctcccaaagggattacaggagtgagccaccgtgcctggttgggagtgaattctaatgggtacaaaatttcttttggggtgatgcaaatgctctgagattagagagtggtgatgtttgcacaatctcgtgaatatgcaaaaagccacttaatggtgcactttaaaacagtaaattttatggcattgaaattatatatcaatttaagaaaagaaaaaaaggttggtgtcctgtgtgaattccttcggatcacagaataatataaaactaaacaggcgagggttaaccgtcaaaatttgattttaggccaggtgtggtggctcacacctgtcacctcagcactttgcaaggacgaggtaggaggactgcttgaggccaagagtgtaagaccagcctgggcaagacagtgagactgtctctaaaaaataaacattgcttttaggctgggtgtggtgatgcacacctataatccaacactttgggaggctgaagcgaaaggatcacttgagtccaggagtttaaggctgcagtgagctatgattgcaccaccgcactccagtctgggcgacaaaggcaatcctgtctcttaaaaagagaaaaaattggctgggtgtggtggctcaggcctctaatcccagcattttgagaggccgaggcaggcggatcacaaggtcaggagttcaagaccagccttggcaacatggtgaaaccccgtctctactaaaaacataaaaattagctgggggcattggcacgtgtttgtaatcccagctactcgggagggtgaggcaggagaatcgcttgaacctgggaggcggaggttgcagtgagccaagatggtgccattgtactccagcctgggtgacagaatgagactctgtctcaaatgaatgagaaaaaattattttgcagactgctttgattcaattaaccactttgaggtatctggaggttgcgtctgctgaaggtgagtgttgactctagacccacatttgcagatggtgcccaatccaccactcgcggccatgtcctcttggcttcctgttccaggtctcctagaaacacgggttcctccctggacccggtgctcctaagccacacaacctggctgtggacagggggctacagagtgtcatccaagatgctctccttggttacatgatttgtttgagcaggagcctgccctttacacatccactctacatatgcctgtcttaaatttaatctgcaaatgtggaggtttcatcgttaccagcacgcggcccccataagccaatgtttattcataatccccgaatctgtttcccatcgtctatttcagaggagccaaaaacaacatcttcattcaataacagagcaccatatgacagctttcatttcccagaatgagccatggcatgctctggaggttgcagcgggggcaggggtggcctttggcctccatctttgccccagctagaagggggctcccagccctggctgaccagacccagacttggtgtcccagtgccaagcaagagaacgcaggtctgtcctcactaggttcccatctgacagatggcacatcagtgtttccactgcatgtactgggagcagcccattccttccaccttttcagggcatgacaacatcagacttctggaacacccaagaatccaagacactgatggcatgagtgagtgggggcaggtcacccacccctcccatgtggatgtccaagccccaaccccattcctctggctccacaggggtagggctgaggcctgcaaactggacttgggggataggacaggcatgcaaagtctaaggccacagtgcatctgggttggctgaaggtaactgataccttaacactctctaggggccaaagactcgaagacaacctggcctgggatgccagtgatgttgctggtatcgccaagagcctcatgcacgcctcactgccttccctgttgctcacaaactctatggttttaaagacatctcattgggtaatgtaaaggtttacaataggaagggatgcacaacttgaattgtggtgagctgtgtatgaaaggtagagtgagtatctataaacatccccaagcaaagcccatccatccatctacctagtcacccatcctcccacctacccacctaactgggtgggtcttactagattcccacctactcacctatttatccatctactcacccactcagccacccatccattcacccatccatctatcctcccacctgtccatcccttaaccactcatccatccatacattcatccatgcatcaatccacacatccacccacccatccatccacccacccactcacccatcctcccatctacccacctaactattcatttagacatccatccacccattgagatacctactaacccatttatccatctactcagccacccttctgtcctccaacctacccacctacccatccattcatctacccacccacccactcatgcatccatccatccattcacccactcattcactcacccatcctcccccacctacatatgcatttacacatctgcccatccatccacccactcatccatttatccatccactcactcactcatccacccatccatttacccatccacctacccatccattcacccatccatctatcctcccagctacccatccattcatccacttatccatccatccatccactcacccagtcatccatccactcacccacccatgcatctatctatccattcatccatccttctacctacccatccatttatctgtccatccatacacccatccacccacccatgtattcatctacccatccacccactcacccattaatccatctaacctcccactactcttcatccttccaaccctgctagcccattcatccatctgatcacccacccatccatcctcccacctacctatccattcatccatccatccatccatccatccatccatcagaagtactttctcagcccctactccatgccaggcactgtgtgaggtgcagagaatactgatgtgagtcaactgtatcctcctgattcttggctctcatggagggtagtaaaccttgatcaattgaccccacaaacaggcgtttacaaattaattaacctccaggtccttgccttcagtcctcttggcttgcaccatttgcacttattaaatctgctccaacacgaggttcctgatcccagctcatcaaacacatcactgggaaagctgcttaaaaatacagattcccaggtcccaccccagacattcaggtttcatgaggtggagatagagccctggcatccacattacttttctatagtccaggttgagggccataccctaacacatggctgtccagacacacacaacccatgtttcctgggtatctgcagctgaggaaggagaataatgacaggagagctagcttgctcctggtgctttccagtttgaattcattcccctctcatagcagccctgtggcaaacacattactgtcaatgccaacagaggctcagagaagctgagtaacttgcccaaggtcacacaggagacataaatcaggagtcatggactctgatgtttgccttttcaatggaaaagaatccaggtcaaacccccagaacagccctgagactgacctaaagaggcttctaaatgctgatgggccagggtacacccttgtcaagtagcagtctctgccttcggctcacacaacaaaatggccccacagaggatgggattgtgtggtaagaaagggtgaaactgagaagtcatccacagaatgcagcttggtttacagctgtgactctttgcctctgaaatagactaaatgtgtgtgtccccctcaaaactcctatgctgaagccatgaccccctcagtgtgactggatttggagaaaggactttagagaggtaattaagattaaatgaaggtacaaggcagggccttgacccaagaggactggcattcttaagaggaagagagagcagaggtgtgcatgcacaaggaaaggccctgtgaggacacagcgagaaggcggccatctgcaagccaggaagagaagctcaccaggaacttcccctgccagcccctgatctgcagcttctagactccagaattgggaggaaatacatttctgttgtttaagctgcccattctacagtatttcatgatagcagcccaaactgactaatatagactcttccctgcctactgccctccacactggcagcccagtgtagcactaagaaggtttctaaccccgtgaatgtccgggccatgtcactgcccttctctcctgaaccctctgcccacagtggccactgtacaaggtgacttttgcagacaccacatcctgtagcggcaggaggggctgtggagaaaaaaaggacagggttggtacccagcattaccaggttgccatagtaacccagagcaggcaccaccactgctgggaggggacgaggaaggcctgggccccacagcaaagccagagactggatcctcccaaaggaacctgaaataacacacagacctggcagaactctattttgagggtgaacccaagcatggaagctggtccttaaaacacagagcggctgctacgaaacagcagcacatacttcacggcagcgaggctctgagtgtgttttaataaagtggcatacgagacagaaagggtgggggatgcaggagtctgccacggttgtttaacaaaaacataatcattagcagacaggacaatgcgtcctcatagctattttatgttctgtgagggaacagctagtaacttctttggaagctggcttttgtggcttattaatattttagattacaattgtgctaatagagtcatttgcctgtatttttaaatgctctaaagataacaaagacattctattttggaagaaccaaacatgggtatgctgatgttttgccgagggtttatacacactgtgactaacgacacttctgtttaataggactgtaccatgccctgttccatggctccaaccagagccgcccagagatgtgggtgacagctcccacccctttcacatccttgggagggcattcctactccctgagaaagcaggtcacagcaatatcctcctctgatcttcaaggagctgaggcgcttggcgtccctgctgaaggcatatctctaactatggcctgcagaggtcctgcctgccaccccctccttctgctggttccagcaccccaactgtccttggcaagccatcttccctacacccctgacccagacccggccagtcacccttgctggtgcccccaccccctagccagagtgactggttctgggtgggcatggacatcattcaggtcggtcccatcaggactctcgctaagaagctagcacagagccattttctttctgcaggacttggacctataaggacataagccctggagctgccaggcaccatcctgagagggagctgctcaaagaataaagcccccatggagaaatcaggccaagagatggaatgagagctccctggggataccatttgagcagctggatccaactatgcctgatgccagacaattttaggcttctccattgtgtacactaataaattcctttcgtagggacaggggttggagggagccctggggttttgttgcctccaatttaaaaagcaataatgaccagagaagcccttgagttggtacaggggaagggagaggccctgggtcagagtttaaccccagggctccaggccagctctgccatgagccaggcattcgatccccagtaaccagaagcccagatttccttctctgaaaaatagaggcctggctctaaatgagtttttccaaattggagtccagaaactccaagtcatctgaggggcatctcatgtctgtttatttggtgccaacatgtagatgataacctaaatacatgaccctatacttatctttaaagacaaaactgtttttccctggtaatgcatttttttttttttttcagatagagtcttgctctgtcacccaggctggagtgcaatggcacagtctcggctcactgcaacctctacctctgggttcaagcgattctcctgcctcagcctcccgagtagctgggattacagacgcctgccaccatatctggctaattttttgtacttttagtagagacggggattcaccatgttggtcacgctggtctcaaactcctgacctcaggtgatctgcctgcctcgtcctcccaaagtgctgggattacaggccctggctgtaattcacattttcaaagacagaacttctgtttcacaatagtttttttgttttgtgtttttgttgttgttgttttaacgcaggagatttccctcttaacagtgacctacacgttactaagtcagagagattttgaactaagcagtaactatcatcccttccggttctcaccttctctggatggtgtttgtgtcggttctctgtttatgagcccaaggagtgaggggttccattcgtcagctgacccacatgcaaatcctcaggctgaaactcatagggctgtgagaccccggaccggttgccgtgagaccccggaccggttgcatgtaaggagctcacatccttacatgcaaaataggaacgacaatactgaacacacagttcacgattgttctggagattggaggaaaaccatgagaaacgtccggtttgaagccagctgcccaacaggcactggctggtgttggaatcggggtcaggattattgtcaggaccctcagagccccatggtacccactgcctggtgcaaacctctgaagctcccccaacccaggcatctctgagagccttaagttaaggagcctgtctgggaaagggaccattgcttggtcatcctcaaagctgcagggcagagttttccaaacacagtcattcctacacatttatttctaaaagcagcttgcaatttacttacttattatatatatatatatatatatatatttacttatttatttattatactttaagctctagggtacatgtgcacaacgtgcaggtttgttacatatgcatacatgtgccatgttggtgtgctgcacccattaactcgtcatttacattaggtatatctcctaatgctatccttctcccctccccccaccccacaacaggccccagtgtgatgttccaaaggaatataaatcatgctactgtaaagacacatgcacacgtatgtttattgtggcactacccacaatagcaaagacttggaaccaacccaaatgtccaacaatgatagactgggttaagaaaatgtggcacatgtacaccatggaatactatgcagccataaaaaatgatgagctcatgtcctttgtagggacatggatgaagctggaaaccctcattctcagcaaactatcgcaaggacaaaaaaccaaacaccgcatgttctcactcataggtgggaattgaacaatgagaatacttatttatttatttagagacagtccgctctgttgcccaggctggagtgcagtggtgtgatctcggctcactgcaacctctgcctcctgggttcaagtgattctcctgcctcagcctcctgagtagctgggattacaggtgcccgctaccaagcctggctaatttttaatagagacaagattttgccatgttggccaggctggtcttaaattcctgaccccaggtgatcagctcgccttggcctcccaaagtgctgggattacaggcgtgagccaccgcgcccagccttaaagcagttctttaagtcaccattttaagtggaaaaccagcctccctggcatagatggaaggaagccttcacatccaacaagggggaaagcaggctatggggtcccagtcgagctgccctgctgtctgtgggaggcactgggccaggcccgccttctccaagttataaggaggactacagaccacagagctgtgtggaagagtccccagcccccagaaaaaaaaggcaaaccacgctgtgggagcagtcatccgcacacctgcaccactgacaaaggtcttgcttctgaagtatacaaggactgaccacaaatcaatacgaaacagacaagcctgaagaaaaacaggcagaagacccaaactggcgcatggccaaagacgacacacaaacagccacccaatacatgcacagaaaggtgctcggcctcagaagtaataagggaaccgcaaatggcaatcacaaccatatcatcatcgcacacgcagcacgtccgcagcggaagggcccgtcagtagtgagctggtgacacgtgggcaccattactcttacagactaaatgtctgtgaccccctctagaattcacggacccgcaatgtgatggggactttggggtgtgattgggtttagataagtcacgaagctggggtccccaagatgggattcctgccgtcctaagaagagatagcacagtgctcttctctgtctctgtctttctgcggatgaggacacagagagacagaggctgtctgcaagccaggaagagggcccttcccagaaatggccatgctcgcaccctcatctctgactgtccagcctccagaaccagcattttagccctccagatctcagtgttctgttacagaagcctggactgacaatgaggtccaggcaggacagggttgcagaattcagaaaagcagaggacgtgtccagcctgaccacggtcacccctggggtatgggcgatggaagggcacccacgtttacatcgagacacaagggtagggactcccacagcaagcggactacgactgcccacggcgggacagagggacaaatccccagtgaacgacctcacagtgaaaacaagtgacccagatctactcacatggcccagataccagggacagctgttgggagagaagccagcacagcacagcacacgccaatcctgtctccatatggctcacgagtgggcagagtcccacgacactgtctggggctgtgtaataagagcctgggactagtaataaaatcaggaagcaactgtgtgcgagaccagccctgggcagagacagttatcctggggagggagctgaggaggcagagggggcgtctgggtggggttgggggtgctgggtccacagggtttgttttataactgcccactggacgtgcggttgttttgtgaacctctctgtatgcttgttacgcgccacacagaaaaattaaaaataaaagcatcacacaggcaccaaacaggatcctcccatctattcggaaggcccggaagaggaaggagtgaagggggactgctggattctgggtctgacctgcaaggtcatctcccagatgcctgccctgggcacccactgtgtgagccttggaggtgacacagactcagggggtgtgagacacagggcaggggccactggggacaggctggaagtgggaacaagtggctgcctgaaggccccaagggtgtctccggggcaaagccgggatgtttcaggtgctgcaggaagaagccgggcaccctgttcacccagccagggtctcacttggcacaaagaggcctcgggagaatacacagaaacccctgcttttttttttttttgagacagagtctcgttctgtcacccaggctggagtgcagtggcaggatctcagctcactgcaacctccgcctcccaggttcaagtgattattgtgcctcggccccccaagtagctgggactacagggcgtgcgccaccacaccggctagttttttttttttttttttttttttttttttttaagtagcgacggggtttcaccatgttggtgcagtgcagtagtgtgatctcggcccactgcaacctctgcctcctgggttcaggcgattctcgtgcctcagcctctcgagtagctaggattacaggtgtcatgttggccaggctggtctcgaactcctgacctctcaggtgatctgcccacctcagcctcccaaagtgctgggattacaggcgtgagcaactgtgcctggccatagaaaccctgagttctaatccgcatttgccattgaccagcgaggtgatgtccccaggtgttactgtccccctctgtggcatgggctgagctctgtctgcctccctgggagcctgtggctgaggtccagggagatgctgggtggggaagtcaggactcctctggcttccccatctcggtaaatgtcagggcctctgcccagagtccttcagccccggggccagggcccacgctccaaccgccactgctaagagccctcccgctattgggggctgctgtcctgcctcccatccatggacacaggaagccacaggtggtcccctgcaggctgagctgtcagggccagggacacgaggtgccactttcagcttttggtcccaggtcctgagcacaagtggtggcttcccaggagggccatctgcagtgggtctctgggtttccatggggtgtcctgaggcctgtgtgcctgcagctgctaggcccgtaggatgcctccgtccagcacagacctgatttctgggtagcctgtgagcctccgggaggacccaggctatgggcccaatgggcatggccaggaggggacaggagacctgcacaccacacaggacagacccctgggggcgcctgggccccctcctaccctcgtccacacaccatcttacccccagacttgaggaggcatgaggtttgctgctaaaagtgttggggtgacccgagggggaggggccctcactcatcaaagcagatctctgctttaaacctgcattgctccagatgccccccaaagctctcctgtccagggtggtggcccatccccttacctaactctcctctctccaaaagtctcctctctccttttttttgccagctggccctgctccccacaaccccgccaagctccatcacccgctcagtggagcagaggcagcctgccggttgcagggagaggagtctgttcccagtgaatgccactacctctgtctctccagcaccccccaggggctgggcagggcctgtcagtggggtgaagggaggtctctagagggtgttccaggtggccggagctgccgttagtctcaggcttccaggtggtgctggaccctgccacaccttccaggggctcacatgttccaggacagggggtgcagtgacaaagcaagagaggtaacagcggccttgggcatcatcccccatctcgggcaccaggctgcccaaacaaaagccgagattaatttgcaccaggtcgagggagtggacatggggatgctctgtccgcttcagggactctttggtttctaagcaggggctcaaagaggaggggttccactatcagctgagggtggtcgcctgggaccactgatgggctggtgtcctacctgctatgcacagatgggcccgggaccagacctctagcagtgtagaggttcccacactgcagcccaagtctcctctcagggtaagcgggaccgtgccagaatttccaacaaacaccaggagtaactttcaagtggaaacacagctggcacgggcagcacagggcttataaatgacggggcaataaagtggaattatgacctttgcacctgtcctttgcttctgtgcctttctcctctgcagccaccctgggctgtctctggcctggcctccttttacaatggagctgggggtaggacagtctattagaccaagcctcacaaagcagggaagcagatgggcaggggctgggtggaggtgagggcagagcaggagtgacaatgacctgctactgtagccacagtgccctgcatggccagagccttggtggtgctggtgttcccaggtattactatcaggaagcccattccatcagtgctgttggtaacaattcttgtatgcgtatggacttttatacctttacattcttctctgtgagccactgcaacaaccctgcagggcgtgtctatctgcagggcatataaatccaacttacagatgagaaagctgagacatacaagggtaaaataatttttctcaagggcaccaagtgtggtgttgatttctttacatcaagaggggatgtgaggaaagaaatgaaatttcaagaactagaaggggaaagccaggaacctcctccaaacaaagggaaggctgcacagggctgggatgaggaagaatatttgttcatggccagagcagtagcgttcaccaaggtggagtgccagacttgactagcatcatccctttatcatcttaaaacctctgacaccatcaccaccagcatcattgctagtcacatcactaccaccatcaatcaccatgactatcaccatcaatagaatcactaccatcatcaccaacaaaaacagcatcaccactatcatcaccatgaccaccaccaccagcatcaccaccagcatcaccacgaccaccatcaccagcatcaccatcatcaccaagatcaccaccatgagcatcaccatcagcaccatgaccaccaccaccagcatcaccaccatcatcaccatgaccaccaccagcatcaccaccatcaccaagatcaccaccaccagcatcaccaccaccagcatgaccaccaccaacaccagcatcaccaacatcatcaccatgaccaccaccactaggatcaccactatcatcgccgtgaccaccaccaccagcagcatcaccaccatcatcaccatgaccaccaccaccagcatcaccaccatcatcaccatgaccaccatgaccaccaccaccaccagcatcaccaccagcatcaccatgaccaccaccactaggatcaccactatcatcaccgtgaccaccaccaccaccagcatcaccactgtcatcaccaagaccaccaccactaggatcaccactatcatcaccgtgaccaccaccaccagcatcaccaccatcatcaccaagaccaccaccaccagcatcaacaccatcatcaccatgaccatcaccatgaccaccaccaccagcatcactaccatcatcgccatgagcaccaccaccagcatcaccacgatcatcaccatgaccgccaccaacaccaccaccaccataaacagcatcaccatggctgccatcaactacttatcatcattaccaccaccaccaccacccctggtccctgactccaaggccacaaaatcttaacatctcagaggctggctgaccctggggatgctccagcctccaggtaaaggaaacagatgtcagctcagatgtatctatgtttaggtcctgggccggccacccctgcttctgagcaagtcactcaccatctctgacctcgtgtcaaatggactaacatcactgcatgcccccctcccaagtttactctgaggatcacatgagttacctataaacatcaaatgagaggtgagaggatgcaaccacagggacaaggtttggaactgtgtgctctgaaaaggctggaacgataacgttacatggcctgcaggatggcggaacatgacttactccagtgcatacatgatatggctcccgagggagagcaggtggatcccagaagctgacctagtgttgaactgggaggtgtgacagccaagaggacaggtcccccaccagggccattgtggatgaggactttcctcattgtgtcgtcttcttatcaatggccacagacaagaaatctcaaaggacagtggccccaagtcacttgtgacttcagcagcttccctttatccatggtttcactttctgaggttttaatcacccacggtcaactgaagtctgaaaatattgaacagaaaagtccagaaataaacagttgaaaagttttcaattgcatgccattctgagtagcgtgatgtcgagtgccgttccgcccgggggaagtgactcatccctttgtccagcgcactcctgctgtccacaccacccactggttagtcacttaggagctggctctgatatcagaccaaaaacatggtgtatgcagtacagggcagtacagggttcagcgctgtcccccatttcaggcacccaatgggggtcttgggaggtagcccctgaagataacaggggactgctgcagtcacaaaagagttggtaaaaccaagaggtccccatccttctcctgcccagccctgaccccagggttggatttgggaggaggagatttaaactccaagtgtgtcctgaaaccccgacgaggccacacagggtgtcctataggagacaggaggtgacggctccaggtgtggcttcagatgatagaggagcaacgcactgctctcaggtcgatttctgggaggaggaaacacatgccagcctcaccaccaccctgtcgggtccacacgatctgaaggagagatccgagaatgttatgcccattagtccttggggtgtggggctggtggcggtccggagacacttctcagagcaaatggcaatgctaagctgtaagatgctcccagtaagggccccctacgctggtaaattagagagtggctggaaaggagagtccacggcagggattctgaatgggaacagtccatgggaagagagcttgggaatctggacagcctggcacacatgcttcccagacatacacaacacgtgtttccttatgaataagcggggatcataaaggcacctcccattaagggcaattacgaggctcaaatgaggtcctgtctcttctccattgagtgccacaaaaaagtagaaaagacacactgcaaaccacatctgtttcctggtcagagctctgactttctgatctagatcctatgcttatggctagcttctagaaacttctagagagccatggggcctattcttaaatgcagacttaccccacaagagtggccagtcaagggaaggcacggctaatcccatcctacactcacaccttctacccagtcgagacccctgcaccagggagtcagccagaagattccggaagcccattctgcagagaatcccatcaagtcacttcctcggtggtctctgcagctgattgaggatcccgactccaacaggctctggtggtgcatacggcacaggacatgccaaaactacactgggtaggtgctgctcatctgggtaggtgcccaggagtgaagtaggagttgagaatgtggcatcttatgccccagtctgagctgcctggctgtgaggcccccactcctacctcagtggctttcaggtgaccagatcctacctgtctctggaggatggaaacagggatgtacagcggtgactcatcacacccattttctcatcatgttctacatgaatggtgctcactgatagtcaagtcttttgtttgtttcagcaactaaaatacgatttgctctggtgctgcttggccttgtcattttctcagggataaacagagagccctggcctgacagtttccatgtacacataagatgtgtcgctgaaaactgcacacacgtgcattgcattcatttttcataaactgcctcatccatgggtgccaactgattacttcggaaatattttatctttgtttcttagtcaagatacatcaacaggggcacccctgatttcaatgtgtagaattctgaggaggaaggatcaagtgattctacaatccaccagcctgaattcacagatgaggaaattgatgtcttggaagatgcggaaggcagtcaagtccccagtaggggaggtgggcactgtctctccacccagggtgcatgtccacccagggcactgtctctccacccagggtgcataaagagggtcagctttatgggccaacggaccaggctatagcacccagttatgcagccaagcactagcctaggtgttgctgggagggtattttgtagatgtggttaacatttacagtctgttggcttgaagtcaacatttttctcagtaatgtgggtgggcctcctccaatcatttaaaaggcctcaagagcaaaattgaggtttctttgaggaagaagagattctgcatcaagtttgcagcaccagctcctgtctgggcgttccaggctgctggactgcccagaggattttagacttgcctgttcccatgatcgggtgagccaagtccttgaaatgagtctcttaatacatacgctctatctgtatctacatctgtgtctacgtcctactggttctgtttctctggagaatcttgactcaaacagtcaccaggaggtggctcctggcccgggaccacaggtcccagcatctgcagcatccaggttccctccacagggtgtcacgggcgatgatgtgtgtccctgatgtgccagagcctcacacaagagggcagcgtttctccattctctctccccgtctctgcaggctgggggcaggggaccctaaggtcctcgaggatgaccaggccacagaatggaagggcctggactgcttggtcacatcatggagaaaatcagcccgtctgctgaccagaagagaccacactgggtggctactgggcaggaaaaaaacctgcactccattaagccactgaagttgtgggttcacttgtcgtagcagctgacattgagctacctaatacaaatgggtggaaagctttagagtcttgacaaaagccagaccttccaactcctaactgatcaagtgcaacaccacccaacctccttttcacaaacgcggtgggccaactgacatgcactctgtcctggataggcaccatgcagggcacaggtgtccctgccctcagagagcctaaactccagcaggatggggtgaggacatgcatgtaattaagcaccaattttctagagcaccatcttccaagatgcatctcctcttgcatataataacaacatagtcatatgtggcacttagctctcaggtctctgggctgatgcatgcaaagaagtgagattttataaatctgggcatgcctctgtctcttacgcacagaaacaaaaaagctatgatcataaacttccacccaactcttcatacgcatcatctccaggcttcacatttcagataaagaagtctactcagagctagccagagacagctgagctgagaatagacccggatatgtttctgtttccccattgcctcaggtggatgtgcaggaggattaatcactggcagtcacaccaggatcaccaccctgatcactgcatgagaaacactgtcctgatgcaggtacaggtcacagctcaagcatcagtagttacaaataatgggtcatagtccctgcccagtaactccctatctgtgtgctccgacatgctgagatggggatgctcatgtgtacaatgcaggtgatgattcctgccctacttattccagaaggttggatgagacagcatgcaggaaagcccactggagactgtgaagtcccataaacatgcagccttaagaaattacaactaaggctcaggtgagtaagcccactatatcttgaaggcataactaccaaactattcatggaactaagctgaacttgtatcatttgaccaaccatccatccaaccaacaaaccaatcagccagccagctaaccaaccaaccaaccaaccaaccaactaaccaatcagtcagtcagccaactagttaatcaaccaaccaaccagtcagccagacagctaatcaaccaaccaaccaaccaaccaactaatcagtcagctagacagctaatcaaccaaccaaccaaccagccagctagccagccagccagccaagcaatcaatcaaccaaccaaccaaccaaccaaccaaccaaccaaccaaccaaccaaccagcaagccagctagctaattaaccaaccaaccaaccaaccagccaaccagccaaccaaccaaccaaccaaccaaccaaccaaccaaccaaccaaccaaccaacgaggaccaccatttgattttgctgtttgttatccccaacctccagcaactgtcatgaggctatgagaattcactgggtcctgagcagccacttctttactgagttattcattctgtgagtcactcacttatttcatttaatgttcatgaatggagtttaccaactaaatgttcattttacaacataaagcaatggtgctccataaaagagaaacagcttccaagggtgcaagcaaggtctactgtgtagaaagagcttggtggatgggaacatctaaaaacattttgtaccatcttccagattctatgtatatccaaagtcttctaattttcagcatcaaaaaaagctacaaaaagggccaggcatggtggctcacacctacaatcccagtattttgggagaccgaggcaggagggtcacttgtgcctaggagttcaagaacagcctgggcaacatagtgagaactcgtctctacaaaaaaatacactaataaaataaattttaaaataaggcaggagaatcatttgagactgggaagtcaaggcatgtaatgagccctgatggcaccactgcattcccacctcgatgacacagcaagaccctgactcaaaagaaaaaagtgacaaaaagcactaacgtggaagaaaaaaagaataatttggattagattcaaaattttaaaaacccttctactcattaaaagacatacagttgacccttgaacaacatgggtttgaactgcatgggtcaacttacatgtggatttttcaactaaatatagattgaaaacacaatattcgtgtgaaataaaacctgcatatacagagggctgacttcacatacacaggttccatggagatgactgtgggacttgaggtggattttggtatatgatgtgaggtggtggtgtcctggaaccaatccccacgtatactgagagatgactgtagttagaaaatgaaaacgcaagtcacaggctgggaaaaatgtttgcagcatatatttgacaaaggactgataaacagaatatataaagaactcctacaaaccaataaggaaaagatgaacactgccattaaaaatgaaccaaagacttaaagaagctatacatacagcaaatgagcacacaaagagatgcctaatcatcatccccagaaaaatgcaaattacacccacaataagatatcatttcatatctattagaacagctgaagttaaacagactgatattgccaaatgttgatgagaaagtggagcaactggaactctcacacactgccggtaggagaacaaaatgggacagcactttggagaactgtgtggtagtttcttataaaatgaaaatgttatcatacaacccagcagttttctacctagagaaataaaaatgtatgtccttaaaaagactcacacaaaaaccttttttagcaggttcattcatattagccaaaactgagaagcaatccacatgtccatcatcaggagaatgatcaaactgtggtgtaaatacaccataaaacactagccagcaataaacatttataaactgctgtctgggcatggtggatcatgcctgtaatcccagcattttgggaggtcaaggcaggtggatcccttgaggtcaggagttcaaaaccagtctggcaaacatggtgaaatcccctccttactaaaaatacaaaaatcagccaggtgtggtggtgggagcctgtaatcccagctactagggaggctgaggcatgagaatcacttgaactctggagtgggagtttgcagtgagctgagatggtgccactgcactccagtctgggcaacagagactccgtctcagaaaaaaaaaaaaaaacaacatataaaccactgagtcctgcaatacatagctgatatcacaggcattaggctgagggaaagaagttgggcccgagagtacaagttgcagggtctcatctacatgaaatccagtgataggcaaaatctatggtgacagaaatctatggtctatggtgacagaaatcagaaccacacttgcttccggtgtgggatggggagggatggctggaagacagcctgagatcacttcctggggtgaaagaaaggtgtttttaaaaattattttatatattttttgagatggagttttgctcttgtcacccaggctggagtgcaatggtgcgaccttggctcactgcaacctccacctcccaggttcaagtgattcttatgcctcggcctcccaagtagctgggattacaggcatcaccatcatgcccagctaatttttgtattttcagtagagacaggtttcaccatgttggccaggatggtctcaaactcctaacctcaagtgattcacccgccttggcctcccaaggtgcaaagattacaggcatgagccaccacacctggcctgtgaaggaagggtttaatatcttatttgcagttggagacgtgggtatatacatttgtcaaaatgcactgaactagatttttcttataatctgtgtgttttcctgtatgtaaatcacacctctataaaagaagataatacaaaagaaggtgctaagtcacgatcttagaacacccaagggcaagcagaacccagcaggaaccactgtggaatcctccccgccctcctcgactcctctgtgctgtgatcttggtgtacctccttccatcccaggtcacagagatgccttccttccctgacccacagcctttgtgttagaggagagttctgatgttcatttttgccatctgtgttagggagaaagatggctcctccctaggatgcccaggtcctaatccctagaacctgtgaatatgctcccttaaggcaaaagggaattaaggttgcaggcagaattaaggcggcccatcagtttacttgacctggattagcaaggtgggcccatctaatcacatgggttcttttcttttcttttttcttttctttctttttcttttttttttttttttgagatggagtcttgctatgttgcccaggctggagtgcagtggtgcaatctcagctcactgcaacctccgcctcccaggttcaagcaattttcctgcctcagcctcccgaggagctgggactacaggtgcatggcaccatgtccggctaatttttgcatttttagtacagacagggtttcaccatgttggccaggctggtctcgaactcctaaactcaagagatctgcccacctcagtctcccaaagtgctgggattacaggtgtgagtcactgcacctggccataatcacacaggttcttaaaagtggaagaagaggaggcagaagggagggttggagagatgcaatggaagaaggaccctaccaacaggtgctggctttggagacggaggaaggggccatgagccaaggatgtcggaaaggcaaggaaacaaattctcccccacagattgcagaaaggaatgcagccctgctgatgccctgactttagccaagtgagactcacacccgcatcagcccaggtagaaaatacggttttatcaaggacattgtcctgggagtgtgagctggagcaagatcacccttctagaaacctctgtcttaccccttaaataacctcctcccacagtaaacacaaacacaaaccaccgcccctctggaagctgcctgcacaggatgtacattttctggcagactccacctcgcccacctgccctgggtggggaccctgtcaacggggctagagaaagccatacgttctcatctagggcacacagggtgatgctggcaggtggacgggaaaagcccacaggagagaggaggaagacaggttgctccagctgccctgcttcctcctgcacactatcctggaagccgctactctctggaggatggagagagcaggaagctcaaatgatccccctacgcagcagccctccaggactgccccatccaggtgtggcatagccaacaaagcccggtgctggcacagttgagtccttccaacaaaagagtagagggagggcagccagtgtggctctgaaggtgagtgccaggagagggaggagtggtggctgctcaggaagaggaggactggaggacagggagaaggaaggcattgagcaaccctgggaggcaagctgagctccagggcctggcccttctcagacaagtgaggcaggggaaggttgcttgcaggagagggtgggtgtggaccaggggtggacgggcaatggcagggcttggaggtctggcctgtgccagtgctcagtgtgattgctgcccagtgtaaatcccgtgtggtctacctggttcaactctgcttatcttgaggcaacaggatgcctgaggtcagaagctccccctggtgaccaaaaaggctaagactagtgggatccaagatggcagctcacttggcttctgaagaacctctaacctcattacagtctgatttccatgctaaatgaccctccccccagcaccaggatagttgacaatcaccatgacaacaacagaaagaaaccgtaaaaggacagaaaggaaggcggcacaccggttctgagaagctctctgcccatttccagaaaagacatgaatattcctccccttgatttaatgcccaatccctttattacagaggccccagctctgtgacttcccagccctcgggagctgataaatggatctgtgagccaagctcccgcttctcggttccatggccaacaaataaagcctgtgctgcttgaagctcacttttgcttttggatactggctgtgtagcacacaacagagaaagaccccattcttgggaagaccagctttgttggtaacattgtcatcgccacatccagaaaaacacactccctcccacccagccttccgagtggagcacattcccagcttctccttcatagttaagtttgggacatgtcttaactcaataccccacaataccgtctggtgtctaagcctgagcagggactcatcagcagggaagctgatgcacgaactgagtccccgttgaagccaagatctcagacagaaaacctactgagcctccctgctagagactgcaaagccagccaggtccaggacagactcctccttgctttccagaacacacgtttgtagggcctggctggccctggcagatctgatcaggcggcagagggctacctagtgagcccacagactaggaacctcaaaaacagggcaatgggcccgtttggacagagctcagaggcggcaggctccgcacaagaaggcgtgcatggttggtggccgcagcgtccgtggccacttgacacgtgttctgtgagcctgggattctactaaaagccagatgccgttcacatgcggactgctttcttcttataagacacttaaggcttcacttttcctccactctcatacacacacacacacacacacacacacacacacacacactcggtaccattttatataagtggtctcctcttcacattttaatcagttcaatctctcggcaatcaattttgaaacgattttcagcaagtgctatatctggaggttctaagagagatgctggaatggcttcccgtcggaacactgaactctttcgagcagtttttacggaggcgtttgctacgtgttctcagggcggcacaggagcatctcgcctgcacatgggaagctgcctgttttatgccatcgatagaagagatcgaaaaagaaatctaatcaacccccaaaagtctctctctgatggctagaacatacggtccaggttttctgggacgtgtactgagcagccttttaactaaaagcttccacaccatcttgtaaggaatttctggtttggatgaagcccagaggaatgaaagcaaccaacctgtttccaaagatctagaaagtcctgaattcgcaactcagcctccctctacgacgcaacggccgaatcttgccacggacaacaccgaccacgggcctgagataggcctgcaggatcgagggtgggcggccacgagcgctcgccttacctgcctggctgtccctgggcttacactggacctcctccacgcactccgccggaaaccatccgatgtggccgcgggcgctgccttcccagaagcccccttcaccgatgctcagaactagagacgacaaaaagggagaggtgttagcaggggggacgtggagggcctgaggttgaacaagacgagtggggctgggcagaggcaggagaatcagcgcacccctggccaggcctgcagagcaagcggctctggtgtgactgcacttccttcagctgctgacagtgctaagaggcaccggggcatcaccactgcagaccacaggtgccctgtgccccttaggtgatgagacaggaatgaagcactgacatgtttgcatctttacgtatctgacaccacgtcatatgaatggatgtgcacggcggccctgtagcatctctcagtgttgcacatgagacaggacagtggtgcttggctgtccttaccatcaatgatttcagatataaaagtggagtcggggggcaccgccacaaagcagggaggaaatgatgaggtcgtaccttcccctcctaagctgggcaagaaccggaggcagatggcctggaggaaagaaaatccacctgcccggctctgtctggatcttctaaacaagcgtgcggaaggagaaatcacagcagaggtctgggcgcggtggctcatgcctgtaatcccagcactttggggggccgaggggagtggaccctctgaggtcaggagttcaagaccagcctggccaacatagccaaaccgcgtctctactaaaaatacaaaaattagctgggcatggtggcccatgcctgtaatctcagctactcgctcaggaggctgaggcaggagaatcacttgaacccggaagatggaagttgcagtgagccaagattgtgccactgcactcacagcctgggtgacagagtgagactccatctcaaaaaaaaaagaaagaaaaagaaatcacagcagaggatgggcgagcagctcacgaatcatctgacaatggtgtggacgtggaattatcttcacttaaaatggaagaaactgcactaaaaacctcacacagtcagcaccagccccttggaggcctggcccacaggcatgctggcttattaatcaggaacctattcattacgtggttgctggcaaggactgcagttttctttctgacttgtggttgaaagaagccaattccccaggagagaagggatggtggccacacagtgaccctgtcctggggaccacgcacatcactggacagacacggccaccccagcctacagggtggaagttgctgagtccagacacaggcatccctccccagcccatgtactgggtacacagtaggccctcaatgaacatccgctggaagaataaagcatgtttgtttttaaactcaactgctgagcatgggtgagggacataagcccaaagacaccatggggtgggggcaaggtcaggaggaccccgccggtccccatggccctactgtgataactatttctgtcataaagcttgcagtggcaaagtgaggaaggaaaatctttatatcttagggttttttttttgttttttgttttttttagaggctttgtcacccaggctgaagtgcagtggtgtcatcacagcgcactgcagccttgactcccaggcttaagtgatcctcccacctcagcctcctgagtagctgggatgacaggcgtgtaccacgacacctcattattattataattactttttttagagacagggtctcactatgttgcccaggctggtttcaaaaccctaagctcaagcaatcacctgcctccacctcccaaagtggttcggatgactggcgtgagccactgcgccggtctgtatcttacttaggactttggtgctgggccagggatgccctcaacaccttcactccctcctaatgtgtctaagcaaggaggaaaacaatctgatttctccacatctttaccttcttttaaattactcaggatccaaaggcaacagccctgctgaaagaggaattatggccccataagtgttttcctctagccctcatttgaatctcaaaggccagacagagaaccactcagcccacgatttttgaaggttaatggaactgaaaaccccactttataagttcctaataacctgaagaaatgacctaactgaaacagatcagccacatcccaggtgaccaggacaatcatcactgcctgaagcatctcctccaaaactcgatgcagggcctgtgggctcctctcagcccagctggccgggatgtgcctcacagtttcccagcagaaccctggacctgagagggtcatctcagagcagtaaccccgggctgcaaagggaggccaaggacttgctgctgcgccaccaggagccagtgcccacagatacccacactctccttccttcacggctgtgaggtcattctgctgttttatatgggcctggggagaagggaactgcataggtagagattggtatcatcttccatggaagctctgccctatcttagctatgtgatgcttgggaaaactcggtctctctgtacctcggtttcctcatttatcagagcatgacaatactatctagctcataagtgtttctatgcgtgaatcggaggcacgtgagcccagtgtggaatgaggactcaacactcctgcctgactttccttccaaactcccctctccaggagaatcacaccttttagttccatatttaatctctatgaagtatgcacttcaggatgtgttattgttattacaagaccaaccaaaaatatgaaaggctgtttccaatgggcttgtacaaggaggcagaggtgacgtgctgcaaggggtccccccaacacggggagccttcatgtcaggggcgtaaaaagagcaggacgtgtgccgagggtgcaggggaatggaggagggggccccttctgggtttctggttgtgcaaatggtacctgctggtcctcttcagagaatggggagcaagagaggggtttgtgccttgagtgcctccctgacagaacatctgcgtccaggtaggaatgagtgttcctcatatggtgaggaaggggctgggcttggctaccccattgtttgctgatgcaattcattcaaaagtaaagactccacaccctgggtaagaagaggtggaggagaagaggaagtccccatccacccagcagtacaagagcgagcactgggctgggaggtgagagacttggccccatcactgggatgctgagggatcccggggactcctgttctctctgtggccccacctactccatgtggaacactagggtgaattctgagagtgaattctgaccaggcaaccaggggaattctggagtctggagtcctgccttgctcttgggtgctctggctagaaaaattgtcaaggaccctgtccctggagccccagacttgcaggggaatacggtgtgataggactgactctaccacagaggatcagatgagaatcgtcccagccaaaccgaggggcaggaggaagactacggaagcacagagggggtgcggcgagacttggggcaaccctgcaggaagaggcagtgctttgaatggtgggtagagagcaggtgaaggcactgcacccagggcatgaggaccgggagaggggcacatacggcacggctgggggccctgggaaacctggctagaaagaaggttcatcctcaacaccatgtctgctccaacacagacgatgctttaaggcacctatgaaaaccaactgcggatctctctatgggccccacatgcttcctgaggccacagtggggataagcttgttggagaagggccagctctgctgtcctcactatggccaccacagtgggccgctccctgcctcagcagctctcttgcaaactggaaagcagcggtgattccctgtactggatgggtcaggggtggctccgaccccgctgctacactccaccttctcccccttgaccccagcctgggtacagaaacctgccaggtcactgcggaggagggaggaaccgagacccagtgtttctcctgttctgtacccaacatgctggtttctaatgtacctctaggccatcttcaatttcaaaccatgcatggtgttcttgaatccacatatccttctgcttaaattgacacaggacttacttgggtcaaggactgtgctggtgtctggggtcacaaagatggtgcaggatttggggcagacacctggaggagcttcagaaaaggaggatggccttactgtccacctacctaatgtcacagagcaaaaacgctggcgccccctgtgcccccaccccccagcattggcaatgctatgtcatgggcttagttttttgcttgccagaatgggggcttgcagtaagcagggtcaatcatcactgcttccctaggcctcacccatggccacgaaccctcaggggttcactgtgtgtctgttaaataaatgaacccctaaaatgaccacgctcactgtgctacgtgctgcatcagaggcctgtgtggcctgggccaaaaagtagagagggagcgtggcaggtgggggcgaggacactcccagaggaagggacatggcagccgaatcctgaaggaggagctgatgggaagacacagggatagctgctgtttgggcagaggaaaagcaggatggaagcatggtggtgagagcgtgggacaaaacacacactgctatttagaaaactctgtcattctttcacgctgccatgcactcactcactcaccacctatccaactacccacctatccactcattcacccacctatcaaactcaaccgcacatccatccatccatccatccatcttccagcctacccatccatccatctacccatccatccatttacctatccatccatccatccacccacccacccagccatccagccatttcatccatccatcatctatcccattccaagcactgtgtcacatgcttgggaaacaaacaagaagaagacaaagtcctgcctgcagagggtctacaatccgtcacagtcaggaatgctgcaaaatcacctgaggagcttgttaactattcagattcccaggctgtgtccttggagacacaattctgcagatgtagggatggatggccaggagatctgcacatttaacaaactcctctcatgtctcagatgcagggacttcgggaagagaggctgagaaactgcactcaggtacacagcttggacaggagcctctggctcaggagcctgatgctggatctcgcataaagaactatcgggagtggagggaagaatgtgccaggcacagtgaaggacaaagaagagcccttgaattaaaaaaaaaaaaaaaaggagcgtcagtgggggaatcggaacatgtacacacctatttttgggcaccccttattttagaagaaaaatgttggggtatgttttcccaggtacatggtatgcaactgtctactgggaacgtcaaccccttcccaaatgggaccgagcggaggagatgtaaattaaccttctgaaagagccaggagcagcagtgttatcagcaggaccccagggccaccctggggcccgtcacagccaccctgcctgcctgctgcccagacccgacttccactgcaaaaaatgagtttggtttctctggaaaccctcccagacctgcccctgccagccaggcagctgggtttcctgcccacaatgattgttcccttgatatcaaggggacagaattcctccaaacggccttggctctgcaggcagtggatcggctcgacccgcccgcctctaagcactgccatgcaggcagcaaggatgtgcgggccaccccacgatggggaggaggcaccgacagctcggcaggaaggaagagcggtgccactggcagcaggaaggggctccgtgccaattgtgtgcaaatggcctgcgcggcccactcgaatctcttttcagaacagcagtcctttgccatcgatcctttgaagtgtgagttttggaaccgagctctgtcatttctgttctccctgggagaaaggcccagctccccgcacgccccacgctcctgcgaggggcgggttccagtctggtcatgtttgaggaggtgctgctgggttccagtgtgctggggaggggcagagaggctgaggaggcccagtcctggggcctggataggagtcacgtgacctcccttctttcctttgttgaatcattctatcaaacccagggagttggacaggggaaggcccccccagagcttctgggaattaaggtgtgagatgtggattcgcctgccatgtcccaggacccctgcgagtcctgggtcctcaagtctgcctaccactgccagcctgtgggagactcggatccactgatggggctcatcaccggctccccctctcccttgagctcctgctcatccatgctgctactcagggtcccctctaagggactctcagctgtttagtgcccactcccatgggcctctgctctatgtctaagggactggggacatgtgccaagttcacagcatgggagcctgtctgcagctctgcccctctcggagcatgggtcagtatgcctgagtgagtccacagatgcccagccccaggctctaggttcatcttcacaggcctctctgcccctttggaagtccaggactaacctggctgccctacaggaactgccagccgcaccccagccttctccttgggcatcagtgagctccaaagcaggactcacagaggagcagctcccaccctccgacccctgagccccaggcttctcctctttacaatagggacaggcctggacaagaagaccgtgtgtcccttcctgctctggagagacagtgagcttccttggctcccacttgggcctagggggtggccctgagtgtgcagaccggtcagaaaacactctctaactaggaacttcagctctcacttcctagaacggggttgctaacaaggccggcatcggccctgatccctgcacagatggcccctcttgctcccccactgcggggccttaacatccttgtcacccgacatctcagggctggcctcagtggggaggagggaaggtggctctcagcactagtcctcagagagacagccaagttgatggggtaagtgtgaaggattttaaagtggcaattacaccaacctacagtgttgtaaaaacaaaacaaaaaactaagtttttaatgaacaaaaaaatctcaacaaggtaataggagatcttggcaaataaaaggcaacaataaaaacagataaacagaaaagctagcaaacatgatttatgaaattataaaactcaaaagacggacttaacagctacagggacatttcaaaggaaagggtaagtgaacttaaacaataaccaatagaaatgatctaatgtaaagaaaaatgactgaaaaaaatgaatagagctccagggacttgtttgatgctatcaaatgatgaaatatgtgtgcagcagaaacactggccatcaggcaagagggcggggctctgccatcattagaatgttgcagtaacccaggtcaagctgacctgatcagtgtgtcgcgcagagaaaggaactgagtcaattacctgctgggggccaggaggcagccagctggggaaggcgggatttgaaccgggcctactgacctctaagggccgcaccttccacccatgccactccaatggcaacctgccctccaatggcaaggccctccaatggcagggcccggcatgctgccctccaatggcggggcccgggcatgctggccacgtgtgctaggcctttcttgctccacccagtgagttcctaccaccccacacaacctccgcagcccacacctgccatgttgcttctgctgtgtgcctcagatgacaccactgccaacttccctccaaccctacttttatcttcctgcagtgcttcacacacctgacttccccctgggcagaaaccatcactggctccccaataccccaggaacaatgtctaaccccttcttgacctggtgttgacaatggcccccccagaggcttctcaacgctggttctcaggattctgctttgagaatctttccttccaacctggtagaattccttcctttgaacactgcaggccccgggcctcaggtcacaccggaccatctacctggagaccccaaagccgacccatgccagggcccaccccgacacttcagacttaggggatggaaaggagctctgctcttcgatgccctcatctggctcccccactgcccttctcaagtggaatctcattcccagtggacgtgtccccttcgatccctgagacccagcactggggaagccgcagcagctccctggagagtgagggaaagggtctgggaacgtcactctgttccccattcctgcccttccaggggcccgtgttttccatggagaagcacagccttggacatcgtccccacagcaggccgggtgaagggccccagcctgacctcactccaggagcggaggacaaccagcagacactgacctttgaccctgtcaccgcggtgaagggggatctcgccgtccacttggggttggtatggcttgacagcgacgaagagcctcccgggcacggcactgtagagcttccgcttgggccccgggtactcgaaggccgagagtgagtccttgttggcaccaagagcaaaaggcgacctggaccaggtgagaggggcagagagagagagagcagagtcacaaggtcacaagccacatgccacaaaccacagccaagccattcaacgcatgctgcgcctcggctggccgcatcagaactcctgatgccagacaggaagatgggaacaggccggggcagcactgtggtcagaggctcaggcagatccaacaatcccactcgcaggtctgccccgcacagacagaaagctgccactcggggagacgtctgcacacctgcgttcacagtggcaccgttcacagcagcccaagggtccctccacagaatggagagacacagggtggtccaaacatacaatggaacgctgtttagcctccatcaggaattaaactctgggccaggcgtggtgggatcacatctgtaatcccagcactttgggaggctgaggtgggcagaccacctgagatcacgagttcgggaccagcacggccaacatggtgaaacctcgttggtactaaaaattcaaaaaatagcagggtgtggtggtgagcacctgtaatccgggctactggagaggctgaggcaggagaattgcttaaacctgggaggcggaggttgcggtgagccaagactgcaccattgcactccagcctgggtgacagagtgagactctgtctccaaaaaaaaaaagtaaactgtgacacaggctacaccatgggtgaaccttggggacactgctcagtgagatacaccagacacaaaagaacacagactgtgtgatcccagccatgcgagggcccgagagcagtcagattcatggacacagaaagtagaatggcgggtgccgggggctggtggagagaatggggagtgagggttcaatggggacagagttttggtttcacaagatgagaaggttctggagatggatggtggtgatggctgcacagcactcgaatgtattccactgaacgccactgaactgtgcacttcaaaatggttctaaggtgataaatttgatgttacacctatttctccactattttacttcattttatttatttatttgagacaaagtctccctctgtcacccacgcgggactgcagtggcatgatctcggctcactgcaacctctgcctcccaggttcaagcgattctcctgcctcagcctcctgagtacctgggattacaggtgcccgccaccatgcctggctactttttgtatttttagtagagatgcggtttcaccatgttcaccaggatggtctcaaagttctggcctcaaatgatccacctgcctcggcctcccaaagtgctgaagttacaggtgtgagacaccgcacctggcctattttgccactattttaaaaaagactagcctgggcaacatgatgaaaccctatttctacaaaaaaaaaaaaaaaaaaaaaaaattggccaggcatggtgctgtgcatttgtggttctcgctccttgggaggctcaggtgggaggattgcttgtggccaggaggtcgcggctgcagtgagccatgattgtgccactgcactccagcctgggtgacagagtgagatcctgtctcaaaaaaacaaaaacaaacaaatcccaaagagactcaggtggagacagaaatccaggaaggccatgggtgtccgacacttcatccacctcactgtgagcgtcagtcacactggacgaggaagcacccagggccttccatcaaaatgggtcacgacctcggttctcccagtgcagttcccagcggccccagcgaaccacgctagaggaactcatatccgttcttgctgtatgtcattgattttgcacagagctatgttttcaacctgacttctacacccgacagtaagacacaccttaacagggcccagagacaggacacgcaacacaaagtactctgagatgcacctacacagtgccaggacgggcgtccttagaaacaaacgcatctacacggaggaagttggccagaaattcaggacggccctcccgggcacatgctcagaaagacagggaaagtgtccacctgcggctggcatcctccaacagggcgcctggctgcagggaagcgagtggtctctgaccatggttcccctcccaaactttaggtgctgtggcctctgaggcgatggaggcagcatcagtctttctatgaggacagggaggaagggcccatgcacacagggacccatgcaaaacaggcttgcagggaaagttctagaagcggatgtgactaccctcttttggcatttaacataagcctccccctgatcacctgccttcactactgtaatcacccgactcatgtgtccctgataattgccttatagtttgctctgtgcttgtataaagttacagaagggcaatggggctgtatttagttctgattcttactccttctctcagcattaggatggtgagatctggccatggggaccttacccatgtcaacgtgtttgaggagccagggctccatgtactccgattactctgtagggagcagattgggcctgaatactcagtctgtctgcctgactccaaatctcagatttgtcctgaaaccatggggagcagagacagggcaggacagtggcctcttctggaacaggtgggcgtcttggatgcttacctgggctctgaggacattgagagatgggggaggctgcaagcagctaggacttccctgtcccctgtccctagggatgccattcctcccccaagtcacagccacaaatgtggcagtcacagactcctgggggcacaggtgtctctgagctgtcactgccatgcagcctgggcacaatatggagcccaccgggcacggtgtggcacagcagtgcatcgatgtgcacagccaggagaattccaaaggaccactgttccccatcgatggacatcatctatccccaaacaccccaggagttcctggagcaggaactcctgcaaaagctaggtttggtggcctcctcttgtccaaaggcatagctcagtgagccaccagggagcagagggaaaggacactgggcacttcctgctctgcaaggggagctgatgaacgcaacagcagcgctgggccaggcccccacctgagaggcttccctgccagcctgcccagccatctgcacgtgtaccagcactcagacacattcaactcagcctgactcaggcagggctggactggcacaggaccgagagctgggaggggtgggagcctgtaccgcaggcactgagcgtctcacggctgtctcctctctggctcccaggccagcagggatgcggggaggagaatcccggcaaccaagggactccaaggagaatacagcaccccagggtcagaatccctcctctccttgaacttcccttaatgcacctgcccacatctgccccgagtgatgaagccagcaaggctggcggccatcatgggctctgtggacggcctgaacctcccgtcactcccaggctgacctgccccagctgtgtgaccttcagtgagtcactttacctctctgagccttaattttcttatttgtaaaataggtggtagagggtgggggtagggcgaatccccaccacctgtggttgctgggagactaatgagaaaatgcagatgagaagctcagttcccagccccgctgcagctccgagggcagtcactgtctctgcattgaccattatccaggctggaccggcagcagccagaacacagggctatgccgacatcatctcaaccccctctcctggccggtgatgcgacatgggcgattggaggagctggatgcattaggccccatcaggactgaaggttagtcctagtgatgaggtcacaggtggccccagtgtcccctgggctgcatggatgctcttcagcaggtggagtggctgcaggtcaggtcagcccagccccatgatcagtccccaagcacccggataggttgactccagggggagcaaggtgaggcttgtgggcttcctcccgaggggaaagggtgggtcaaagtctagaggaaaaatcagatgaacaaggctgacagtagctggggcagggcagagggtgagccacagagcaggagtcacagggtctgttcacaactgttatgtgtctgacacagcagctgcttaagtccagaacttaggaaccaaatgaggagtgcgtcttctcaggatttccacacccaaagagctcctgcaaggaaccccacggccccactgtgcatcctcaacagcagccggcaagggacactgagcctgccctgcttgagaagtcagttaacttcatcagaattaatccatccactcatctcttctttgttatccatccaggcctccttgcccaaatacctgttcttccatccatccacccacccactcatccacccactatccatcatcgatccatccatccatccatctacccatccatccacccatccatccactcatcatctacctatccatcatccatccactcatccatccatccatccatccatcatctattcatccatccattcatccaacatccatctacccatccatccaccattcatttatccatccatctacccatccattcatccatcatctatccatccaccatccagccatccatccatcatgtattcatcatccatcatccatctacccatccatccaccattcattcatccatgcatctacccatccacccatccatcttatcatttttctgaacatctattcactcatctacccaaagttcagaaagatcttgcctgaagcccagctgaacacttactatccatcattggacaagttagctacctctcaaagcctcaacctccccatcaaaaaagcggatgatcaggagtaactgtgataacgcactctgccaggtgttatgcaaacatcagcaccttcacactgccctgctgcagctgcaaagtcagtaacaaagtgcctgtctcacctcactggtccagctggcaccagagtgcgtgtcacttgacagagaagtcaaagtgaacacagctccaaccttgaagctctgtttcttgattctctttgcaggaatcagttccctaacccatcaaccccagagcctggggaacctttatctaaaaacaggaaagccttatttcttctagaccagagtggtgtacacggttgcaggcagtgattaccgggcagtgacatacggttccagccaaatgctcacatgtcttcttattcactgttaatttgaacctcaaaaagtcccacaaaggcagaaggtgaaaacttttgtccccattttacaggtgagaaaatggaggctccataaatggtgacttgggtatggaaatacagagctggtcctcacatcctagctcggggttccctgctctgtctggtgacagaatgaggtgaacaagatctcacctgctacaaggtgtcttatccttgtgatgtctcatttgatgaactacatcctcctgccaggtcccactcttcccacagcagccatagtcagcagcagaagccagacctctgcagcccagggagaagggctgccccgctcaggagacatggcacccgggccacgctgggggtccctcctgctgtcctgcctgcacagtgaggactggtctgaagttcctgcatcccaaactgtccatgttttccttatgttctggccaagaacagccaggagggattctaaccaacttgttttggtataagggccaaatcactgaattcttaaaatgaaaaaattggtaatcttctcggtggggtgacttggatcagtgagttgggccatttcccagccagcctgggtgaacaggaactggccgacatactgacctttctccattcattcattcaccagtcagttacacattcattcattcatccagcaagtactctgcgggtgggctgtgagcccatcgccatgtgggtctgcagacccccgtgaatggtagacacggatgcaggcctcagggagctgacggtcaactgggcagaagcacaggtcagcagatgcatttccgcccatctgaggggtcagcacagagaacagggccaggacttgaggtcagggttagagtccacagggcctacccacaaaaggctacaagaggggacagctgggtagtgcagagagaagggcaagggcacgggaaaggctctgcagggatgttcggggagaaatggatgccacacggcgcagtggtgccagtgaacgagcaccagctcaccctggatgcagcctcaaggctggaccggagcagacagaaggtggaggtggggagccccattgagggcccctgtggccatcccaggggagctaggggagcccctgatgtgtagaattgtgagaaagttggaggtttcaagaggcacaatcacccaggcctgggacctactcaaggtgggtaggtgggtgtgtcttccaggttacggctcacgcagaagatggcagtaggggaatagagaaagctgtcagctcaggtctctggcacagagggcagcacagcaaacgcaggagttcccaagcccttagcgtctgtcaaatgttactaaatgctattggctgacagttgttttaaagttgaaggctcaggtcctgtgtcatctcctgtctggtcaatatcacctccctccctggcttcccaggactgtgaaagtcagcccgcacccaagccctgtgcgtctcgggcctgagggcttcacgctgcctctgtgattctggtgacggcatctctgaggatgcacgacagggacttaggattattcacaatgtctcaccttgctggctgcaatgactgcttcagggacggacacaggacaccggctacccctccatctggccccggctgtctgccagactaaccctgggcacaggtgaaagtcaggctgggcatggtggctcacccctgtaatcccagcactttggcaggctgaggcagctggatcacctgacatcaggagttggagaccagcctggccaacatggcgcaaccccatctctactaaaaatacaaaacttagctgagtatggtggagcatgcctataagcccagctacctgggaagctgaggcaggagaatcgcttgaacctgggaggtggaggtttcagtgagtcaagatcgtgacactgcactccagcctgggtgacaagagtgagactctgtctcaaaaaaaaaaaaaagaaagtcagggccaccgggagagctcccaattccacacctcacccctactctgccagcagggcccagccacccccactttctaggtcaggatgatggggcacaggagggcaagcaggagccgcagtcctggcactgacttgaagcccctctgcgggccccactccagcagtgtccctgggcggccaaggccccttctgcccatttcatccgcctgaaaccctgaacgcagctgcacctcagttcccatgccagtttcaggaaaacagaggccactgggccaaagacgggcttcccagagccccactgggtcctgccggggtccagcccctgcctgtgtggccaggtgggtgccgctctttcatgcgtgcaatggacgacgcatggacagggcggcagcattcatctccaccaactgaactcaaaagcatgagtccttctttcctgctgagctgaccccacccaagcaacgttcttgaaggagagggtggccaggacattccctggtgggtgaggccagggcagcccttgggactggctgccactttgtagaaatacatccagagttgttctgaacccgggaaggccaaccagccccttggcagctgggagagacccagaaggaacagggatgcccccaccccacacactcccagagcagggactcaggtgtctcaggaatgttctcaggacagtggtccagcagtgccagtggacgccaccagagggcgcccccaggggcggagctggctgagcctcacacctgagggagcagaggtgtgcaggtgcactggctcctaccctcccggaccagcacctttaggaggatgggagaagaaacacacacacacacacacacacacacacacacacacacacacacacacacacacacacacacgaaaatgagaaggaggaggcacagggaggaaggaagaacacaggccaagggacaggtggacaggtaggcaggagagactgtgggggaggatgggggcagggacaagtgtggggcgtgttcctctctctgtctcagagggacagccctgccacaggctctggctcacctgggaggggcttgtgcagtgatgggcagcgagggaccctgtggtgtctccactaacagccctcacctcccagcggacactcaccatccacagatcggccccctcacaccccttgcagcccccttcctgttacaccatcactgcaacaccagctcccaggctgggcccggtgagctccttggggcgctcgccattgtgcaagctggctcagggcagcttcgaaccagggttggcacctccatgcaggaagcagaccctgcctacagctctgagcccaggccaggaggcactgggttgcttggtgccagcaggagtcccggtgggggccctggggaggctgggaggcctccctgaaccccatcaaggctgcacttgagggtgtgacctgaggctggttctgaccacactgccacgcccactgcagtcctggccaaggtttctggggctttgggtcagcgtttaggcaaataggtctggcccaagaggggtgctgagcatgtgcagagggacaggggacctggccagtcgcctccctgcccaggacagtcggcctcctcctacctggccatctctgcttcccctgcttcttagcccacacaggcctctgccaccgggacaataacacctgataccctgtgctccctgccccatggcagccagcggggtctttctacactgtccacaataaggatgaagatgaagacgaccctaagagtggccgacgtttctgcagaaccgaagactgtctatgagcagctgtggatgtcagtgcaggccaggtgctgaaagccacttaatccacccagcacactcgggagggggtgaaagtcatcagccccactttacacaggagaaaacagaggcacagaaccagcaagtgacttgcccaaggtcagctggcgggtgggtagagccaggtagccctggcggtcagcactgcttgggggatgttcagcaccggttgctcagcatgggctgatgggcagctgctccacccttcagacaggaggaagtggggagggctttcccctccacggcagggagagcacgctgtcacttatgcttctgatggtaaccagaaagagctctgggtcacccagggcccccagaggctgggagctagcagcctccctgaaagtggcccgttagtgccacatggccagggcccgttgccctaggaaagagctggtttttcaggaatagtaaggcaggcgcacaaggcatggggctgagctttgagcttcgaggatgaacaaggagcagaggggctcagccacctcctggagcctccaaaaggccctgggttgggttgcacagtcctgtgatccaccatccagcatcaccagggctggccgaatgagcgtttccctatctcaataaaggccacttccacaatggggcctcggtccacagccaggaagcagacagctctagccaggcccccctcccctggctgtaccttgtttgcaggacattcagaccaagtgtgctcagggcaccagcctttgcaccccggctatgtcacctgaatgtccctgcgcccagcatgggcctgggtaactgctccataagcaaacaatgtgcagtgaactggctcccttctgtgcctctcaccgtgcaaagacacttctgccccccgaatgcatatggccctatgcagggacagaacacaacagtggcacctgcatgccccaccctcatcccaggggacctcaaaaagatgcctggagaagcatgcctgcctccaactctccatcccacctggtcgcctcgaaggcaaatgctcaccactgctgtcccataggaggggacgtcagtgccactggcaggtcctagttaggacacgggtcttaagggaaggacctctcagctcatcagtgcccatccagagggttcctcctacagcacagctattgctaccattgaggatgctgaatcctggacagatggatatggacagggaggctgtgaaggggtggggaaagggaagatggaacaaggccaagaaagaagggactgacgggtcagggccaccaggtaagagcagtgcccctcgacttgggacaggcagtggcccacagttagggggactggctgtcctgattttagcactgaaagtcccacatcacaggcaaacctgaatggttggtcactctaccaacggttctaggtgacaaaggggacagtcttggccgagctctgggtcttgggttggacatggacctgggctctaagaaccaatgtggaatgcgcactggctggacaaggtgctgtgggaggcggccaccctgaacgccttcagctgatcttgagaaaaacctgaagttggtctttctgggacccttttttgagatggagtctcgctctgtcactcaggccggagtgcagtggtgccatctcagctcactgcaacctccgcctcccaggttagagcgattctcctgtctcagtctcctgagtagctgggattacaggcatgcgccaccacattcaactaatttttgtatttttagtagagatggggtttcaccatgttagccaggctggtctcaaactcctgacctcaagtgatctgcctgccttggtctcccaaagtgctaggattacaggtgtgagctaccgcacctggtcccttgttttataattgacaaagattaggcagattgggttttacctgcccaaggttatgcagctatacaatggtacagtacagaagcgtgtatgcaggaggccaggcaatgagcatttgaggcaggctggccaccatgatgaccacacacacacacatacacaatgattctctctctaacatgcacgcgcatgtctacacaccagcatgcacacaggcaaatgcacacagaccaaaaaaacacaaaaatgcatgcacatacatacacaggcatacacaaacacatacacacatgcacacacacatgtgcattctgtcccccgttcctcacacatgaacagggaaacagggatggtcagaccgcagctgcaatacacccggctgcttctctctttcccgagccacatctagcacatctagtctgcagccagctcaagtccctggccacgctgcctttgctgtcttattagattttgtactgggtgaaggggacacactctttttaaaactgtagtcagaagtcttgctaagtgtgtgaagtggaattggctgcctcgggggagccctttaatttagcttcccattgttctcagcacctgggactcctcccttggggtccttccaagcaggaatctagaccagaagcagctggacctccttgtttggctctggtgggaagcgtctgtgggctaaaggccaaagcgttgagaggacgtggggtctgccagctctaagaggatcaggcctcgaccctgtctaggggccgggagaagtgggctctcaccggcatgttctccccacaaactccttggctgtggccccaaagcctgggctgctggtcatagtcagggtgatcagcccctcctgggaccacgtgaggcactgaccctcctcaaactcacacggagcttgccaggtggagcccctgggggcaggggtggtggcggtcttcctccctgacatccctgaccttagctggcaacagagcatgacccaggcctgcaagactccccgcagccaggctctggaccccgagtggctttgaggccagggaggaaacaggaagcatgtaggatgggggcgagggtcaggggcctcagcactgaatgccgacatcaccaaaaacatggcaacggccggggaagcacgggtccaaggcccaaatctgagggagtgccaagtcaccagatgccagagccaggggcctgtgccgagtcctgcccttgctacgttctggctgtgtgacctcgggctcctcatagaggcgtctgcagcaaagaagccagcacagtgaactcctggagcagctgtacccatgagaatgtggaggcatcggtggcaacggccactgcccctgcaggtgcagctttcgtggctggaaccgacaccaaccctagcacctggggccccgacaatgagctgatccctgggaagtctcttcctcgactgaaaattctgggaggtggcgtgagaaaggcagagacctgcttgggagttggagctctgagtgcaaatccagctcccctggctgcttgggaggcaggagggtggggagagacccagacctggagttggacgccgaatggggtgctgggcaggagaccacaggcagttcccaaagtctgccctatgctgcccatgtccttgtctaggaaatggaacgaggcacaggctcctgtcacctggggctgcttcagagactgacagacatgccctctgtgctcctgccatgctggacccaggcctgcaagtgctcccctgagggttagcgctacctgagaccatccctgcagctgctgagacagccagacgccagagccctgagccggcctctccggcccccagcattctcctctgggctgggtttctccctgccacccacgtgtgcaccctcaatttggataaggtgtgtttgcaggcttgcaaacatggccctcgggagggcacacacccctgaccaggcttgcagccctgcctctctccctcttgacatttcacttaggaccaagaagtcagtacacaaggaaaggaaacaggacccgagaggccagcagtatccccagtccaccccaggatgctcagctcagcctgcacacctgccccgagctttcatcgtgtgcctccatgaggctcgggaaggtgaccccagccccccaaggggagaccgtgccagcagggacagtgagcaaaactcaggcatgaaagtttcctcaacatctgggttggaataaaatgggcttcctgctcaacttctgggccaccccaagttggaggagctgggacccccagcacgtggcggtcttccttcccttggcgtctgccactccttacccgacatgccagagaggctgcggcctcttgccgtcctcgcctgcgccgcccagcctgttgagcgatggggaccggctgcggggcccgggcacgtagctcccaatggtcttcgcggccccctcgggcttgctgggcatctgctgcagcagctggggtgacaggctgcggtgcgaggtggccgtggagcagacggcccagtcgggagcgctggcattgaggttgttgtcactgttggagcgcagcaggacccggggggcggccagcgtgttggggggccgccgccggcggttggagtacgccggggcctctcggaagggcactggggagaaggacatggagagaggccggtgagtgcatctgtgtcgtggtcagctgggtggggaccctagggaggtgcaggcctgcgtgcgtccaagcccccatgcgagcccagcagaggggagctgtgagttctgggccgagaccccagctggactccaccaggcccagaactcacccctgacatggaagcagagagacaggctggggacggagaacatctccacggcacggagctcaagccagtacttcgcatggaagggacgtggggtctgagcttccatctggcctgggagacgtccggctggcttgggcatgtgtaaggacgggccaccccatcacacaaagcagagagggcactgagctgcctgccgcaagatgcctcctccccacaacctaagttgagcctctggggtgggctgaactgtgtcccccaagttcgtgtgttgacgtcctaaaccccagttttcaaaatgtgccaatatttgcaggtaaggtctttacagagatcatctgggtggagggccattagtgggggccctgatcccataggattggggtccttataagaagaggcgatgaggacacagacacacacacagggatgaccccgtgaggacacagggagaaggtggcacctgcaagccatcaagagaggcctcaggaggaaccagccctgcgatgccctgatctcagacttgtagtccccaggactgggaggtgtaaatatctggttgttttgttgttgttgttgttgtttttgagacagggtttcgccctgtcacccaggctacagtgcagtggcacgacctcggctcactgcagcctccgcctcccaggctcaaacaattctcctgcctcaggctcccaagtagctgggattacaggtgcccgccaccacgcctgctaatttttgtatttttagtagagatgaggtttcaccatgttggccaggctggtctcgaactcccgatcttgtgatccgcctgcctcagccacccaaagtactgagattacaggcatgagccaccgtgcccggccaatatctggagtttaagccacctgtctgtggcgctctgccacgcctgagccaaccatacagtctccgagtccactggctggatgattcaatctcagtcctcactaagaaggtgccttcctccctcccatcaagtggggactgtgtgaggaagcaggggctgggcaccccttatctggcatcctacaaagctctagacagggccaggccctcactctcctcactcaatgagaccaggggctcagaatgacagcaacagcccctgggagctttgaggggtggcagccacgccgcagctgccttggtttacccagagctccagagcctaagacagcgagtgccctttccaagaaagaagacctcctgaaaggcagccctccaagctccgcaggaaacagcagaaaccaccatcactggggggccaaaggcacgggcttctccccggcccgtgataatcgtgcctgcagcagcttttcactggctacaggattcagcccttaggctgaagccacgcttggctccgaagtttccactgcacaggaccagggctaccatctgacaaactgcaaggcaagagaaaacacgtgtcctccctgggattgggtctgggggaaccttcatgcctcagaggagaagaacgtcacaagtagtttaggacacaggtggcagtgacgaagctcttggggacatggatggtgctggcagaactcaagggggatagaggtggtgctggcagaggtcacagggacaaagatggcactggcagagttcataggggacagaggtggagttggcagagttcatgagggacagaggtggcgctggaagagttcacgggggacagaggtggcgctggcagagttcacgggggacagaggtggcactggcagagttcacgggggacagaggtggcactggcagagctcatgggggacagaggtggcgttggcagagcccatgggggacagaggtggcgctggcagaggtcatgggggacagaggtggcgctggcagaggtcatgggggacagaggtggcgctggcagaggtcatgggggacagaggtggcgctggcagagctcataggggacagaggtggcgctggcagagctcatgggggtcagaggtggcgttggcagaggtcacggggggcagaggtggcactggcagaggtcacgggggacagaggtggcactggcagaggtcacgggggacagaggtggcactggcagaggtcacgggggacagaggtggcgctggcagagcccatgggggacagaggtgatgttggcagagttcatgggggacaggtggcgttggcagagcccacgggggacagaggtggcgctggcagagctcacgggggacagaggtggcgctggcagagctcacgggggacagaggtggcgctggcagagctcacgggggacagaggtggcgctggcagagctcacgggggacagaggtggcgctggcagagctcacgggggacagaggtggcgctggcagagttcacgggggacagaggtggcgctggcagagttcacgggggacagaggtggcgctggcagagttcatgggggacagaggtggcggtggcagagttaatgggggacagaggtggtgttggcagaactcatgggggacagaggtggcactggcagagttcataggggacagaggtggcgttggcagaactcgggggacagaggtgtcattggcagaggtcataggggacagaggtggcgttggcagagttcacgggggacagaggtggcattggcagaactcatgagggacagaggtggcgctggcagagttcatgagggacagaggtggcgctggcagcgttcacgggggacagaggtggcgttggcagcgttcacgggggacagaggtggcgttggcagcattcacgggggacagaggtggcattggcagaactcatgagggacagaggtggcgctggcagaactcatgagggacagaggtggtgttagtagagctcatgagggacagaggtggcgttggcagcgttcatgggggacagaggtggcgttggcagcattcatggggggcagaggtggcggtggccgagttcatgagggacagaggtggcgttgacagagctcctgggggacagaggtggcactggcaaagcacatgaggacaaaggtggtgctggtagatttcactgaggacaaaggtggcactagcagagctcacaggtacagaggtggtattgacagctcccaaggacagaggtggtgctggcagcgctcacaagggacacatgtggtgctggcaggtttcattgaagacaaagatggcattggcagggctcacaggacagaggtggcgttgatggagctcctgagggcagaggaggtgctggcagagctcatgggggatggagggtgctggcagagctcacgggagacagttgtgacccggcgcaccttccccacctccccaggacacagggcagccctggagacagagctagagccaagcctggggagccgcacagagctgcgcaaagcgtcctgaggttggatacttggacttgacacacttggacgtcagtgcctgctgtcggtaagaacctggaggtggtacattggggaggtcgcggtgtcacacctgctctgatctggttcctctgtgaagcctttctgtcattgaagatgccctgctaagcagccggggctcctcagccagcactttcatcccactcctaatttctcaaagcacacggatccatgaacgccacccaggctggccggggagagacaaggaacggaaaaagctgacggcactctccgtggacatctctccttccagagcccctcgaggggcttggcctgggatccacagccaccacccacgagaaaaacctcatccctgggacaggtcaccgagtctgttttgttggtcttgagggaaaaccatgttggtgccctccctctggaccggcagagactaaaaaaaaccttgtagatcactgagtgtttgcatggaggcttacaaagatacgactggcccagagggcttccgggtgatccgggaactgcctgtcattggagggggctgggcgggtggattaaaagaccttgcaaagggctgatgagcccacagtctcagagagcgattatctttcatttacagagattacgtgttggaagactgtattggtgtgagagccaaaatctcaaacagacacagccagcagaaagcagccgcagagcccccagcttcctggggcaccccaggagaggccacggctctccctacccatgtggaggagacatcacagggcccccagtcacggaaacgctgcctcccacagccgactgcctcacgcccagcttccccgccccgacaatgcagccaattctctttttctgacccttgtaactgggggaggtatgcatactcttcatagcaagtgatggcatttgggggagtcctggcagttgctaagataaactcattaggaaaaaaaaagtctataaaagaacagaacagatacagaattaacctaacaccaaaacccccaactgaaattttcatgctgttcatggattataaaaattgaaaccccagaaggtgaattttggtgaataatgtcagaaaatgggcacagacaaaggttgttatttatatacattcctaagactctgtcagaagagtatggacttagaggggggaagaattcacatggggaggccacccttggaggattaaggaataaaagagctgggacattttcaaatacatttttactctgtagaccacgcaagttactcaaatgaaatctcaccggtgacatcagtgtgaacattttaatgaaaattacctcgcgtaattaccaagattcatattaaattagtttcctgagtactgaaatttctttggtgtttattttgcaacgagctggggctgggaagtaccttcctcatttctctaaagtcatacctttttatgatatctgatttcctaaaatgagagctctctgacaaaactctctaactggaaccatccatggaaatgatgatttttttttgtgaaaagggttaaaaataactgttttctgtctgaaaatgattaatattccacccaactgtttccttcttttaggcaatctgcactctaaataggtggatattttcttagctggcttacatgcatttatttatacatttttttccccacaataaaaattacacaaggtatgacaaacagagtgtgcacttttaaagttggccacgctcccttcccatccattccatgtaactgcaaccccgggatgggagagccgggagcagctcggaaggtagccacccatttggtgcagccagccatgtgccccgacctgcctcggccagtgcctagcagccctctggtcactgaggactatagtcaaaacttcctttattttccctaggacttagttcctaacacactccgtggcacggtccccacggatggccattccggaatggagttccacaagggctgaaggtttgaaagcagcacacgataaggcgagaccttccaccgcgttatattccggaccaactcaaaccaaaccgtatcccaaaccaaagtcattatcccctgacatgctagggattaacaactggcaattttaggaggaactggagtcctccctctcccccaccccgagaatcagcaagcagctgctaattcccatgcacccggctcccgacagctttttccttaccttccttcttggtgaaggcatttaacaaagacttcattttccctctgactttggcagcggtccgctcattatataaccttcctggatgggaggaaggacaggcgtgcagcccggcccctcggtgctagagcagctgggacccggggagaggtggcgggtgtctgggcacggtgcacttccgagcatagctgggcatgccagacccagcgtgctggtgacaaagcccaccccatattctgtctgtcagctgggaaccaactgcacgtagacgggctgctctcaaacccggctacctctcgcggcgcgcgtcatgtgagccgggctactctgcttttgtgctcagggcattgaggaagaggcaccgcggagggttaacgcggatcaggcgtcctcgagctggcagctgggagacgccgggaggcatgagtgagctcgagccccagttatccaaggaaactcgggctggtgctgggcgctccatgcgcctgtgcctaaatatactgcactgtgcttttctatttttttaaaaaaaaatttttttaaagaaaaagccaagtttgtttgtcagctagcagatgtggtaagacagacaagggggagggaagcgtacaagtaccagataagcttcacaccagacccacgttccccgggcagacatggccagcattctggaatttctgaacacgacctatatttctgttcaaaagaatcagacacaagtgcccatgacttctctggctccccacccatcgaggtaattaccctggaaaaaacaggactccaccccctcctacttttttttttttttttttaaagagagagataaaaagacaattaaactgagaccctgccaaggatggccccgattccaggcagctgataaaagcgagctcttcagggtcactttaggcatttcctcagcatttccaacccaacagaagaagagaaaagaggaaagctgccccttggaagccctacatggagaaagtcagatttataaagcaaacacagagaagtggatgcaggctggtgccctgtggcaggtggacagtgagttatttctacaccaggagaaggagcttcctgaagctacgtggagcatccaggggcaaggttctgttgccggatgcctctgctgggctgtaatttagtgtgctgtgtgtgtgtgtgtgttttttttttttttttttctggttgctaagagaactgcttcagaaatttaaaacacacacacacacacacacacacacacacacacacacaaccagagaaagacgagacaagacgaggaaaaagcaaccagagcactaaagtttaattccatatggttgacacactttgtgtcaataaaaatggcggtgtgagaacaagaaggctgggggccccccaggagcctttccctgaaggcgtaccagggacgggactgcggcatgcctcggtgagggcctctggctttagggagagcagagactgccacagaatcactgagtgtacgccctatatcagctgagcacccgaacagcatctcttggccgggtgcggtggctcacgcctgtaatcccagtgcttcggaaggtggaggcggttgaattgcttgagcccaggaatttgagaccagcctgggcaacacagtgagaccccgtttccatgaaaaataatttaaaaacattagccgggtgtggtcgtgcgcctgtggtcccagctactcaggaggctgaggcaggaggattgcttgagcctagaagttcaatgctccaatgagctatgattgcaccactgcacatcagcctggggatagagcaagactgtctccaaaaacaaacaaaaaaccccacaaaaacccagaaataacgataaacttcatctcttatttaactcacacaactcatgagccatgtcaaaactctgccggggtgacattctcaccctaccatgcatcaccgactcataaaactgagtcaaagccatttctaagacttgcattaagaaacggttctgaggtcagagccaccagtgtgtcccacagagttcatgcacctcctcggacactctgagcaaggctgaacagcttccagaagaaccctcctcggatgcacaaagctttcccccacttcgggaggcctgacgatgtgtcctccgggtggaccagccaggggggccagaagctttccagatggtgagtgtctagttcattgccatgtgctggcctggctgcctgccctggctggcgagcgctgggaggctgagacggggatgccaccgtgtccgtattggtgtgtacagggagctcctccaaggctgggggacccggctggtcgtgtgctcagccacgtgagcccagaggactcatcaaagcgcagggaactctcggggagactcagtgacgctcaacaccccctccatctgtcactgatcgattccctcccaaaagcacagagcctcatcccaagccaagtttctgagccaatcactgctccggcgctgctgcctctgcggcctgccatggtgtggggagagcctgcacgtttctgggctggtgaggccaggatggcccttggcctgaggccagcggtgtcctgtcatctttggctgccttgccggccacggaagaccttgggtggagggtgtaaggaagaagccacctccctgggaccatgtgacaatcctgcatctgttctgactggtggaccaggcaggggacaaaatggagcctttttcccctcacgggggcctccaatgtcaaatatgtcaaaggaccaagaagaggccctgccccatctaaaccagagaaaaacccagaacctctggacgggagccacgcagcagcactcacagctggcccagaaaggaccctcagcggccaccgtccggtgcgtgtgcagcagctgctcctggaggtgcatttgcccacaagcaggagcccaggcaggggttccatgaaccctgggctgcccagggagaagggaaggagccttcccaagacaaggccccgtcaccaggaatacggctggcttccacccctggggtccctctgccccgcccacccccacccctgcaccccatgtcccatctggtttgggggcatgcgcagaagacagccagccagatctgaagacccaggcctgcttctcagcctgtgcaggggtgaggggcggggcaggatgaggctttggacacaagacgatttgaggaatccagggaacacccccaggctaaaggatcccttttccagacaccttcaattctttcaataagcagacaacttttcccgcccacactcggaggaggctgagtaaaccattcacaaagatcaggagcggtggtggctccatcagtctcatgcacacacctactgagtgcccggtcctgggccaggctctgccacacggggtcttctggtcaaccccacagaaatcctgccaagggagttgggccattcttgacaccactgtcctggccatgtggtaggctctccgtggataattccagcgacgggggactcactacctttgcacaggggttctcactgtcagacgcgggcagcagcctgtaagagcctccttcccccacacccaccacttgcccccttccctggtgggtgcagaccacttcctcatttgccaagaagtctggcgctgaaggcacagactctgccccgacaaacgcaaacctttgtgcagcctccagggcagttttcatctggtgtccccatccctgcctttctgggggaatatttatcttccagccctgggatgtggccatgggaacatcagcattcctcctgcccctcgttttatgagcatgtccgtggcctgaagcctgccctgcctgcctggctgggagggaagttctgtgtggacaaatgttccgtgtgagtgtttggggtccgggccctcccagaaatccacacttggggttattgcaggagacgagctcacccctgagccccaggtagatggttcgcattctcctgccatctgcacacaggcccggcccttcaccctccaagccacggagacccagaaacctgccaccgaccaggtgaccttggagagctggggaagcagaggcgggtgcacagcctcccgcagaactccgggaattcgctagcgcccttcccatctctaaaacaagtattccgaggatgaccgagcgctagtggttgagatgaaaattaagacaaagataaaagatgaaacttaaaaacccattttccctggaggcttccagagatcttcttctctgagaaaagcctcaggctttgggaatgtccccgtggagctgccatcctgggtccctgagaccagcagcaaggctgtcagatgagacagacgaggttcagagaggctgagcgctaagctgcccagggcctgggaagggtcagacatccctgctgcacccacataggtttccacgcattggagcccaaatgcccacagcatggctgagcactcccttccttctgcctttagacccactgttcctataggggtcctgcgtggagggcctacaacgaccctggaggcttgtgccggccacattcctactgaatgcagatgaggttttatttcaaatggatttcattctggaagagggagagattggaggggaagaacttccaggtgtgagttgggctgggggcaggcgggtagcagagagggtggcaatgtgagtggttggtgatgaagctatccacctgcctgcctgcccgcacacccacccgtcccaaaactcaggcaagcaccttttgagtctgtttgttgcctgcccgcacgcccacccatctcaaaacgcaggcgagcaccttttgagtctgtttgttgtccatggacagatgaaaaaccaggaggaaagaggagagggaggctctgaagtcagagtttccagaaaggaaaagggtcacccccaaatgaaccccaaactctcagccacccaacctggctcttcagacaccaactcagctccactcagcccagttccagtgcctggcccttggtgcttcgtgagccagtgacatccaaagccccgtgcccccttgcctccctccctgcagcccctgcccacaggcatcccacagactcaccccatacactgcaccaccccctcaaaccctgagactcactaagccctttatttgccatgtcttttgacaactgcctgacaacggactgaaaataatttcacttcttgcataaaaaaaaagctcttcacacatcagaacatttcaaggtgctctgaagtcctggcggggacgccgtaccaggtgttataaacatgccagcaagactcagaggtgctcacgggtctcagaaacatcctcgttcagtggcgatcagacgcccgcctccacttgctgtggcttcagtgcccatgtggtttggaaagagccggacgtgggagtcaagacgcaggtttgggtgctgactctgtatcatgccccctgcagccatgggccggttggacaccccctgaccctcagtttccccatctgtaaagtaggaatagcacaacttaccccacagggtggagccacccgagctcgtgtttgaagcacaaaggagaggggcttggtgcacgcaacaccgtggggacacctttggggacaagtctcagctctgtgagcccagagaagtcccatgagctctctgtgcctctgtttcctagtctgtttaatggggatattaatggtgccacttcacaggagagtcataaggataaagtaagttaatatttgtaacagtagtacctggaggcagtgtcggtgatccctgaatgaatacatttaagttttaaaaaatctgtaagtggatagcaaggcaatcctcctgctttgccctatctctataataaacaagtcctggtctattgctcacgatgcattcacattatccttctgggtgctgcctcctccaggaagtctccctgactgatccaggcagcagacagaccactcctaagggctcccgtggcagcagtcagcccttggggcatgttgtggagccaggagcctcccagcttctcaaaggcaggttccgtgtccagccctcctccctgccctgcacactggcagtgatccctagtgctctggagatgaatgaatgaatgaatggagtgaattaacagagggggtgagtcctagctttttttctgagtgttccagagcactttactaggttcaccaggctgctctctagttgtgctgctctcctgaggccagaagccaccttccttgtccaactcccaccctacccccaccccctcttctgcccagggccttgcatgtacccagtggaggcccagggaggcttgggctaagccacagccacgctaccagctgccccagaccctgagaaggcctgtactgccccgccttgccccacgagcaggtgcagccaggacagcatccttagcgtcctcactgcatctgcagagcagctaggctgttgtcctcagcatcctcactgcatctgcagagtggctgagccagtgtcctcagcatcctcactgcatctgcagagcagcctggccagcgtcctcagcgtcctcactgcatttggagttccctgcaccccatgtcctgcctggaaacagtgagggctcatccctcagcttccccagctgctgtggtttcgagttcgagcccatcagacacatgggccaggaaggcactgatgcagaaggagcaactcacagaagccggcgagtgtggcacggggctccagcacaatgtcaagctcctgccagcgcctctgactgtgcacagcaccaggtattccatgcagcccacctgtggctagacgccccgactggccaccccggctggccgcagttcccaggcctggctctccagccctcttggagcacagtgaccgcctgacatctgtcagagtcttctgcctcctgcatcaacaagccagggtggactctactgctggtgacccagaccctgaccggtagagcccgtgaggctgggtctcgggcaagagagctgggcatgcgacatctctcagggaggcctctggtccagggaccctgacagcatctctgcaacatctgcagctggactttctgggttcaaatcccacaaggtaactgtccatgagtcacaaaatgtccctggactctggatccccaaaaacaaagcaagcacagtgatgatggtcacttcaaggagctgctcagggggttaagtgcatactgggtgcagtacttacgcacagtgggtgctcaacagaggttagctgttgccatcacgaccacgactgaagtttgtttattattgctgactgttcattattgtgattattacaacagcttgttgacgagggaggtcctgacaggcattctcagtctctctgggcagctcaggtggctgcaggcagtggaaggccatcaggccgctagagacagggtcctgacccaggccaggacagtgttgtctccccaggacactgcttctgtgtaactcagacccaggcccttctgccaggaaggagctccaagttgatgaaggcacaagggccagctttgagcgtcaccttcaacttaaaccctgggcaaaaccctgagtgtgatcacaaccaaaccagaagggaagaaaataaaatgttgggatgtaggaagcaatgccaagaaaattcccagggttctggggcaggggatgccctgatatcccggagatttattaaggctccaccccatatttcagggggagacgcaggggagcacctgagcctatttccaccttaacacaaaatacacaggaggtggctctaactctggtcccaccccatatttcaggggaagacacaggggagcacctgagcctatttccaccttaacacaaaatacacaggaggtggctctaactctggtcagactgaaggcccatggggagccgaaaaaagaaaacaaactctagacggtctcagtggcccaccagcccaagctccactttatcttgcagaaacaaagactgaatgctgagaaagtatgtatgcaagagcctcagccagcgggggccaagccaggagcaggggtggcaggtgcagggcaggtacaagctagagcgggattcttcctgcccatcccccaccagatccaaaatagcatctcttgtttctttccctcgtagctttagataactgcaatttaaatattagtaggcaacatttctccatctcacaataattgttaaatgaatcatgcttttataaataacacaagatataaaaaggcatctcagcaataatgcggggttatctttgcacaaagaggtaggagtctgtggtgtttgtaacgttcccgtcactggagtcattgagggaagctttgctcctgcaggatcgagggaggcccgtggaaaatcggggtgagggcactgaggagcgggcgtcggaacctcccacagggtctctctccctggttggagagctgaaaggggctgggggtgtaactccaagagatactactcaccggttttctgaccctgaattgagctttagggccaagaacatggctattttggggggcagcggggaggagctctggagggtgaaggtgggtctgaccacaaagagaggtgaggggttcccaaggtatattctagaagaatcacagcctccagacattgcctcctctgccctccctccacgcagctccagccttggccacaggctccctgcagagccacagccccagtgcacaggacactactgtgtgcgggacacacctgaaggaggaggggtggagccaaggggcgtgcaatggcttacgggcagcatgaaccatccctgtggtggcccttctgagagctgagtgactgtggatacctgggcctcccacaggggaaaatgaggcttatgtgctgagacgtgctccgccagttctcgaggacacaggacgctcagtcaagaggctcatgtgctgagacatgctccgccagttctcgaggacacaggacgctcagtcaagaggctcatgtgctgagatgtgctccaccagttcttggggacatggtccgctcagtcaggaatcacaaccaggggccgaggtgcaggccaagtgggctgggggcttatggaggaccctggggccagggtgatcttgcaccatgagaagagatgtccagtccctgggaggaactagagctgagctggaggacccctcttggagtgagccattctctttccacaggacctgatggggtcctttgttccagcttcttataaaaagaatgaaatctgagcttggtggtggaagatgtgagtcctgggtcagtctctgactcaaggcagggttctgggactcagttttctcatctgtagaatagggtgaccagcctcattctgctgaggtctcatgaggtctctgagaatcctacaggctagacaaacccaggcaggagaagcctggagatctaggggcagagtgggctccctctcggacctcagtggaggctgggggagtgggcaccccgagcccactgcaccccgagcagggcagcagctctccctgtctcaagccacactggggtgggctgcccaccacctcctctcccatacaagagagcccaccaaggtgcaggagggactcctgaaatgtgggtaggagtgtcgctccgtttccagccacagacaccctttcacaacatggcctgcttgcccatggggggccaggggaaggcccagctctcagtccttaagggagcgtgcctgctgcctcctctttctgagcggctgcacactcagaagcagcatggccccttagccctgattctcaggccggctccacacagctgccactgggcacagagggaaagcttgggcgagactgggggtgaggacagtgcccgcttccacccttgctgcttgagacctcaggcacgtggctgtgcctgtccgagcctgagcctgcaagttggagaaaggataataacagcagctgtcttgaaggccagcagttgtgcaagtcaacgtttacaaagtgccaggtatggagggaaaggacttcctgtgggtggccccgggtgccacccaaggcctggacctctacatcgttcctgttgctcccccatgggtagacgctgtctggagggccctgcctgcctccatcacagcctctgctcactgttcataggctcctcaccgcctgggcatttggtgccagactgcagatgccaggaccacacagaaagaaccactgcagctgcccaacgcctgggtgtctcaggacacattcaagcactaggcccacccagcagctcccctcacagactgactttcgtaaagcagcacctgagaccatctgaggctgactacagtcaccaagtcctgtggcctgaaggtttacatcccctccaaattcatgtgttgaaaccctaacctcccatgtcatggtatttggagatggggacattgggaagtaattagggttggatgaggtcaaggaggtgggaccccatgatgggactggtgtccttgtaagaagagacttgagagttggtcgctgtctgtctctctgtctctccaccatgggagggctcaaccagaaggctgccgtctgcaagccaggaagggagccctcatcagacacccaattaagatccaatcaaggctggcaccttgatcttggacttccctcagaacttcgagaaaaatgtttctgtcgcttaagccaccagtctatggtattttttgttaaagtggctgcagctaatgaagacaccaggcagactgagcatgccactgcccccttacaggccactgccccttacaggcttccaggggacttacgccattgtctctgctgctcctgctcctccagatgctccctcacccacacgggccctgtcagctccctcccactggcctggacacacctctgcccctgctgtgcctaccctccatctggcattcctctgcctgctctccccatgtctggctgcttccaactccaggccttgtgcattcacgctcatggtcaacgcatgaggaggctttccttcaccatcctgtccaagagggttactctcttaatctctatgctagccccttgtgactttttccttcattgtatttattgaacattgaagttatgttagttttaagtttgcttatatggtctttctcccccaagtaaactgtaaactgctgacaagtgcagtctgtcttaatcaccactgcatcaccagcacagagcccagcccctctcaaagatgtgcgttgaggccaggcacggtggctcatgcctgtaatccctacactttgggaggctgaggcaggcagatcacttgaggtcaagagttcgagaccagcctggccaacatagcgaaaccctgtttctactaaaaacacaaaaaatgagccaggcatggtggtgtgcctgtcatcccagctactcaggaggctgagacaggagaatcgcttgaacccaggaggcggaagttccagtgagccaagatggtgccattgcactccagcctgggcaacagagcaaaacattctgtctcaaaaaaaaaaaaaaaaaaaaaaaaaagaaaaaaaaaagatgcatgctgagtaacttcatccaataaatgaataaataaaaggaaggcacgttcctacctcccaccctggacttgtatggtgtttgcctcaccgtgtgaaatgtcttcccaccatgaacactgcctccctacaactggggccttctggaagacctggggcaggggaggggccttcacacagttttctatgctcaggacacaacagaagaccccgcacaaagtgggagcttatcaatacatgttctggttatcttaggtccttgtgtgcctgcttcaacacttgggttgtttgatgctgcttctaacaattgtggcttcctttggttgcacattgcattttccttctcttcctagctagtaatttctgattctatgctggtcattgtgtttgttatgtcggagagactctaggttctgttatcttcctctgaggtgtgtttagtttttcaagtaggtagtaaaactatcagtgcaatgccttgccccgtggaggtgcaatctgaggctttgttgggggagtctctgttgatttggtcctgggatggagtcctgactcctagggcccctctgtggctccagctctggatgtttatcaagctcctctaacatgctgggactcaattctatactctatctctcctgtggaagaaattactgaagtctccccaaggcacttgggcttttagctactgttttccactgagtccctggactctcactctgcacaggccgattcaacaatccaaaaggaatttatgtgtagacttcagggccctccactttccaggatttctattgacttccagtctctcaggcaactctgaccccaacctccaacccctgaatccacaacacagtaagactccagtttatgtcaggggaaatctaattaatgtgggccttacaagggtggggggcccctcttctgtcaagggtcccagcatctctagttctgtctgcttttggccacttgcccaggcctacaagcagctggtgttggtgtttatatagaatttgtcccgcgtttgccactgtaattaacaggagggttagtctgacatgagctgctccatcactatgggaaagcagaagtcatgggctcatcaatacatttataattatatttaatacaacacacttgcggatattcagtaaagtgggggagaagtcatccaataggctccttcaaattactttttcattctaaataaaactaaggacaatggtaaaacatgtgggctccagaactcagaccatgtgcttggaggtgtcttggttgctttatttggtaactcagcctagaaagccctcagggaaagggcgggtctgggccagtggccctccccaccccactccacagcccgtggtatccggcagccagcgcagtctccccaggtctggaggcaacacacacccccctggtagagagggcgggtacgtcaaaggagagaggggaacaggatgtgctgggaccactgactacgtaagccaaaaagtcctgagcagacaggaggtgcagccttcctgtgccactgggctcctggacctggacttccttataccccatcaggaaaggaccacagccttggagggggtttatttcaatacaagaatccaacttttgtaaggtttgagtacctccaggaggctggaagtgaaggtgggttgaaggggaggtccctttttagatcgaggtgtccccggtaaagctgccaggccgccctggaaaaggaagcactcaccaggcggctgagtgaggctggttctccacctcagttcttcacctagttagcgaatccaaatgcacatttatattttgggaactaattaaggctcagtgactgatttaaccttcaaataaattcctcccagggccgagctggcagcatagtgaatatcaggcaccacatctgcatcaagaaaacctcaaagtctaggaagaaccaaaacccaaagggaagggacatggagaggagggaatgtcaagcgtgaggtgggctcggccggccagcagctatgcagccctggggctgaaggcagagggcgtggggcccaccagctgactccccacatggtgacggcgtacagtctgggaagaacagtgtgaggggctttgaggactcaggcattgtcacggtcacagcttcccaggcagtgaaagcctcactgtgatcgccacctcaatgtcaaagccaaccagaggtgtcccgactcctggacagggaggtagttgggtgggtgcctcggagggcaggtgagagctcacctggcacactacagagcatgaggcagagatgcccaagggcaggtccgcagacccacctgcgtgttctgggtgctacctctgcctggctgggagtcccagctccctggagcctcagtttccccatatatcaaaaggaggctagaatgcaccccaaaagtccttcaggctgcaagatcccccctctcagctctgaggagcatccttgtctgggaggagccctcagaggagcagagtgtccatgggcctgactcctgggattctaggggcattaactgacacaaaaggtggagacctgggaggggagccctctccctctgaactgtccacaaataaaagggcacacagcggcagccacatactgtagctcagtggccaaggagagttcttgggacctcagctatcagggcagggctcttccaggaagtgggagcctggggagggctggggggccatatcgggaggctggagcctgcagactcaggatctccctcctgggtgccgaggacagggacaaggaactgcagtgggggttctcatgctgcagccatcccagcaccgggcacttctaagagatgctgatgaggccacccccagccatcaagacttgactgtgtttcactggagcttgataagacttcacctgagaaacactctggctggctctgatctcttccagaggtgtataaaacatataggaataggccaggcgtggtggctcatgtctgtaatcccagcattttgggaggttgaggcaggtggattgcttgaggtccagagttcaagaccagcctggccaacatggtgaaaccctgtctctaccaaaaatacaaaaaaaacaaaattagccaggcatggtagcgggcacctataatcccagctgttcaggaggctagggcaggagaatcgcttgaacctgggaggcagaggttacagtgagctgagatggcaccactgcactccagcctgggtggcggagcgagactccgtcttaaaaaaaatagcaattatcaccgcagtgaaaggtgggcagtggcagcaggtgatgcctgtgacacgccaggcatggagggcaacagctcacggcttccatctctccttcctccaccgccacccagggcacagccattttccccattacacagcagaggagtccaaggttcagagcaggtcagcaactggatggaggtcacacagccaggccaagatgtgcttgggcttagcctgtggagtctgcctttggccccatcgctgacccagctgctgagagtgaaactcaagccctgtggtgccacattccaggagggtctccaccttggttcttcaggaattctggcttgacctgggtgcctgcgatcactgttggaaggtccggggcccctttccgtctgcttctcccttaggcactagagccagctactgcagaatcggggtgagtctccagcccgcaaagccaggatgacgtgactgctcctcctgcctggcttcttgcttctcttcaggacccaagcatgcagtgccacttctgatctacagaccttctcaggcctcaaccccaaccctgactgtgcgtgtctgctcgtcagctcccaaatcttctccaagtcttggctactgtcaccgacctgggcagacaaccccagagcccacagcctcccaaaccatcctttacacacggtccttgtgctgtcactgcccttattcctgggacctaactgcccttctcccttaaccctgggctcctccaggacaagagaccttgtctctctctactccacacgccctgaagcctggatgggtgtcacagctatttggcccatgcttgttcaaatcacgaacagaacaaatgcaatattggcgatatctgaaaactcaccaagcatttacttccaagtatatgaaatctcattatgttattaaaatatttaaacattttactaatttctttttagtaaaatttgacgatggttttgccttcccttgacttggggccaaaacccatgctggaaagagacagacactccagggaataaagcatattccctgccgggtggctccagacctttctgcagcaccatggtgaccccgaggtggtcaagctatgagtcatggaggcccatggcccactctgcttcaatcagcactggggtttcgctgtgccaccttggccaggctgcataacctgtctgagccactgtctctccatgtgcaaatggtgttctagggccctctctgcacttgtccctttcaggagctcctttagcttcaaaagcagaagagaactgggcacagggaggggtcagcagccctgcaccgtgagctcctgccctggagcgagcatgagcctcagcctaggtccctcggccaggagtgggtcctgctccctgctgtgccacctgggattctcgtgcagcttaaatggaactcggcaaggaagctgagccctgtcctgaagctaaaggagacactgctggaggctcccaggggggtgggaggcagcacgcagggtctccccacccagaggcccaagagacggccgaggtgaagctccctccacacggtttcctctcagcatctgagcttgcacggggatctgtgagaataacacggacggtggaaccttccactccacaggctcagggggccgggctgggcggccattccctcgtgtcatctgactaccctgacgcagtgtcatacccctaacacaggtgtggctcgcatctgcacagagctgcccacaccacaccctgggcctcagactcccagagcgggctgggcagaccctggactctcacagcatgtggaaggctggggtgtgagcccagagctgaggctggaaggtacaggtttcaggtcatggggtcagggagcagaggctgcagtggagatgctcaggtggtgactgtgactgggaggttgcaaagacagctattagggtgggctgggctgctatggggtgggctgggctcctatggggtgggctgggctgctatggggtgggctgggctgctaaagggtgggctgggctgctatggggtgggctgggctcctatggggtgggcttggtgggccccaggaggaggaagggaagcaagtcttggtggcttttgggaagagtttatggatggctggcgctgtagacagagctgaaattcgtattgtgaggtcctgactcctagtgggactgcatgtgaagcagagtccttcacagtggttaagttaaagggaggccactagggtgggcccaaatccattctcattgatgtccttgaagaagaggagatgaggacaaagacgcacagagagacgaccctgtgaggtcacaaggagaaggcggcacctacaagccgcagagacaggctgcaggaggccccagccctgcgacaccttgatctcgagctccagcctccaggactgtgagaacatagaggcctgctgttgaatgccccccagcccacctgcagggctctctgcacacgggagactgatacagggctcaaccgattcttagaggacacacgagtcaacttccctaaaacagaactgctccagccctcccaatttggtgctcagggaccaggagttcacaaatatctcctggtgcttccgtcggaaggcctgtgaatgccatctccttgggtgggtggccataccatcttcatcttcctcctcagtttggggacacggccttcgtggacgattctccagtgagccctcagttttcctagggtaggaccacactgtgctgcgtgcaccatcccctgtcccatctgagtccccaaggtggtgggagctccctgggggatgagtgggcgcctccatccatccacacacacccagccctcgcctggcttccccacatctctggacaggaggactcttctggcagtgtgttctccctgccacaggcacccctacaacattagttcaactcattaatactctgcttaaaaagaaaaatctaatgaatgccccattttcctaattgggtcagcagagcatgccttgaatagcattcaagctgttcagtttctacctgaaattgccatgcgtttttccatttgggttggggggccgggggcggggcatgaaaatctctccccctaaatccttactccagccttcacagccagcattctcgacaaggggatcatctaaaacgctgggcacgtttctcgacatagcacaaactcactggaaccatggggtttggggccgcagtggaggagttggaaacacaggctccacgccgggcactgcccttcactccccacactgagcacctggccctcctgctgcagccctttgagtaatctcgtgggatgttacgtaatattcctggaggatacatgctgttcttttacatgacaaattcctcagacagggattatctcagtccagctgagatgcttttcgactttccccatgatcaataacacggcggagaacattttcacgcaggtggcacctttcttcatttgaatattttacattcccaggagcggaaatgccaggtcaaaaggtctgagcgcccccatggccctgggcacgtgtctggccaattgctttcaccagagttatgccaatttatatgaccaaatcactgggacccaatttcttcttatgaaaataaaatagggctgggtgcagtggctcacacctgtaatcccagcactttgggaggctgagatgggtggatcacgaggttaggaattcaagaccagcctggccaagatgctgaaaccccgtctctactaaaaatacaaaaattagccaggtgtggtggcacacacctgtaatcccagctactcaggaagctgaggcaggagaatcgcttgaacccgggtggcagaggttgcagtgagccatgatcgtgccactgcactccagcctgggtgacagagcaagactctgtctcaaaaaaaaaaaaaaaaaaaaagaaaaagaaagaaagaaaagaaaagaaaatctttttctaaaatgaggtatagagaaaatgggtttcaaccagaggacaataaacttcaaagatgagaggactttccactggagtggattaggggagacataatttcacgctgaaggactcatcagaacagaatagtttctccttctcacagagaaatggactctgataacatcaggcctattccaaatctccaagtccatggcatttttcctactcggcttcgtgaacttccaatggaatgtgcttattggccccggggccagcacggggccatcttaggtgccgaggatagagaggcggtgttggaagaaatgggtggggatgcctccaaaccacccacaaagaccgttcccagagaccagaggcaggaatggcagacaacctggtgacactgagatgccaataaaacccaggattgattgatggaaagacgagccaagccagggaaaatcagaatgaaacagacggccccgggtgaatgaatgcacatttcccataattacatagagatggaaataagcagcacagaacaaagcgagaaggagagcccacttccaagttgtttgcagcagaggctgaaaatagacaccggagaggtggtgctggatagaaaccgccagtgtttgtctccgagcttcctgcaatgaaacaacaagcaacgcactgggggcaggaaacggagccgtcagaggaaagcaccccagagacgctgttccccgtctcccgacactggagaaacaggtggccaagggcagccgccaaggtttccagaggctggtgccgagcccagagagacctgaactgggtccctgggaaagcggaagggcagaaaagcgaactggagagtctagagtgcgcttccagtgggacagcacccccaggcaaagtcagctaaagagggtgccggtggtggggtctttctaccgtggcagaaaacggaggcacccctcttcttaggggttcctaggaggacaactgagccttcaatgcctcaggttatttttctgtaaattagtattattattattattagaaacacggtctcgctcggtcgctcaggctgatatgcagtggtgcggtctcagctcactgcagcctcaacctcccaggctcaagcgatcctcctgcctcggcctcccaagtagctgagattacaggcatgtgccaccatgcccggctaatttttagtttttcattttttgtagagatggggccttgctatgttgcccaggctggcctcaagcgatcctcccaccttggcctcccaaggcactgggattatagacatgagctgctgcgctcggcctcatctgtcaatcaataacaaggatgacactgggaagcacaggtcaactgctggtgtcccaagccctgctctcagcactccacagaccccaggtgcctaacggccacctcatctcagcacagaaggcagcgtcatcatccccatgacacagatagtccagtcacctgctcccggccacacagctgggaaggagccagtgctccgaggtctatgttccaatgtaaagcaccacactctccctcccacccttctctgaaaaatgggggctagaacaggaccactgggtgctgtgagcatgaacgaggtcatccaatggagagccttcggtgcctcccaggcccagagcatggttcaaggcccgtggtgctatttaagagtttctctgtgctcataaaagagcctgctgccacggggactggctgctgctctctgatctgaggatgggcaggactgcagctggggcctgggcattcccatccctgagcaagatggcatcactttacagaggagaggtggaggcccccatcaagaggaggggacctctgccccggcccatcatcaatcttgcgagggtccttgactgtgctgcgacccacaccccagtacagggtcctgggagtgtgctagggagacagagacacaggtctacgttccaggcctcagctatggagtcccaccatggcaccccgcgggaggccgtccctcctgcccactctgtacttgatgaggtccacgcctcctaccgctgcaattctgttgaggttctaatgagacggggtcccccaaatgcagccttgtctcacagggtggtgacggggttggcagcagcagggcctcctctctgagattctcagcaagaaagtgatgccaggaggcaaaaccgtcaatcccaggatctgctgtcagcgttaaaaatagggggaaatgtgcctgactgccagatcccctgccagggagggtgctgcccccctacccaactcagaattttaaattaatttaaaattgctctggaacgggggaccagcactgaaaacctgcccgagcatctctctgcgctcagcagcgacgccatccagggtctcatctctgctcctgaatttcccatgctccctctcaattcactccactcaggttccgagttcacaagcagagtctaccacgcaaactctcccacatccccacagagaggaaccagcctggctttgcctggggtgcccccacccacccagtcctcatcatctggctgcaggggtgggccaagagccagtccagggcctgcccagcaaggcctggaccaaagaggggggcagggcttggagacggttcccagtggaggaccaccaggagaccacgtcctcccaggcttcacggctacaggagacctggggagcccagggctgctgaggtgaccgtggctggaggggaccagccagctggggtgtggcttcatcttgctagaaggcatggcaatgcctgcggtaggaagggcggccccacacctattcccagttcccaaaaggagtctgaggtccgctgggcttcatttcacagccaatgaaacagaagacgaaaggccctctcaggacagccttctctccacggaggcttagcgacagcaatcttatcactgctgcctaaaaaagaagccagaactctggatttttatgtgaaatctcctgattttaaataccagcaacgagttcctattttatcaaaatgtgccttacagcatgggctaaaagaatctgcccgtgagccgccaggaattgtggggtggggggtttgaaagacgggcaatgtcagggcctggcgggggtgatcaacccacccgttcccgccacttcccaaagtgagctccacgggaccctggagacccttgaagatgactgtgcaaaataggttctacagtcatgtttgggaaacgccagatcaaacaaagctaaggggcttttttattgcaggccttaccaggaccttaaaggccctaaagtgcactgcaggccttatcaggaccttaaaggcccttaagtacattctgagggtccaggaaggaagtaaagcaggtagcgcttccaatgcgatttgaccacagacctgtgctttgcagagcagccacggcactcactagaatccagcacctttaccttgaaaggtaaatggcaagtgtgcagttcagggtccgagaagcttgggcagggatgtaccacgtccagtgatgcaagccaccctcaactgtgcagtctggctgtgatcttaattacagaatgggagagccagtcctttccccgagcaagcaagcctgatgccagcttgtttcaggaccaccaggaatgtcaacaagtgcatgatgctgggagacaaattgagcaccatacagacagctgggcctctgagtgggtgaagggggaccttgctctgaggcttgatgctgcgtgaatgagtcagagaaggatgtgagtggtgcccagggatgctggctgcagggccactgaaaatatgaatggtagaaacggcctggacctcacactccggaatgttcagacataggggcacacaccccctccccaccaggacacaaggcacaattaccaacaagatacatacacccataggcagggtgtgaggatgcatacctgaaattccagctactcaggaggctgaggtgctattgtttgaacccagggatctgagaccagcctgggcaacacagtgagaccccatctcaatatattaatatgtatacacatgcatgcatgccaatggctggtctaaaaaggtgaggtagagaaaaagacaccaatccacaatctattctccctagatcacatctgtgtgaattctgtctacgggtgcacaaatggggctgaacagggacatggaacctggaagtccttctctgcactggaggccagcaggctgtggcaggctagtgtaggaagtgggtgcctgggctcagggtggaccccagagccaactgtactagagcataaccctgggcaagtgcctaccctttgtcaaatgaaaatacaagggatcactgtgtgagaacataacaccctaatatacatgttagcatgcagtagccatactccttcctctctttgaattttcttatgagggcatttatgtcaaaagaatgaaaccacagtaaaaaaaatatgcaaacagcagtgttgggtcaaatctgttaatagctgccatttatcaagtctcctggatggtgatctggggtccatgatctccctacgttatctctttttttaaaaaaaatgtttttactcatggcaaaatacatataaaatttaccatgttcatcatttttaagtgtacaggtcagtgacatcaagtatattcacagtgttaggtgaccattacaccatctgtctccagaactttttcatcttcccaaactgaaaatgctgtccccatgaaacacacatgccctattccctctcccctagcccctggccctcatcatcctaccctctgtttctatgaatctgacgactctagggacctcatatgagtagaccagtacaggatttatcctttagtgaccagtttctttcactcagcacagtgccctcaaggtctctccatgttgtagcctgtatcacaacctcctacggttctccttcaatcttcacaacagtgtcagcggtcagtactcaggtgaccagatgggatcagagaagccaaacaacatgtccaagatcacacagctgcacctgaaacttgaacctagagatgtctgtctccaagcttccaccccaggtgttatacctcctgcccccaaggccagagaagcagtggtttttgatgcattttttcaagcaactggctcactttacccaaatgagatgctcatactcactgggggccagggtggtgtggtttaccagctctccctcctgcccatcagacagtccctaaagcacctgtgaggaactctctgggacagtgtgtagaaaccataccaaggatggatcctcagcctcccctctgccaagagccacgtgtcctcaccatgcacgcccgagctgagctctctcccaaattccaagatctaagtgtagtgggggcttgggcctcgagtcactgtgcctgcagctcccgtgggctcctggggagagtaacttatgactctgaggcacccggaccttctagtcagttctgaatcccatcagactgctggcgaatggggagaagctgggaaaggtgacctcacaaggcagctcctgatctcagctttgggcaggggtccctgagtccagaccagctgaaacaagtacccgagagtcctgacaattgtgctgctgggctctgcagccctgacaaccccttcgccctccaagccacacattttccacttttaaaatgggctcacggccactcttcatgcttgctgcaggggtagagtgagccaacacaaatttggagcatccgtaccccaaggtgacccattaacagtggctgtggctctcacaggaaggctgggacccagccctgtagggactgtcagtccctggtgagaattcctgaatcctctccaggatccctccctactctctggactttccacttcatggagcccttaactctcagatccaaataccagagccttgcagaacaagaacagactttccttcagaaaagatcttctccccaacaaaggcacaagaaagggctgttgtagctggggctcctaattgtcccccacttcctgttctcctgtcttcctctgaaatgtaacctggcccttcatctggtcacctggctgtccacaaagaagaaggtttaagaacatggctgtccacttaagaagggagctgtgtgataagatcctgaccactgggacataaataaaagaaacaggtccacttaaggaaagtgtccttataggaaaagggaataatgcctttctcctgcccctttctcctttctgctgattggaatgatgatgtaatgggtggaggtgaggcagccgccttggactatgagggcaattgagcacggagtccacacatgatgaagcagtaagtcagaagaacatgcgtctcagacaccacagaaccctgcctcagttatggaccacctagctggacttttatggaaaagacaaactttttaaaaaacttaggatttttagttactcacagccaaatctcaccatgactattagaggctagcaatgccaatttagaaatacttgagagagcagtagcatcgttattaaggacccagagcttggggtccagttggaccatgcgtggaggttcaaactcttgctaatcatcctgagtggatgcaaaagtcagagcctcccggcccccaggctggtaaagtgaggcagactcataaacgactgtgatagaatgtgatcaattaataagaatcactgccccatgaaactctgccaggcagtctgttcccattcccacctactcctgaaagccgtgaaaataaaacacagtcccttttaaaaccaagaccttctgggccactctgtgcccagggaagcaggactactgcaggagtcccctggccgccggggaggagcgtgggcagggtctgcagaggcgagagagagctcggactcagacatgacacacggcccacctgttagagcatatagctcctcatcctgctgtttccaaagcatttgcacagtgccagattgtacagaccacaaagaaaactggctcctgcttagaagctttaaagaaagaatattgggagagcgaggaacgtaaaccccagtcaacttcaaggccatcccagagaagcccttcagaaagaagtttcctcagaaggccatgcaggggctccacggggcctgcaaagggtgttgtgtttgtgggatgcagaggccagggcaggagggttgcaggggaagggcaggaagaacgggctggctgtccatttccagcaggacactgccacagtctgcactccacgaaggtccccaggtttctgggggactgtgtgttcctcaagatccatgactggctgggcacagtggctcatgcctgtaatcccagcactttgggaggccaaggtgggcggatcacgaggtcaggagttcgagaccagcctggccaacatagtgaaaccccgtcttgactaaaaatacaaaaattagccaggcatgatggtgcatgcctgtagtcccagctacttgggaagttgaggcaggagaatcgcttgaacccaggaggcggaggttgtggtgagccgagatcatgccactgcactccagcctgggcaacaaagcaagactctgtctcaatcaatcaatccacgaccaggatggctgtgctgttaggaagaagcccaaggtagaggccaggggaggggttgccttggcaaggccttgagtctccacatcactgtcagccagaggaaggcaacgttccctgaaccagtgggccacgtgggaagttctgcagagccccacaaccctgccctggggaagcagagccctcaggcccactcgacaggccatctggggtgccccctgctgagacaccttcagtgcctggcattgggtttacgggagacagcaatccttggcagggtcctcctgggctccttagagcctgtggggagagtgaagttgggggaaatgaaacatgagcaacactccgtgagctctggaaacagagccagactctttctagggagcagacactggaaactccagccaggtggacctggaccaggcgtcccggcgcctcccacgggccctggagctcagagcacagcttcctgggagagtccaagtgcgggagagggtgtgagtcacagcggccgtggggacagacaagaccctgaggctgcagtgaggctgagtgcgtcggccattgtcacccagtgaccgagagaggtttgaagcggactggtgctcagttctgggtgcagccttaagcgtctttctcagtctctttatggccaggggggatgcctctcagcaggcagggcaaaggcaaatgtctcctcccaacagctccaccagcccggagcgtgtgatgtgtgtaggatgcttcctgggcatctgcctccactctcagtaacgggagggagacagagtgaaaatacaggatgcgtcccatgttcctggagctgccgtgaccgcttaatacacaatgggtgacttcagacaacagaaattcattctctcacaatcttagaggccaagagtccaaaattagggctgtggcagcacttcctccctccagggcctctaggagaggaccctccctgcctcttccactccattctctgccttcgtctgtgtgtggccttcctctcttggtgtgcttcagtgggttcctgtgtctgaatcccccctccttcttcttataaagacatcagccattggtcatactaatacagcatgacctcatgttaaccaaaccaattaaacccacaaagacgctatttctaaataaggtcacattctgaggttcaagttggacatgaaattgaggggacattatttgacccagaagaaagaccctgcagtgttaacagtgattcacttggggagtgggggagaagaaggtttggatgattttcatatgtacacgcatttaccccttgcttttgtgtaatttctacgaagaccacatattacctctctattcagaggcaaataaataatagtatatttttgattaagaaaaaattacttgagatctcaaaggtccttgttgactgtcatgagtaggaaagttaccaatgctaaaaatgctgagatcgaatctagtgagtccagcagagagaaggctgctggctcatggcccaagaaacccagtgccttgtaactgtggctagtgctgttactagcactcagcccagccaacaaagttgagagcttgagcaacaggaaagtgaagtgagcaggtgcctcagattccacccccagtggcccacattcagccctgtagcttgaaatccaactgagcgcatgcatggctggattgagggagagggaccaaggtccagagggtgaaacacgtgctttccatccaggcacaggcaaggaagggccttctggggaaggagatgcagaagtggcccaaatggaagatggatgcaggcccacacagtgaaaggtcccgccaaagctgacaagcacatgaaggccagtgaaatgtccctctctgttctcaatggggagcccagggagaaacacccacagctggaagcaggcaccacagggggcaaagctgctggggtgtgagtacactgccccatggcctctggggtcctggacaagccctctgtccaccacagagcagggactaggcactggtctccctactacacctgtgttgcacgcagggagtgaacagcaagagctgtactttttgtttttgcagaaatccagatcacggttcacccacgactatcagaaacccacccccagatgttcatgactgtccatcaatctaggaggtctgggcccggcccgtagtcctgaaaatctggacactctcagtgacctgctaataagaagggacagccatttggctagatgccagcatatggcccagtggctctggctgtttgcacagcaggctcggctgcccctcaatgacttcatgatgagggataattaaaacagcttccctgcacgttctcctccctcatccaatttggtcacatgatgaacaagctcagaggaaattagcaaggtattctaagccctacaggacagacattctagcaggtgaggagtaagccaggtttctggaagcttcccatatctagaatgttgggttctgggcaaattgcccatcagtctggcccaactcagtcacagaaggtttcagatccctcctctttgctcccccaaccccttgctcagatctgatcctatcagctcttccaacaacctccaggcaggtccccctttagccagcttccccttcctgattcttgaaccccaatgttatagctctgaccagggcatctgctttaaaaatcttcaacagctcccatggttagaacaaaagtgaaggaataggaattcctacattcaaatcctggtctccaacttcacaagaggtaacgctaaaccagcagaccctgagggcagagaagctgccttccatggcacagggcctggcatgtggtaagctcacaaaaaatgtaagatgaacagaagagaggaaggaaagaaaaaagaaaggtgggaagaaaggaaggagttaaatcgatggcaggatgggtaactgcatggattgttggatgaatggatggatgggtgggtggataaatgaatggataaatagataagtgaatgagcagaaacactaatgaatggatagatggatgaatgaatggataaagagatggatgaatgcatggatagagagatggaaggatggatggctgaatgaagaaatggatagatgaatagatgaatggatagatggatggatggaaagacagatgaataaattgatggatggatggataaatgaacaggtgagtgaatgggtgggtgggtaaatggatagatgagtgggtgggtggtgggaggatgggtgaatgggtggttcaatgagtggatggatgggtggatggatggatgaatggataggtgatgggatggatggatgaatgaatagatgaatgaatgggtagatggatgaatgaatggatgaataaatggacagatggatggatgggtggatgggtgagtgaataagtgggcaagtgaatgcacagatgaatggatgggtgactggatgggcagatgggtggttaggtgggcgcatagatgaatggatggacagatagatggataattgactggaggaaggaatagatgaataaatggatgaatgggtagatggatggatggataaattaacagatggatatttggatggatgaatgggtgagcagataggtgggtgggtgaatggataatgagtggatggatggatggatggatggatgggaggatgggaggttgggtggtaggtggctggatgaatgaatgggagggtagatagatatattagttgtatatataaaggcaaccttcccctcttggactgttttgcccatctattatatttccttgcctctagggggtgtgagtttaaaccatgtttgatacattatttcattaaaaacaccaacagccttatgagggaggcatctgattcctgctttattgaatcagagaatttcaaggatcttacacagagtcccactcaataagcaggtgggacagctggaattcaaacatctgccaatctgtgcccaggactctttgcccagtgtggttctccctgctcttcccagccccaagcatcatttgaaactctggatacacaccagatggacacccctggctggcccttccttaacttctgtctacctcgtctctatccttagtctgacagggttggtgatacctgttttggacttacatctcttcctgctaacttatgctctctgcaacagcctgcctctgcgtgcaaatgttcctgcaagagggattaagcaaacatttccctgacgatggccccagcagccaggaggcagtctcaatagctggtttccatgctttgcataaacttcagtggactccaagggctggagcctgagagcccaatcgggccacaggatgactgacactggacaagtaagcgggcctcagctcccaacctacaaaatgggaataatgcaagtagcacccacaaagggttgttttaggaatcaaattggataatgcacaggacttagcacccagtaaatactcaatgtacggtgacccgcttttcaaacacctgctcctaagcaaagcgttctcaacctagccacaagcaacctggaggctaagccctcccaggctgactctggccttccctagcacagggctcagtcatgtgcccaacagatgactgctgggtcttggatatcctatttccttttcctcaagtggcctcacttcctgataaagaccttggtgcctttctcaggacttgggagggccaagcccttgggcagtgcccaagagagcacaagcagttgacatacgggttctgctgcccaccccatcatcctcagcactttagttgacgtgatggcccacctcttgctattaggggcatcacggagcacaaggggagatctaagcccacaagacttgcaactctctaggaagaactgacggcagccttagcacatgacatcacgaagacacaatgacccttgaaggccaaaaatggtggtaacagcagatcacagcgatggggcacttccatgagtcacacaccatgttccacggctcacacacatcctctcaagatgctgagacccaggatggggctacatctgacctagtgtgtgggtgcttcactgcagcctccacccaccccaccttggaatccttgtactgtagcatgatggattatctgggcctgtggcaagttgcaagacaccatttggagagggaattattcagatcatagcacacccatgacctgtgcttctcagctttcatcccagcccaaatgtgccaggagctaaatttagggtgagggttgtacccagcctgtgctctgtcaagaaggagccgagtgctgctgcgaaaccaccccagagcatctgcttcctgtcccctgttcataatccattttaaatgaagtcatcaaaattcactgccatgttcatataaaataacagcagcaactgccactaaatttgtattgcgctgtgcggccaggttgctcttctcttagccatggccatgtcaggtaggcagggtgcatgtgatacccatgtctgaagctgcaggcatggcagtgtgccatgcaaaagcccatggcctcctgtagtctttgccatccactcagtgggctagactggaaacccaggcatgacctgcacacccaacacctagcagcaaggcagattccaacctgaccatggctctccagtctcatgcccatggctgagtatcccatggacatggcagcagccttccagtgtgagccctgcttccttccttgctaaagacagttatccacacaacagccaaaggattcttcttaacaacagcaatcatggaaacttctttgttaaaactccttaaaggttctccccatttagaacagaacccagacccctgatttagaacatgaggctcaagggacttggctcctatctccagcctaactttactacctcttctcctggactatgcacctcccactcacacctccatctggttatccctggcatctgggagaacccaagcaagttctttcctactgcagggtcttggccaaagctgttttcaggaatgtgctgtccacacacctgtacatgctcgtccctcccaaaggcattcctgagcactttgtttttactactgggcagtccaccttgccctgagtctcatgctgtcctttccacactggagcactggtgttgggcctagagtcataaaatgtttacatacagcactgctctggatgggtgggtagatgaatggagaggtgagtggataaacagaatggtgggtgggtgagtagataaatggataggtcggtggatgaattggatggacagaatgaatgtatagataatagagagatgaacagatgtctggatggatgggtggatgagggtaagtaggcaagtgggtgaatagatgtgtagataagtagatggatagtggatgaatgaataaatggatatacagatgggcagatggatgggtaggtgagtggagggatagatgaatggactgatgaatggatggatgaatggagaagttggtaggcaagcgagtaggtggacggaaagatgggtagatgggtgggtggacagatggatcgatagatggataagcgtgtgggtggatggatggatggacaaatggatgaagtgggtaggcaggtgaatggatgcatggaaagatgggtaggatggatgggtgagtggatggatgaatgggtgataggtagataggtggggatggatggactagtcagaaaagtggatgaatgacatcataggtagatatcatcacctatacaactgagtcagagaaacttcttcagagaagctgagaaactgaagacacagaaccagcaagtggcaaaacagggtcaagtccctgcccttgaatgtggtttgacctccacgaagtgagaaaacatgccaggaagcttgttacccacagattggttctaccctcgaggctggtgtccagcatagctgaagagatgcactaagccctctttccctatcagggctaaacacgaggacagatgaccagactctggagcaccgcacctccagggacagtcagaaaccatgacccggggtccagctcacagttgggattgatcaatgggatgccaatgacttctaaattcagctttggcaacaaccccacagcgcccaggcttggcagtcatcctcgtgtgttcctcaaagaaccccgactatctccctccctgcggagcaaacatccccacctccaacctcccccaacatccgaccctgtcccttgctcccttcacatggtaggagtccctttctctcagaagcctctttgctccagaccaaggtgaacacagcccacctgatcccgccacctccataccctatcacacctggtcaaaccttctctacccgccccaaagccccatggctatgagttacttgggtgcgggggattttctcagctctgtacttggcacccccagactctcatcagcctgaatgtccccttaggccatgttatcctcgtgcacacctgcccatcagatctctcccatcacccattaaggtgacgggtctctttatgtaaccccaagaaagaacgttttgaaggtggaaattgtctgtggaatgcaggaaggaataagggaataagaattagaccaacagagtgtgtatttcgtctgtccatcttcaatcccgatgtgtgcagtgggagactgcgaggtccccagggactgggactcagtcttgcttttctaccagttgggtgaatgaacgaggacaaatgattaagcatttctcccttactctctcacttgaagaaaatggatgaatacttgtcctttgacctctcaaagtcataaaagtataaaatgaaatgcgagcatgcatttatagttttagaaatacacgcaaggggcctggcgcgatggctcatgcctgtagtccctgcactttggaaggctgaggtgggaggatcacttgggcccaggaccaggtgttcaagaccaacctgggcaacatggcaaaatcccatctctatttaaacaaacaaacaaaaaagaaataaaagaaaatgtgtatgtgaatcataccacaaagccccttcattccaaattctttctgcaggagccgcgtgcatctcaggggatactctcttcccaggagccagggaaaggacatccctcgacctgctgggcacacggggagcagcgctggcctttccgggcccccttgtgggagggaagcattccgacctgccccctctgcaggcactgtcagtccaagctggcagccaccaacaggcattttaatcaggcccaggttagtaaatcctgccacttccctgagggttttaaccctgcagttggaaggtcatgtttaacagcaagacctactattatgcctctgtttccatgtgaaaataaatgagtcccacacctagtaatggttttgctcctccagtctgtcctcttaaaaatgggtcgtgaaggactaatgcttttaaaacactataaaacaaggtctgtaatggctctgatgcctcaaaagtgtattaagatgaaaatttatgttttcctacaccacatggcattgaaatacaagctctaaaataagaggcagaattattgtgtgttctgacaaaaaatccccagccctacctgcacctgaacttgcatcaaaacatgatttccatcaaaattcccatcaaaagtcttatttggtataaagcagtctttttgggttaattttttttttaaaccatgcaaacatccatgtcagagttaattgcactgagttggcctcctctacgagccagttaactctgtagctcagggcctggggtttgtttctttgactcctctgggcaggtgcaaatatagcaacctacagttgcctctgcaggctgcagggtttgtgccttgagacaatcccagcagatgctgacctcaggccacaaaagaaaggcagggaataagccagacctcagggagctcagagctagacaataaataagcacaggaataaatgagtgatccaactgggaggagaaccaaaagaacaaagcagagatgtgatcagttagaagaggagcagagcccaatttggatagggtggtctcggaatagtgggacacaggtgcagccaaaatgcagagagcagggggcaggggcaaaaaaaaaaaagtgaaaacctgggaaggatcctgtcgcactgggtctcccaggccagggggaatctggtgtggagcccaacctggatggactccatgaggtgacacctctccccacgatgcggctgtctctgtttcagctgatctaagcaccagacactgaactgatggcacacctgcccagtgcccaggtgccagctccccgaacacagcctgacctcatcccagttcatccagattcctgctgcaaacctgctgcgattaagtgtctcagggggagggtgtgtgacacaatctgatttatggtctttgttgaaagatccctcttcgagctcctggggtggagactgggttgtaggtgaaaggagtagaatgtggagcctggctgggaagctactacactggtctgtgtagtctctggaatgggcttgagtagagacaatggaaatggaaagaagtgcaatacgtcagttggtatttggagcctggactggactggctgatggacaggactagactggctgatggactggactggctgatagactggactggctgatggacatgactggactggctgatggactggacgggctgatggactggactgctgatggactggactggctgatggactggactggactggctgatggactggactggctgatagactggactggctgatggacaggactgtggatgatactcaggcttccggcttgagtggatcatgaacaaagagggaaatctatgtgcttggggtgggggtggggagcttggttttggacacattgcacattttggatcctttgggattcccccacgggagtagtcaactgggcagcaggacacagtctagagtctagtaaactggaggtaagaatttgggaggaggagacatgggtgtggggctgattttgctgaagtgcccgtcttggggctcttggtctcagcaggagacaagccgccttacctcagtgattcagggactcagggacatgggctaaaaggtgtgagctggtgggcagggcagaggctgctccgcaggacttacggagcaggggtagcatccatcttagatggcagggatcaaggggtttttatacctgggtaggtctagagaaaccgtgaacactgtcacattccagggacaaatctcaaaaataatttgtaggccagacagcaggtgagagaggtccctggtcaggaggggttggcctgggttgagtggcccactggtgtgggctccatgaggtgacacctctccccatgacatggctgtctctgtttcagctgatctaagcaccagaacctgagctgatggcacaactgcccagtgcccagatgccggctccccgaacacagcccgacctcatcctggttcatccagtgctggccctgtctggacgagccccaagcatcctctgctcggtgccctgggacgcctgtgaactcctggccacggctatgtggtggaagacacggattctgtggggggttttccttatctctaggactcgcccacctgctcccatgcaaatcctcattttaactctggatcccagtgaaggtacaatttagagtctaaaataactcaggctggtgcaaacggagctttgctaggcctggtgcctcctttcagtcaacatctggtccactctctctggcatcctgggctgggggtatggggaagaggcactggcaccccgtttcggcctctttatttggagatgagatctttacagctacagagagtctttaaagtggagtcactcaggtaggtcctcatccaacaggagaggtgtgttgtaagaagaggaaacctggacagacaggaagaaaccgagtgaggatgacgacagccacctgcaagccaggaggagaggcctcaggagaaaccagccctgggacaccctaatcacaggcgtccgcccccacaacggtgagagaatgtttctgataaaaccacccagtttttgatactttcttatggcagccccagcaaacaaaaactggctccatggcctcccctgtcctggcccctcagtctctacgacctgggcaccttgcaagcacaagaaagggaccctccagttcggggtgcccacacaccttgctttcttccttgagctctggtcaccaaggaggcaaaggggagagaggcttccaaggggcccatcatttggaaagggaaaaccagcttctgttgccgtggcaactccactgggatgctctgctatttgcacattttgaaattggaggtgggtagtgagaagggaaaaaggaaagaaaaattgagggagatgagagtatccagggcaaaagaaaggagagaaaagcaaatgaagtttaggaaaaatccagcttcggacaggtgaccctgacagtgcttaatgacctcagatgagtcccagggccgcggggacttccccattaagtcatggtggctccagccaatgtcagcccaggtcccccactgtcagagaggaaacagaggctcgaagatgagaagtgccctgcacaaggtcaccttgtgacttggaggattctccaggtaaaagcagccgtattgggggaaggcctctattcttgtaatgaaccaaacgtttgtgccaaccccccaaattcatatgttgaagtcctaactcccaacgtgatggttttatgaggtggggtctttgggaggtaagcaagtcataagtgtagaaccttcataaataggattaatgtccttataaaagggacccccaggacctggatatggtggtgtgaacctgcaatcccagtgctttgggaggctgaggtgggaggatcccttgaggccacaagtttgagaccagcctgggcaacatggcaagaccccatctatacagaaaatacaaaaattagccaggtatggtggtgcacacctgtagtcccagctacttgggaggctgaggtgggaggatggcttgagcccaggagtttgaggctgcagtgagccatgattgcaccactgcactccagcctggaaaacggagtgagagtgtcttaaagaaaaaggggccctagagagttctctggtaccctggtttcagacttctagcctccagaatggtgagaaataaatatgtattttttacgagccatctagttcatggtactttgctgcagtggcctgagcgggctaagaccttcctccttggagatcccatggagtggggttcaaggggtccttatgatacccgtgagaggatttgagtcagacctgcatcccaccacaggctctaaggagagactcaacttctagggtctggctggcagacttctctcactggacaaaccattctagagaaaagcaaagatgctgcagaactaggcgacgtctaaatttagcctcacaaagaatctagagcacaggagcagggaaatactattctgaagggacaaggagaagaatacaatgggcccaggaggctgaattcaccacgagtaagggcacgcggggggtgtctgagaaagtgcagaagtcaggtgccggaatggccaggctgagatgcagctgcgcgtgcctcattccccaaccgcccattggatggaggtgtgcctcagggtggggtggggtggccgggcaggctcagcagcagagggtggggccacaagcatccatctccaaaattgctcttgagtctgctagcaaggagccacaggacactgcctcgcaccgccttctgatgtagctggacaagaagtgtgttcttcttccagcattgaatcagatcctgtctctcaaaatgagcctcagatagatagattcattcattcattcactcactcactaattccttcactcaccctgcagaaaccaagcacctgccttgtgctaggtactgctctacccaagcatcaaggaatatgcccacagtgctgcccttcctcaacttcaaatacctggctttcttgggtcgtggcccctccctggcagtcccaccctcgggcactgctcccctgggccctctcctccctggtgctttctgcagtttcttagtggggggctgcctggctgttctccagggtccatggcctgtccagcatcttggtcaccaattccgcgcgcagatgcctctgtcggaaaggcctagggtggtctccactttctggattagactctcacccccaggccaccagggagcggtctgctgcagtctacaccctcctggtgagacttaggctccatccagacagcaccaccgagtggctcccctgccatcagaaggcaggggcagagagtgcagctcagaggagccacagcccatcgcaccccgcggcaccaaatggggggaaccatttgggagggatctagtcacagaaaatggaagttgggaaccgagactcatttttgagagaaatggtcaaaagagccacacccggctaattaggattctgagaacgagatgctgctgaaacaagaagggaacagataagaccaagaaacatcccagacctaacatttggctacaaagaaggagtccaagtgttcttttgtgttgatgttccggaaactcaaaattgcactttgctgcagacgtcagtaactctagcaccaagggttcacggagcttgcatttgggaatccgaggagagcaatttacaaggagtaaggataaaatctaaagtcctatctcagtaggaatgacttttcttatcagttcacgcaggggcccggagacacacaagtcaacaaataggagatttttgtgatttctaaaggtccacttttgctggagttttcctatgtctacccggcaaattttcatctccccatttccctaaggaaacatttcttaaggggtgacctagaggcagccactctctgcccgcacatggactcagcaggagcttcatgacggccctcgctggtcttgagagcatctctaggtaacacaggaggacagatcaacaaccacaccagcctctgccttcactccctcgctgtggctctcaccccagcagacaaggcctggggctgacattccatgaagccaggagccaaacgaatgatatgccgtggacaccaccatggacagcacagaagggaaacaggacctcgtagcccagagggatttgaatccaattcggtgtatttaaaaaaaaaaaaaaaaaagagagagagaatgaggtcccttggggtagtggatccccactctgactctctcaagttctagaatacgaaggtgccatcctgaggtcagctgtctcctatccgggtaggggtaggtggagggtgctggtggaaggacgctcttgtccgagtcctcagtaaatcctgaacacaggggaggaccaatgaggagagtgcacacgtcttggctccacacgggcagcagggccgagagcaggtccggaggccaaggatcaggccaggactccaccaacggaggacgagaggcaagagccgctgttaacagcaaacagctatgtccactgctggggagtacggcatgcgcatgagggctgaggggtggggcaggacgggccaaagctgcctgagccagggatgccttcacaacctcgctgccccagccagaaaagtctgcccaggccaccggctcgtgaatgtggggtcagctcagccatgttccctcttgagaatcgacgctatagatttgtattcattacccactgaattcagagccagccagacatccacgtctcaccccaataaaagctttaacatttacccagcggcacagagtcattattctgtgacaatattccactgctgacctttattgcctaggactctctgtgaagtttccaaggaagcatttcagcgttcagcacacaggacccaggtccaccgcctccactgctcctgcaccggccggcccccgcctcccgcccatccatctctgggctgtttgcctctgtctggacttcatgtactgacagtgtgtttgctaccacttaattccatcactgactgtgcctccctctaaattgatcagtgtcaattctgggcaaataattgggtggaattaccagcgggtccacccgtgctgattatgcaaataatgtacgccgtcaccaagggcccggcgctggcagtaagtgtctaaactccttagcatttgacagcataattgaagacacaaatatgaagcctaatgaagagtttcttttctcgaggaagactccctcgttctcactttcaatggcttggcccagagggtgcaggtgaagaaggtgggtcgcatagacacagaggctgagggggtcggcatacggacacctgtccacggacatggggcggtgtgatctgctcttggacaaccccagggtcataacctgtgcctgctatgataagcctggtcaagctggataaactcccaagcctcggtttctccatgtgtaaaatggaaataatactataataaacaatgacaacagtcaagagtccctctaccaccactgctactagctgggcacgaggctattgactattatttatccctgtgatacagaggaggcaactgtggcacagagaggttaagtaacttgtccaaagtcacacagcctgtgaagggcagagtcaagacacaagccaagaaggtgggttccagagtccaggctcagcctatggactgagctgggccatgtccacatcttacacagtcagcctcacaccccacgggggcagcccagggccccacccacacagggagcacagtcactggagctgccacggccagtcctaagtcccatccgggaaagggctctggcacggaaagccctgtttggacacaacatgcggcctcctcatcctcacccattctcttccacaaacctgcccaattctcacccagggtgccaaagtccagaggatgttgggggagggcgtcctgcagttagaagccacatccaggtgggcgctgagtgctagaggctgaactgtgtcacctgcaaaattcatgtgacgcaggcttcacccccaggatatcagcatgtgtgcgactgtatagggagatgggctttaaagaggcaactaaattaaagtgaggccagatggggcaggtcctaaatccaatccaactggcgtccttacaagaagagatcaggacacagacatacagagggatgaccccatgaggatacagggagaaggcaaagtctacaagccaaggagagaggtctccggaggaaccagtccagagaccccttgatctcagccttccagcctccaaaacggtgagacgataaatgacttgtgtaagcctccctgtctgtggtgctttatgacggcagctggagcaaactcatacaccatagatcccgacaatctgtcctagaggcctccagaccagcaggtttcagagggaggacaatgtatcggtccacaggccacagaatgcttgggatgcaccgatcggcacgttattaaacccactgggaccaacagaactccacacatcccataccagagtgattaatgcttccaatctcagcctgtgctgtaggaggctttcatatttcacggcaaagttgtgcagaccagttggttcatggcaggctgtctgtcccaccttgctgcctatggcctctccaccaagccaggctcgggtatggagctcctgaccgtccacagcactctgtctgctctgtgtcctgggctagaaacctgataaccagcagatacttccttgggttgggcaccctgggctcggtgaccaccgtgtcatcttggcatgtccccatcatctccttgattgtcctcccccagacagggggctcgacggggagtccatggtggtgttgttggaagatgggatgagaactgacactgtggtcacttactgccgcactgggtgctcagtcgccgctgggtcagtgcagggacctcaccaccaattatgtgaatgcctcccctctgcctgaagctccccaggctctgccttctcacacacccagaaaccctcacaaaagtccacaagagtgtccccccaaatccatgtccacccagaacctacgaatggggccttaactggaaatgggtcattgcctccttgcagatgtgatcagtgaggttgcgacgaggtaatactggattagggagggtcctaaatccaataattagtgtccttataaagagagtgtggcccagggcactatggaagaggtttgaggatgagcacagcagcagaatctgagtgctggaggctcacccaggcagagtgtgctccacttcgttccaggggactgagagaaatgaacccggggtgagacccagagccgtcccctcctgcagtccatctgggccaaaatgagagcccaaccagtggggagggaggggcagattcaggaaatagaaaaagtggaaggggctggttctggacagatgggaaaagggcaggtgagcgccaggaaagatctaggaaggtttttgggttttcagttcctgggccataactgagatggggtgcccaggaggaagggccagctggccaggaaagatggggtatgttcactggagctcctgtaaccacagcctgggtgactgaaaccacagggatgaattgtctcatggttctggaggttggaagtctgaggtcaaggtgttggcagtgggggggttcacactggggactgcagggagactctgttccaggcctgtctctccagctcccagtggcctgtaggcaatctttggcattccttgactgacagaagcatcacccagagctctgccttcatctttgtgtgaggtttgctccgagtgcatggctgtggccacatttcattcattcattcattcatttatttatttgagatggagtcttgctgtgtcgcccaggctggagtgcagtggcacgatctcggctcactgcagcctccgcccacacagattcaagtgattctcctgcctcagccacccaagtagctgggactacaggcacccgccaccacgcccggctaatctttgtatttttagtagagacggggtttcaccatgttggccaggctggtctcgaactcctgacttcaggtgatccatccgcctcagcctcccaaagtgctgggattataagcatgagccactgcacccggtcccatttcctctttttataagaatatcagtcctactggattagggcccaatctaatgacctcattttcagctgatgacttctgtaaagaccctacctctaaacaaggtcacactctgagatcctcagggtgatacttcaacatatgcatttgcagggacacacttcaaaggggagtcaggggtctgggctcgcctggtggcaggctctgcaggagatgagtctgagggtccaagaggaggtccagggagcgctctgcaagccaccagccccgaagatcactggcaccataggagcagggcaggatgggcgggggtggggagcagagagcagagcaagggcaaccacagaacctggggccacaccaccttctgagatgagccacatagcctggcactgagcctccttcacgtgctgaggccacatctgtgtgccatggagcctgtgagcccctggagggagaggctgtgcctgggaccctgcggattccccaacacatttgctgaacaagcagggcagggagagaaaggaaagtgaggtcgagacaaatattataaatatgaccatatccctgatggagaagaaagtcaagaaagagttcatgttgaaaggcaacacgggccagacacacctggtactcaggggccctgcagggttttacagcaaactgtggccacatgggggctgggaggggacagccaggaaagaggcacagtccccatctgaatttgactgagagactctttgaagccgtctgagatttccatatacgatttctattaatatttaaggcaagacgcatcccatcctccataacaacaccgtcttgaaagaagcctttgaactacttgaaaggtaaacccagcattattcttggattaagaactcttgttcattcaacaaatacagccccacgacgacatccctgaacaccagagccagaggtgccttggcatgtgcacgctgcctgcttctgcagcagtaggatgatgcgtgtgtggcctgttacgtcacaccgccagtgggtctgggcagtgtcccattgccaattgcgggaggagtccttcagggcacggatgaataatcatgctaagtaggataaataaaaactataaatagcctcaaatcagttcaggtcaagtactactgccaacgagctacggagaaggcattcgcttttcagatctttttgcagatccacattgaaggtagggaactctgtctttactcctgagagctcgtgttggaaggtactcatgagtgaagacagagttccctaccttcaagtttacagaggagacggggtgcacagtggaaaggaggggaaaaaaaccccacacgcatgaagaggaaagacaagtaggatgcaggcttggaggtggaggctcggcgggacggggagaaaaaaggacaagacccttccctagaagcgcttggtggacacagtgggtgcaaacgaccaagtggctggatggagggaagagagaccctcagatggagggaatagggggcccccatacagaggggccccccacagaccagagtcaggggcacacaggtccgtgagctacgtggaatgagagatgggtccctggaccacattacttccggctccctggtgtatctcctccacgttctggccacctgcgggtccctgttttcctccacactgaccacttgaaaactgatgggtggcaattttcacccctcattgtcctaagggtcgtgggggctgctttgcttggtgctggagtctggggccacagtggaacatggcattgattgctaagaggaagggaccccacgatgccctgtagagcccagctcctcggggcaggaggagcacatatccactgtctgccctctccccacactcatgacctccacctcccccagccccaaacattacaaaagctaaagacatcctgggcacctgtgagaaaggaagagcggaggtagttcccacgtccatcctggtgcctctgcctcccgggtggcgaccctcaggaaggtgaaacctgcagcttgggccctgcagtttatagaatgatatgtttgtggttccctaaaacaaagagccgttgccacagcaaccgtggcatcccagcactcagaggctattctcagacactaaacaatgagttttgcctttcaaatgcatttgatacaatttgcttggaaggcattaacatcctctgacaaaacccatgaggaagaggagggcaggtgagagctgacaaggtcgagacttgcagggcttccaggaatcacacccattcatgagacaggagggcccaacggccccagacactttcaataggcaaacaggaaatgggaaacagcagaggggaggcaggcaggatccctaaccttccaacagcagttccgtggaggaggaggggctgcccagaggtgaggcagttgggatccctaaccttctagcagtggtcccatgaaggaggagcggctgccacacaccctttcggggcttcttcaggagagacgttccacagtcccatctggggcagttctcttcttcagggtcactgcaaagatggcagcacaggccagagcccgcagcaaccacttaatccaccctgctcactctgcaaaggacattgagtgcgtcccctgctcacagccagccattgcttcctccatttaccattttttttttttttgccagttcatgaacaactttgctattgtttacaacgatctcatgggattagaataccaaacagtgatgccagtgagaagaccaaataaccttcattcctagcaccagcctcctgtcactagcacgctgggcaagctgccctcaaaaacagctcccgggcgtcagtgacaggaacacgtgtcatcaggaaaaaggcatgatgtaggcaggctgggggcagcatcccaatgcaaagtacatttttgaacagactaaagaacatgtgaacagtacacagaaattcctccatctagccatctatccatctacctatagatccatccattcatccatccatccatcttatctatcaatccatctatctaatctatcctatctatccatatccatctatccatatctatctaatctatctacctacctacctaatctgtccatccatccatccatatctatatactccatctatctatccattcacccatccagctatccctctaatctaatctaatccaatctaatctaatctaatctatctaatctatctaatctatttatatgtaatctatctatctatccatgatttatctatctatctaatctatctattgagacagggtctctgttacacacactggagtgcactggcccagccgtagctcactgtagcctacaactcctgaactcaagcaaccctcctgcctcagcctcctgagaagctggaactacaggcacatgcccttcctctgtatggcaaaattattttcattaacagtcatgtaataaccatcattttattgatttgtgcatcagttttaaaaccaaatattttgaaagaatgaatgtcaattttaaaggtattatccaaatccaataaaatagttcatgtaagcattgaaatctgcatatctgcatttactaaaaaaaaaaaaaaaaaaaaaaaattccaccttgtagttcacatccactgccgtttcaaattttaaacacagatgaaaactccgagtggctacctagaatgacagcactgaaggaacacgagttcactttgtctttatagttactgtgccctcatgtctgtttcaaatctaccgtgtaatagcaggaatggtgatcacagggcatggagaccaggccattccggaccctgcagacttcactccagtcaaaaggctgtagctaagcccactcatgcctgagaaccacatgtaactataacaggcttccccaagttaatgttcatacagaatatggtattcactaaaggatacattataaaaagatgctaatttgaagttcacagatacatttcaacagcaactgtagcaattgcttagatcttagaccaacgattgggggaaggagtattttatcattggcaatttttagaacggggggacatggtgatcattaaaagggaagggacatttagctggctttattgttatttggaattctctccagatgaagcaatagaagtgccctcctgttgcgtgtacctggggcagacagcgtcactcactccgcccccagtagagctctgctttcggaacatgatgataaagcattaatattgcatgtttggtgaaaccccgtctctactaaaaatacaaaaaaaaaattagccaggcgtggtggcaggcgcctgtagtcccagctactcaggaggctgaggcaggagaaaggcgtgaacccgggagtggaggttgcagtgagccgagattgcgccactgcactccagcctgggagacagagtgagactccgtctcaaacaacaacaacaacaacaacaacaacaacaacaacaaatattgcatgtctgggagctgggcatggtgactcacgcctgcaatcccaacactttgggaggccaaggcaagtggatcacttgaccctaggagaccagcctgggaaacacagtgaaagccccgtctctacaaaaatataaaaattagctgggtgtggtgacgcatacctgtggtcccagctacttggggggctgaagtgggaggattatttgagccctgggaggtcgagaccgcagttggcggtgaatgcactgctgcacaccagctggggtgacagagtgagacactgtttcaaaaaaaaaaaaaaaaagaggctggtcacagtggctcatgcctgtaatccaagcactttgggagcccgaggtgggcagatcacctgaggttgggagtttgagaccagcctgaccaacatggagaaaccccgtctctactaaaaatacagaattagccaggtgtggtggtgcatgcctgtaatcccagctacttgggaggctgaggcaggagaatcacttgaacccgggaggtggaggttgcagtgagccgagatcacaccattgcactccagcctgggcaacaagagtgaaactccatctcaaaaaaaaattatatatacatatatacacacacgtatatacataatatacacacatgtatatacataatacacacacacacatatagacacacacacacacacacacacacacacacacacttggctgggtgcggtggctcacgcctgtaatcccagcactttgggaggccgaggcgggcagatcacgaggtcaggagaggagaccatcctggctaacacggtgaaacctcatctctactaaaaatacaaaaaattagctgggcgtggtatcgggcacctatagtcccagctactcgggaggctgaggcaggaagatggcatgaacccgggaggcagagcttgcagtgagccaaggtcacgccactgcactccagcctgggtgatgagtgagactccgcctcaaaaaaaagaaaaaaaaagaaaaaaattatacacacacacacacacacacacgcacacacacacatgcatacacatgcatatattgcatgttgattcattaacggggaagctgaggttcagaggagtgtttcatccatgtgggctgcagcaggtgacaacacttctagggtctgtgcaagtgaaggcaggaaataacagggctgctgctgagcgcagagtcgagtctcgtgaaatgctctgagcaacggtggggtaggggatgttccatcagaaggggccagcatgctgaggcagagcgccctgtctagtggccactccaatactctggtcccgtgactgcctctcagcctgggccatctggacactggccaacaaagggcctcaccacctggaccttggagaattccacaagggactgagacccggtgagattctaacagctggaacacacacatggccctggtgagaaaggagtaactattgcttcctgtcccagccacacaatttcctcccatctcttcctcactgatatttttatttctcttcaggacacagaaaaagaatacggataatttataactaaaggagcaacaatggtgttctgaattattttcccctctttttggaacgcatcaacatgtaatttgtgccccgctcgctggataactctgagagcaggcaggtgttccgagggccccagccagggtcagggccaggaggcctgggcagagccctcaccctatgccgatggccagcctgtgacctcacataagccaagaggcttcctgggccggatttctatagtaaccggccactgggtctgccggcatacgtcgcctgactttctgctgttctattctttggcagaacacccttcccctgcctgctggctgcctggaactgaatgaagccaccgtgatttcagggagagatcccggctcctgccctccccaccagcttcagcagaactctgccctcttgggtcatgcatttcctttccttacttcaccagctctggttgtacacatccgagactccccaggactctaccaagggcctgatagaggggatagaacatgaacacctttggccactgtgattggttcaaggatggttgatacccaaagccatgtcattggctggactcctgaagctctggccagagcaacaaggagtaagaagcttacttactcaaggagtaaggctgaggccaagcagagggaagccaaatatagacacggatagacgggcacattctataaatattccctgcggagaaagtggctgtttctctcctgcaccaggaaagaacaggtctgaatagtcagcaattgactcaacaaatatttgtcaagcacctaccaggtggcagaagccatattggttgggtgtgctggggaaaagagaagacgttaacacctgcctttgtgcagcgtgagtccggcgaagaatgcagagaagcaggagggagagtcagcggttctgagaatggctcagccgccattgacttggcctcaggagcagggcactgggggtcccagacacaggaaggaaggtgtcgcctttatggccttcgctctgtggatgaagtcagcactgcagaaggctgccccatccacatctctcttacaaaaccaagccgcagctccctcctgctgagctgggatgcagatgaatattcatggagaactgggaattgggagttgatgaccaagtcattccaaaggcaggaccctgggaggacctcgacaaggtctagaccctaacactgggccacacctctcaatgcagccctaacttcccctccacatagaagggagaaaattcggaacaaacatacagggcatcatcacacgggaattccccatcctgctttctggagcaatttaccatattaattggctgtggctgatgctcagaaatcatggaaagccacgtttcaacccacaggaacccagggacctccctcgggctgcatggtgggtttggaccctgcctattaagccaatggtcttgcccaactcagggcaccaccatgacggccttcctcgggggtggtcttggacaggggactggcagaggactggaatgggatctgttcttatttttcagcctctacttgataaatgagtccatgagtttgccatgagaggtgaacttcctcctgctccatcaaaagggaccctgacaagctctctgctgcgctacccagggctcaaagcagctcccttcccactaactcctacgagcttgttccagggtcatgaatgaatgctgaacgattttggagaaggatctggtctaaggccaggaatgaggctgctccctgccctcacctccagctccagccagactctctgcccctccaggtcatgtgacttctcctttaccatctctcccccaggggacatcctgaagtctggtcctggggaaggaaaatgtttcctgaggctacgtatcttcctgaagctgcccccatcttggtggactccttggtcagggcagcccatgtgcccggtggtcctaaggacgagggtatactgatgcctccatctggcacctggatccacggagaattggggaccagaatcccatgaactgctgctgcttcattagctgtttaatgtgtcccttctggcttggctaaaagcaacagcacttaggtacatatgcgtacaagttcttccttttctgtctgaagcctccataacgtcttttcacttatgcttattagaaccagaattagaaacctttcctctgtgcaatttaattctacccagcatattcttatgaggctccgatatttgaaatcccaaaaggcacttcaagaaaggactctcgattctctgtctgaattcgggctcagctcaaaagagggtctcaaatgcagggagtggtgagggagagaggttgttatctgtggtggcttctgaggctcagagaggtgccgtggctggtccaagaccacacggaaaattccggattggaaccctcgtccctctgggatttggtcaaacgctttttcttcagctccaatacccaggtgcttttgcatattaacaaaaattaagatctctgtgactatttcctgactccaatgccagtggctagaaattcaggggttgaatcccttgccccaaaggccatgcggggcccccctcccaggcttatggaggatcgatgggctctgacagcaggacaccggcggtgggaccctctctcctggcaccagctgaatggggcctcggctggcttcctgcagttgcttccaggcctggagagccagggactccccagggaagggcacaagcaaggagtcagggaaagcggagtccacagggatcccaggcctctcccaggaatggtgacagagcttcctggcttttgagggtagccagatgtttctccgagtttcaggaccctgctgttgcaactgtgctgtgctgtggcccactcagtggtagatgctgtgcagctctccagtgcgaggcccaggggccggtgctgtgcctgccagggctccaagctccccggctagccttgggatagttagcccaggcaccccaatgtctatcccgagctcacctgctagcctgggcatagataacctgggcagcctgatgtctactctgagcttcctggttagcctgggtataaacagcacatgcaccctgatgtctatgaagccagccataactctaaatgtgaaaaggcaggtgcactaatcgggcatcctggtcgaaagaagggctgtggtcagctggggaggagaccgggcttcgggggctgctggaagagtctacgaagaaagttggggagatggatggaggtgcgctgagaaaaggaacaccctgaacagaggactgaaagatggggcagggacagctcctgcctgtgagctgcctggaaggggcttggaaaagagaaagccggagaggcaggtggagccattcagaattaggagcttctgagacttccattcaagtcacctggaagcgggcatgccccctctgtgaggccaggggcatgtgcccatggaacacagaagtcaagactcttctctgctcctcgcccacccctgggcttgtgccctatgctgggatggggagaccctgggctggggctggggaacacgatgtctgctcccatcagtctgtgtaccctcaccagaacctctgccccactgacgcatagattttccctccatagaacaaggaggactgaaggggctagggtcccagctgccacctgtggataggcatcctgagaggatagagctcccagggccatcagccacatttgctcaggtgcagaatctccaagggggatttctcgctgggtctgtgagtcatgagactaagcaggggttgccaagattcccaggaccctttcacattctgagtctgtgttccctggggtcaccaacttttgggcatcccaaccctgaacgacaattacttctggaagcaccttgagagtctttctttttgttaatagaaacagaatctctgtctgtcatccaggctgaagcaaagtggcccgatcatagctcattgcagccttgaactaccaggctcaagccatcttcccatttcagcctcctgagtggttgggattacaggcctgcaccaccacgcttggctaattattttattttctaaaatttttgtagagatgaagtctcaccatctcacccaggctggtcttgaactcctgggctcaagcaatcctccagtttcggcctcccaaagtacagggattacaggtgcgagccaccttgcctggccaagagtctttctacagcttcaccatgaagcaggtgggtgaatcaggggtacaagatagacacaaatcttaaaacaatggctaatggggttggttacagtgtcttatgtctgtaattcctgcactttgtgagactgaggtagaaggatgacttgagctcaggagtttaagactagcctgaacaatacagggagaccctgtctcaataataataatattaataataatattaataataataataataataataatagtaaactccagggggcttggattgtcctcttctgggtagatcccaataatctttctccccaggtggatgggtgagcacagagttctagaattccagagctcttttgagtatactagatcctttggctttaattttatttttttttaagagaccaggttttgctctgttgcccaggctacagtgccgtggccccatcatggctgtggctgctcactgcagcctcaaactcccaggctcaagtgatgctcccacctcagcctcctgcacccagcaaattatttatttattttttgtagagatagggtcttgctaagttgcccaggctggtctcaaactcctggcctcaaaggatcctcccagcccagcctcccaaagtcttgggattataggtgtgagccaccacacccagcctggatccttaaattcacttgcaggaagggaacccttgctagagaggcggaaaacatcagtgtgaattccccaagcccccagggggacacactgaggaccagggttaaagggtgactcactggcatgatgctggcaggtgagacaaacagcatggaggaggaggaggagggagggagtggggaaagggaaggaatgagcaagggagaaggaagtggaggagagaagaacgggtggctctgctcggcccattcaccaagtgtttccaggcctggtgagctccggggtgggacgggagaggggccactgcagtgtggaaggcaggcagaaaggcccctgggctgtgcctgtagctaggagctgggaaccagttctatagcctacaagcaagggatttaatacatatctcagagtgatggggaaattgattttccttgataaaatggcccagtgaaaaagatcatgacagaagctgccaaggattccttaccttggcagtatctggtcactgctgcaggctgacatgtgaccttgtcattaataggtcacagaacaggagcaggggccagctgggctagtctgtgcagaagcaggcttaggtcagaggtagggcagaccccaaaacttgcttgcaaaatcagccaggagcacaggggtgaggggtggcggtgcagggagaggacggtgatccccacggctttgctaaaaggcggcagtggcttatcctcatgtccacaggaaaggccacctctgtgccatctgtccacgctggcccagcatctgcgagcacaggaagccaagcggctggcctggtcctccaggagggcagaactgtgtggattttgcaggagtgaggggaggtcctgaggaaacagctgcaggtgaacagcaaactgcagggcaggcaggaggcaggtggaggtgagggcgggcttgcctgcggcctgtgggaggggagggcaggagccagggtcccagaggtcaaggtggcagagagagaagcagtgttatgggcagccttagcaggagtgaaggggcggctccggagtcagggctgtcggttccagccccagctgcatccccaccctggggacccttgtcaagtgtctgggctccaggatcctcatcctcctgcgccgaaaacggggcagtgaaggcgcctccctaacagggctgtcattaggattgagcactgagcactgagcccaggcctggctctgaaagggctgaaggcacaggagctatttttgctgctcagatcaaggcagcagttgcctcctcctctgggaagccatcctgactctatgccccattgggatttagcaccccctaatgctggcctcagccttcccaccctgatacctacggcaggtataacataaatgtcctccatctgtaggaaaccaacagccaaaagtccagctcctcagctatggcacaaagtcctggtccacctgacccctggacctggtgcagggcttccatgtggagaaatgacatgggcagggacaatccagaacctgacccgagcaggcaggaccagaccaagagaacaaagggggctgggaaagggggcagaggccacacaggactccgggagcccacctgagagggtgtgctgcggtgtggagcaggacagagcaaaactagggggcccgggaaagcccccagggtgcacctcaccaccctcctggacccacgccggaggcacagagaaggggtgggcaagaccacgtggaaacaagacccggcctccacctgggctaggacatgtgccctgaaagccaggcagggctggggaggcccaggcaaggggagaaggcgctgaggatgctggcagggcacggagggaacaccttacaagaggggaccaggaaggaggaatctgccttggtcatgaccttggtggtcttcagccctctgcaggagtcagagctgaggaaccagaggccaacctgctgggccagagtcctcggtctcagaagggtaggaacagagatctgcagggagccaggagcaggggtgggtggcgctcaggggcaagggaggaactttctgggagaatggatgcagagagcaagaggagaatgcaccagcccatgcttggctcaggccagtgcaccagggcacaccctgtgaatgcccgagtagtgtttcccaccaggctggcatccaccccaccagagagggctcggggctgtgataataacggggtcagggggtgcttctcacacgtggtgggcaggggccagacaggctaaagtcctgcaatgcgtggaacgggcccctagggattgtgagtgacctaccagatgttcagacaaatgcaaaatctgtttatctgcacaacctcctgcgtgttacttagaaacaccacacaaatctgcacagctttaatactccccgaattttccaggaatgcaatgaaagacagcatgggctttgtttggtttggaactttcctaagagctgttgactattttggaagccagccctgccttggaccacacccgacccatggctgagcatctcccagctgctggaggagctctggggttcatggtgaccggattggaagggaatgaccattgaaactgcactgggtcttctgggacagacctctccctgcctacggtgtccggtcccccccaccgagtgttcctgcttcatagaacagtgttcctgctttgtagaacacgatgggtatcttttcttttctttctttttttgagacgaagtctcgttcttgttgcccaggctggagtgcaatggcgcgatttcggctcactgcaacctccgcctcccaggttcaagcgattctcctgcctcaccctcccgagtagctgggattacaggcacgtgccaccatgcctggctaatttttgtatttttagtagagatggggtttcaccatgttggccaggctggtcttgaactcctgacctcaggcgatccacccacctcagcctaccaaagtgctgggattacaggcgtgagacactgcgcccagccaggggtcttttctaaattccacgtgtatgtcagggtatgttatctaagagtttcatttgaggataatgaaggagatgttatacaacactttttctaagagaactggggtctcgtgtggttgggaaccagggaacaaagtcatctcccgtaagtgccctgggagcgctgtatagaggggaaccgcgcagggaccgcatggtgagggtcaggctagggcacagtggagactctctgagcttctgcccttccgtgggggatggagtgggaaaggctcttctctaagggtgagaactgcccaggaccggggagcaaagagctgggagaagctcaggtttggggaagagttcaacccagaagacggaaggagtcgatctctgtgtgcaccatgggggatccgcagtgggacacacttcccagcagccacgtgtccactgtgtgggagtcagtgcggccagggactccgtgtcctccacccagtccccctgaacagtgctccatttggctgaagaggggacaggccgcagggcgggctccagtgagtaaaggggctgcgcaggaggcatggggcaagggtgtggacagaacgtggtaacgaacatcaacaaagacaaggcacacagagatgcatgctgggcaggagctccggcctcactgtcactgcagcatcccatcaggacaaaatccacaattgccccgggagcaccatgtacacagcattcggggcaggccacacaagacggctgatcctccagcggacactccctgggcgtcggtgctggaaatcggccaaatgtaaaaataccctcccaacccaacacgctggccacctgtggcccttacacaaagccggtcaccttggatcccatccccgccagtcaactccgctttacaatttggaacaaaacttctagacagatacgcacgggagaaagtaggaccacagcaacacgcacgtgaccgaccccttcagctgacatgaaaatgacaccaagcaagactccagagtggcagacgaacaacagagctggttatgtccggatgaaaccagcagcccggcatgcggagtcagcaccacacacacacagaccggaaaccacacgcagacttgcacagctcactcggtcccgcgaagagggacgagacaagacgcaggtcagtcccaacagacaggtcacagaggcggccgactgctcccatatgccttgaaactgctgtgtctgttgggggttttctgtccttcctctccggcaatttgttttgaaaatattctatgggaatctggtcaacagctgtgtgactgctgcagaacgctaagtaaaaatacaatcttgactttccttgggagggtttattcttaacatgcacaggaggggactcaataacggggaccccgaccactctgatctaatgaaatgaaataggtgaggatttggggttttccttggaagctgctggttctacttgcaaacacaaaggctattgtgattactgcagatcatcatttgtgtctcattggaaggagcacatttcacagtcaaaatgccaggtaaactgaaatttttcaaatcagatctattttatttcacagcaggtagtatctagcaaacaggtatatttttaaaggatcatggctcaaaatcagcctgaattttactttcacacacacaatcacacaatcacacacacacacacacacacacacccctaacatattacattaagcaatctgtttgaaaacaccaccctctattcatcatctatacatatctaaagcataattatacaggcacccggtcttgaaacctagcaacagtatccaagtattccttcgtcggctaatcaggcacccaaactcacacatcagctcaatgtgcctccttttaaaatataaaaacccctcgcttctctctccatagctgcggaaggacaagatgtatgaaaacaaaccttgttcggttgaggaagaacaacccatgtcatttaatccatctgacagtgcatctccccacaaagccgggcaaaagcaaaaacaacaaagaccgtaaaaaataggttatcccagtccaaagcttatcagctggcaacatgcttaatgtgtgcacgactgtttcagatgcgggctccccggcacccggacagtcttgctatttgggatctccatcccacagaagccatcgtccaggctctatggcaaagcttttataacctgctgggctcatttacttggccggctaaacactggacgacaacaagcaaggattaactgtggtattcacgtccacatttaaaccatcactttcttcgagttggcaaataaaatcaccaaacagaggtcccatttaatttttttttttttttaagaggaaggggacagaaacagcatcacagcatcagacaacagcaacatacatgctggccggattgtgaacagaacgcttcgcggcaggctgaaacctctcttttaaagagatacacttgaatccatttctgggttctacagacctcagagcacccattcatcacctcacagtgttcattgtcttctcccctaaagccacattccagcatcgtaagggcactgatttcctggcactgattgcttctgtgtttgggaaacaaaggatccctcctcagtagcagggaggccacttgatcctttaaagagactttttaaaggaaaacatcccattgaccaggctgtacacggcaagtcagaaaaatgtgtggtattttaatttacccactttgaagcaccaacatccaccccacacccacctctagcttggaatttgcttccaccagacccatattgagaagtgtgacccaaccccatagaggcaaaggtgagtctcacctccacttcttgacaggagaaagctctgcttgtgagcaccaagggtttgccctgacgccaaagcatgagccaacagcctcaggcttaagggacaggcctcgcttcatccatatgtctcctaagctaagttgtataagacaagtcttgctgaagaccataatgcagaaacgccatgattcctgaggttgacagagatagacaaatggcaggtgaagaatctagagtcctctggtgatcatctgacaccacccacccccacccaagaggccaggaacggacaaaagattcaccctgaggaagaaggactacagcagcaccctgaggttatggaggatatggggtggaggaagccaagccacagaacctagaatcaggaagccacatggccacccacgatctaaagcagaaatccagaaatccctggcttgaggactcacgacatcaaacccaacacagcccacttcctccaactgcctcctctcctctgtgcctctgagctcggctgctcctggactctgaaaatgttcgagtcagataaaacattgccctctcgcaaacacactcaatgcagcaactgatttgccaatatgtgtcccacccttgacactcaagaccgggtaccagggaaggcaggtttgaggtcaagaacagagagtagggccgagcgcggtggttcacacctgtaatcccaggactttgggtgaggctgaggtgggtggatcaccggaggtcaggagtttgagaccagcctgaccaacatggtgaaaccccatctctactaaaaatacaaaaattagctgggtgtggtggcaggtgcctgtaatcccagctactcgggaggctgaggcagcagaatcgcttgaacctgggaggtggaggttgaagtgaactgaaaccgctccactgtactccagcctgggcgacagagggagacgccatctcaaaaaaaaagaaaaaaaaaagagagaaagaggatgagagaaaggctgacttggagtgaacaagagctgggggaggagccatccatccaacatgcattgcctgaggccccaccacgtgcctagcacagtggggacggtagaatcagataccatctgtccttgaagaggtaacagcctgagaagacaaaagtcatgaagcaatgtgagttccctagagtgggtggaatggtggtcctcaaaaagatgggcccaagtcctaatccgtgggacctaaactgcaccctcatttggaaacagggtcttttcaggtgtgatgagttgaaggatctcaagatgagatcatcctggatttagggtagactctaaattcagagactggagtccgtataagggaaaggagtaggacctctgagatatacacaggggaagccatgtgaagacagaggcggaggctggggtgatgcatccacaagcccaggaacttcagaggcaaggaaggattcctcccttgggcctgcagagggaaccagccctgccaacaccttgattttggacttctggccttcaaaacagggagacagtcaattccagttgcttaaagccacacagttggtggtcatttgttgtggcagccccgggaaccgggtacacagcccatccctgggtcctgagcaggcccacgaaagatgtggatgagcagaaacgcctggcaggtcctgagaagcaaaggaggagctggtgctgggacgtccggcatgagaaccaccagcgggatttgaaaccgcagttccagaggaaccctcgaccactgagtcagactctgatggtggcgctgggcatctgcattccacacaagttccccaagggactcagatgcaccccaaatcatacaggccgctgggcagcgggggcctcagtgggtaggagagggttagggcaggcgagtcaagatgacagtcaggaccaggaccaggaccaggagtggggtggttcagaagctgtcttaggggcggatgccagcaacatagaaggctcctgggaatggaggatggagagagagcagaggaggcagacgcagctggaagactggggccaggacatgggggagtaggagctgcaacagccagagaagcaacgtgtgtggaaaagcctgttttcctgagcgggtgtggtgtgtgctcccattaaacagcaacagattagtagctcactccacctaggaagggtgcacaggatccaccatccttcaaacatcacttttagatctggggggtagaaggggacagagggacattatcttccatggtcatcccctcccccaaagggcctgggacatgcaaatatttctgaatctccaaattagcacagggtctgtgaaaaaggtgctcaatgaagacttgtcaccaggctgggcgtggtggctcatgcttgtaatgccaacactttgggaggccgaggcaggcagatcacctgaggtcaggagttcaagaccagcctggccaatatggtgaaaccccgtctctactaagaatagaaaaaattgggccaggcccagtagctcatgcctgtaatcccagcactttgggaggctgaggcatgtggatgatgaagtcaagagattgagatcaaactggcgaacatggtgaaaccctgtctctactaaaaaaaaaaacaaaaaaaacaaaaaaaacaaaaaaacagaggccaggcatggtggctcaggcctgtaatcccagtactttgggaggctgaggcgggcggatcacctgtggttcagagtttgagaccagcctgaccatcatggagaaaccccatctctactaaaaacacaaaactagccgggtatggtagcgcgtgcctgtaatcctacctactcgggaggctgaggcaggagaatcgcttgaacccaggaggcagaggctgcagtgagccaagatcgcaccactgcattccagccagggcagcaagagtgaaactgtctcaaaaaaaaaaaaaaaaattagctgggcatggtggcaggcgcctgtaatcacagctactcagggggctgaggcaggagaatcgcttgaacccgggaggcggaggttgcaatgagccaagatcgtgccactgcactccagcctgggtgacagagtgatagactccgcctcaaaaaaaaaaaaaagagttgtcacgggaagatggtgaccacataggtgtttgagctggtgagagtgcaggcatcttcaggacctgccatttcaggtacctgacatgtgcaagtacagcctgggagaaaggatgcctctcctctagcacaggcagtctgccttcctcagcgtatgcgggctcctctctagacgggaagagactggggccatatcgtcctgctcagttggtggcaacaaccaccaacggagtggctgaaaaccaccagaggccgggcacggtggctcacgcctgtaatcccagcactttgggaggccgaggcgggcagatcacgaggtcaggagatcaagaccacagcgaaaccccatctctactaaagatacaaaaaagtagccgggggtggtggcgggcgcccgtagtcccagctactccggaggctgaggcaagagaatggcgtgaacccgggaggcggagcttgcagtgagccgagatcgcgccactgcactccagcctgggtgacagagcaagactctgtcttaaaaaacaaaaacaaaaacaaaaaaacaccagaatttactatctcatagttctgaaggccagaagtccaaaatcgatgtgttggcagggctggttccttctgctggtgctctgggtggacagcctccaaggtctcatagttggaattctttcattctgtgatcccacagaggtgactatgcagcaccaaaagcgtgtcctcctccctccctctctcggtctccatcccccagggtagagggccaggctgcacctcccctctgaaggtctcctgggtgaccatgatggaccctcaccctgacactgctaagagcattctgggaaggagcatcccagtgacaattgaaaatttcatggtgggtgagaaatgccacagaagacattcctctttgaaatgttaatgtggaaggtggaggaatctaggctttgcagagaaaacaacagattctgtgggtgagaagttactctgagccccggctgaggacaggggtggccaggaccagttctgactaaaacatgatgtctctcgaaagctcagaagatgagcacctcaagccaccctcgtgagagaccactgtgagctacaaaggcttccctcgggggctgccaggcagcaccgtcacaccgtcatgaggctggcaccttagtccatcagtccatccattctcagacaactctctccagccgccaggctccaccccatgcggtcttaagcatcatcttcctccagccctaccctgccttctaagcacagctggggagctggctaggagctgacaaatgcttagctctagtaatcctagagcgagggagcctggatgaggaagcagagaggagatacccctctaactatggtgggggggactgccctgttggtgatctgtggcccaggaagcctcctcttccctctggccaccttcccagctctggttctaggtccagcctctatgaagcctccccagcctgccccatcccagtccacactgatgcctgcagctcttgtatggtggaaggtttttctcagcttcaacaaggaggcagcagcatgtggtggttgaaaggacaggttctcaaggtaagtacttcagcatcagatggacatggggttgaaatctggtttgcccaattcctccagcatgtggctctggaaaagtcctgaatttaagatgtcatcggtgccctgcctgcatctccttggcactcactgttcccaggtatgtgcactgcttacccccacaggcccctgcaattccccaaatccctgatgggggtcttggtacccagagggagcacgcataggagctggaactggtgggtaaatacatgaactgcttcataatgaccaggcacaccctctgcaggttcccagaggaccccaggggcctgagcctccggggcccacagagtcaactgctcatgaacacatgtgtacagctggtgccctgcccttccctgacttccttccctaagtccctgctggtgcttcctgtatctcctccacaataaacaacttgtcctcaaatcctcacctcaaggtcagcttctaggggagccccaccccaaatgccatgtcgcctaggctcttctacacatggagaccacaactgcatctggacgtggaggtttgcatggctgtgatgctgtacgtgaagtgctggcctgtagtacttggtaagtgctaactgttttcactgtggttactcattcattcacccagaagttgggcagctttcttaaacaatgggcaaagacccgcatgcaggagttagcaagacacatgcaggcaaaaaacgcacaagctagtggggaagagagtatgagaccctccccaccacatacccagcacctggcccctgccagaggggcgatgcaaagtgggggtgaccacaggggagggggagaagcaattgggttccaacctacaggtttagttaagaaggcattagttcaggatttcacaacagattcactgtgcttggatcaatcaacacattgagagatgtcaggttcctagaggactcagcctccacacccttcatctctctctgcgggaaactttcaacacaattgatctaaatggcacagtttttgttgatgccagtttgctagttcataatcacgaacccttagatgactcagatgaaacaagaggttttttttcttcttcttctttgtagatgcacaaggaaccgcatgggcaagtatagattttctaaactatcctttccctttggggccctgggaaagcccaaaaatcagggaacaacagacactgactccctgcgtaagctgattgtaaaagccagtcctgcttctttcctgcaggactggggattttacaaacatacggacatgagagactcaaacctcgatcctggcacttcaaaatatgttagtcacgtgagcctgtggtgggtgcccccctctctcaatggggggtgctgtttacagttaacaattgatcagaacaggtaaagggtaattaaaatgtattcgcccaacaaatgggcattccttttataataatgaaaaaaacctctctgttcgtaaagagttgtctgcatcataaataagaaaggtattcataattatatcccaaaactgaaaagacaacaagtgtctcccaaggtggattgtgaaatcaactcggtgcttcaacgtacttggaaagtcagcctggtttttgttttgttttgtttttgtttttgttttgagacagagtttagctcttgttgcccaggctgtagtgcagtctcggctcactgcaacctctgcctcccgggttcaagcgattctcctgcctcagcctcccgagtagctgggattaccggtgcctgccaccacacccagctaatttttgtatttttagtagagacagggtttcctatgttggccaggctggtttcaaactcctgacctcagatgatccacccaccttggcctcccaaagtgctaggattacaggcgtgagacaccgcgcctggcccctcctgtttttgagtaggggggtttagtggctggaccttaccttctcagaagggaggaagggtggctgtgactccatggggcaagacttagggtcaggggtagcagccccaatatctctcagctccatgtggagagctgggataaggaagccacttcaccccttcctctttgcagtgcaggccccagtgagggtagcccaatggggtagcccttagcttgttaccatcccagacaactcaggatctgtggagctggcgggggctctgcctccaggggtgccagcaacaacccctgtcgtcatgggcgggacctgtgctcagactcccttacctcccttcttcactgtgtgcccctggtcaagagagtcccactcccttcacagcagccgatatttttagctctcaaaccaaagctatcctgtgtgctgctctttcatattagggaggcagcaggaagacggtctctggcactctgagagctcagttcattttctaaatcattttgcagacattaactcatcaatctctataacgcgctcatggaggtgctgaggcagccctggcagaaccctggatctcagagcaattaagtgatttgccctggctcacaggagggatgtgcaagtcagtgtcaggcgcagcctttgggaggccccgaggctctgcacaggtgcttgatgacgcaagccatgcatctggctctgcatcctcgtgcggttctccaaggcggggtaggtaccggccgtggttgacgtagggcacacatgccacacggtaaagcctcgacagccaaacacagttctgctttccctgatgccaaaaatgaggtgacgggcacaggcaataaacgacacccaggagcacccccctgacccctttgatggggtgatgccatcttcgaaagctcaccactgccggtccaatgggactgctccccgctgcaggtcctgtggaagcgcggggctggaggaaacaggccagtgggctcgtccaagttgcaagactgggcccagccgatggcagggcgatgggagagaggaggagccccaaagactctcctcctggttggcacaaggggtactaaaaaggggaatggccatcagcacaactgcggaggaagtgaagcagaggcaaccagaggggagccgagaggatgccactggctctctctccaccctcatcgggtcaccagctctttgcctaaatagaagcgtggatgctacggcaccttccaataaacacatccaaatcagctgcaaattaatttgtttcagcaatcaagagccgtgccctacatccattgcttgatgcttagcacattctccagtttgatttcttttctttttagatttttaaaaaagatgtcatatttttagagcagttttaggttcacagtaaaaccaagcagaaggaatagagcttacccagagagcccctgcccctcacgtgcagtctccccagtcatcaacacccccctggagtgggccatttgttacaactgagagcctacagtgtcactcgaagtccatagtttacattagggttcactcttgggcttgtacattctaccagtttggacaaatgcgtaacgacatgtatcaatttttatcattaatggggaaaatcagatacatacatcagatagggaatcctagagccaacccttagcataaattaaacacttcctgttcctctccccattttactaaatcaatgatgttcacatggaaagaaaccttgcaacagggactgtcagaatagatcagaacatcatccttctagagaggcatgtttcagacagcctaacctctaaggtcttccttagccccatccccactataagttaaaaaaagttaagaccagagacagaaaatgggctaatactatgttaagttttgctaaaagcaggctctaaaccaatcttaggagaattttaaaaagctggtgagtgactgattcctcagagcatctccaaaccaaatcccaacacagtttctccacgtgcctactcaccaatgtctgtttccttgtggttcttgatgtattctgccagctcaaagttgcctgctattatggccacctgcaaagtgaaaatcacattaagttaagtgtcacctgcagaacaatgatttctgcatatactattacatcattgaaggcctaacaccaaaagaagtccaatcagaacctttaaaatggcagccgcaatatcaacactcatccactcaccttgccaaccaccacactcacttctctcaaagcagttggctgttctatgatgataaggttgtcgttgctctacaacctatatgagtgggggcctctgtccagaaggcatgtggggcaaattacccatagagcagctgaggattcaaccaggcctgagtctggaaatctccccattgactatgtcctgtgtacccacggggcttgattggttccagctctgacaccccggagccctgtttatctgattagatgcatgccaatctacataactggaaagaaggggaaacctcaaaaaaagcatttaaaactcatcagatttcagttatgtgggaaaaattctacccatagatgtatgcacagccagatgagtggcaccaaaaccatcacctacaggaaattgttccaactccggccctacagatctgttgcctaaagatgcatgatctttgatatgggagagcagtcaggcaggtaaagccaagtatcctaggatggccatggagacccataaggaaggccaggaccagagaccacacgggcaaggcacacagtgcctcagaaggagagaccttgggctcagggcaatacatataacccacaaaaggagccaggcattcagatgccagcctggagaaatacacatacatctacaatgcgctgatgtcaagtcataatgtaagtggaccttatccaaacagctgggggccttatgagcagaaattgaggtttcctatggaagaagtctttccttaggactaaggcatcaactcctgcctgagtttccagccttacctactgatttcaaattggccaacctcataattatatgagccaattctttacaacaaattataaacaaatgcagactttagtgccaggagtggggtgtggctataacaaatatctataacatcttcccaacatgggcttacttcatttgtttaatttaaatcaacctttcttcttgtgtgtatgaggtgatctggtaaggtagggtgggtgatttttggttttgtgttttttcttccttacttagggcatctgtaggcctcaaaggacctttcctttaggtcatattcctcagaaagtcttcgctcttcagtttttattttttcttaaagaatatttttaaagctcaaatttgtgtaataatttgggactttatttagaattattggctgctggcagcagcaggctattctgaaatgtctcataatatacatatacacacacacacacacacacttttttttttcttttttttttggcagggtcttgttctgtcatccaggctggagtgcagtgatgtgatcttggctcactgcaatctctgcctcccaggctcaagtgattcttgtgcctcagcctcctgagtatctggaattacaggcatgtgccaccatgtctggctaattaaaaaaaaatttttttttttggtagagacagggtttcaccatgttggccaggatggtctcaaactcttggcctcaagtgatcagcctgcctcccaaagtgctgagattacaggcatgagccactgtgcctggccaaatatatacacacacgcacacacacacacacacacacacacacacatatatatatgtgtatatatatatatgtatacatttaataaatatggtgttggtgaaaaaaaccaaatatctaaaaatattatggaaatgctttggaactgggtaatgattacaggctggaagagttttgaggtgcatgctagaaatatgaatgttagaatgattctgctgagatatcagatggagatgaagaacacgttactggaaactggaggaaaagtgatgctcgttctaaagtggcaaagaacttggctcaactgtgttctagtatttttgtggaaggtagactgtgtgagcgataaaatcagatatttagctgaagagatttctaagcaaagtgctgaaggagcagctggatcctcctgactgcttatagtaaaatgcaaaaggagagaaatgaatcgaagaaggaattgttaagcaaaaaggaagcagagcttgaagatttggaagattctcagtctatccatacggcaaaaagtgaaaaagcctaaccacattgcaacaaaacgaacactgagggtatggctggaacatcacttgataatgtatgggattataaaagcaggaactctgccagtttgaatggaaggtgatggagataagacaaatgaaagaagactatcggacttaatggatttgacagaagagggtaacagagctgtctggtcacaaatgtgtgctactcttcaggaagaaggcaaaataaccctgaaaggaattcagagatcatcagatccaccccttggtttcaacagttagatggtctctgcccaaagacttacgggcaggaccacagggcagagctgtgaggtgagatggtttgtgtgtgtccccatccaaatcttatcttgaattataatccccatgatccccatgtgtcgagggagggacccggcgggaggtaactgaatcacgggggtggtttccccgtgctgttctcgtgatagtgagtgagttctcatgagatctgacggttttataagtgtctggcatttcccctgctgacactcattctctctcctgccaccctgtgaagaggtgccttatgtcatgactgtaagattcctgagggctccccagccatgcggaactgtgtatcgattaaacctcttttctttataaatcacccagtctcaggtatttcttcatagcagtgtgagaatggactaagatgtgggggaagcctcctgagtggcggcttcccttgggcatgaaggtagaaaaggtggctttagagataagcatgtctccaggccacattcagagagtcagaagctgaggtgccgtcctcccaaaagggggccatctcttcctatagcccacctccaactcagctttgggaactcgacttaggtgatgtggacccatgccctggtctgctcaggctgagccagacatgtccttctccaggtccctgatggttgtgctggctcaggatggcactaggcctccctgcccacaggcccaggcatctctcctgcactcctacagaccagcccttgccgaatgcctgaggtgatactggcggactggcggagggatgcggccccagaggtggagggcatgggctctggcctgggctgcctgggtgtaaatccagactggtactatgtgacactgggcattacgtgtaacccacaaacctaggttttctcacctgtgaaataggtttggtgtgtggatttattgagatctcacaagtaaaggtttagagcagtgcgtggcacatggccaatcaaccctaaaaaactatgctatgggccaggcgctgcggctcacacctgtaatactagcactttgggaggctgaggcaggcggatcactaggtcaagagatggagaccatcctggccaacatggtgaaatcccatctctactaaaaatacaaaaattagctgggcgtggtagcatgcacctgtagtctcagctattcgggaagctgaggcaggagaatcacttgaacctgggaggtggagactgcagtgagccaagatcgtgccactgcactccagctcggtgacacagcgagactcggtgtcaaaaaaaaaaaaaagtttgctatgattagaaaaatgatgactatgtcttcaaacactgcagactgctctttgtaaaggtaatccacccccaggtcacccagcgccccacaaaaatgcgcagtcagatacacacaagtgcacacccacatctgcactggaacacacacctaggacagctgctgaaataacacgtacgtggaccatcccctagtgattccgggattctccttccaaagaaaagccctaggagcttaagcccaggcacctccctgctggtctaaaggactcaactcacagtgcaaatgagaacaatgcaaacatttacttgtgataattgcctgactgtttctccccttgatgatttcaaggcctagaaattcctcttggcagaaagcagcctcctgcctgtcctctggcactgcccgccctatgcttggcttatcatgggttcccagtaaaagtcttctgggagaaggaagagggaactgggtcttatgtgacatctcagcattgctcagtgtcaggctggtgtcaggctcagcattgctggtgtcaggctgctggtctgggtgcatgaggaaggcagagtgtggggtctgtctctgtggctgcaggtgtgcacagcagtgaaaagaatactcacagcagagacacagccgaggctcaggtgccacacgctgctctgagtgagttcccaggagcgacctcttttgatcttaacagctctatgaagtgggcaccattatctctactcgacagagggggaaactgaggcacagagcgataaggaacgggctccacatcacagtcagcaccaaagtcaagacattcactcaagccgtttgggttcaaactcttcatctaatcaccttagcttataatatgctgtcattttcatggactatggcatttttttaaaaagttatgatataatcacaggtcaaacacctttgtaaaaaatagaagcataagaaacaacaaatgacaaattattctcgagggttatgacaagccacactcaggctgggcacccacagaatcttctatggtgaaaagtgccctgcgcaggggaaggactagtcctgtaagaacggacgctgctttgtccaggtttttcagagccctagaggcctggaggggagccagtgaagaaatgagaactctgctctctacagctcgcctgtttttcccccattaattcaactgtcctcctccttccttgtttcaaataacatttcggtaatacagacagatgcctacctgcagggtacggccataatgcaaccttgagggggaaatgttagggtttaaagaaacccagagcaggaaggagccccttacccccacaggatgtagagagacttcctgtcgcctccctctgcaagccatcgccagctttggagtacccggagaaggagcacctggtggaggttacagctcaggcaaaggtttggaggatggatgtcagacgtggtgaatgtggcagcaagacaggcaagatggatgtgtggtgggaggaaggtcagaggtcagcacagaaggcatcgactggtaagtcatgggaggaatccacatgtgaagccaagggaaccctggcttctgcggctaggaggtgacaagaaaccatggccttgggaggcatctggggacagaccatacgagggagccctgaaaaacagcaacaggcaagatgtctccatggcccggggcccggctggcactcttggacagacaggaggctgggagaattcagacgatgggcagccagttctgtgccatgccactggacagcagagcagcaggcggccacccgggcagtgtcactgcaccacactgggcatttgtatgagacgcctcactggcattctaaatcatcctaattctcacttccgtatctgctggctgggaaggaggaaggccttttatggacatttaaacaagagttatgtaacacaaagcaacagtctgtgtttctcttctgtggatctcaaaggaaagggaggggcggggcctccagggaagatgcagagggcatcctccctcgctggcctctcagccaagtgtgcggccgaggtcccagcccctgccgcctccccacctgtctccctcagagctgggatttctcgctgtgcccttgggggctgcctctcagggggctccccttagctcttgccccaagacagagctagcatcactttctggagcctttgctgtgaccttatgattgacatcctgcatttgaagtgtgatctacagttccaggcggcatcgatggctgaagttttgtgtgatgagggcaccacaggattttttttgtgggaatcacccccagttgtaagtcctcagtgccctaaactgggttttcctggaatgaagcaatcatatctgagatgggaaccttttgctggtgctgacaaagccccctgcaagagttggcactgggattaacaagtagaggaaagcagatggacaccccgccaggggccctgggggctctgcccttggcactcagagccacagggtcccctacagatgcaggaatgtcaggagggagcccacattttttttcaacagcagtcactctgcaaggcagtgcatctctccaggagacagcacggcccccctccactgatctaccagctgggggagaagggggagtttccatctattctcccaactcaagaattgacaaccatctcctccttagcacctcaagtgcttacacctaacattaagttagccggctggactcagtggctcatgcctgtaatcccagcactttgggaagctgaggtgagtggatcacctgaggtcaggagttcgagactagccttcccaacacggtgaatccccgtctttactaaaaatacaaaaattagctgtgcgtggtggctggcacctgtaatcccagctactcgggagtccgaggcaaaagaattgcttgaacccgggaggcggaggttgcagtgagctgagattgcaccactgcactccaggctgggtgacagagcaagactctgtctcaaaataaaataaagtaaataaaataaaataaaataaaataaaataaaataaaataaaataaaataaaataaaataaaatagcattatcttagcctcaagctttgaagcacatctttgaagcctataatatgacaatcacagcccactaggacttaggatcacagaaagactggggactcgatccatcacactcatcattggcaagcgtcattgggaaagacagtagaggcacccagggcttgtccacgaggggctggggtcccggggctcgaggttggttcagacccctgccacatactctgtgcatgaccactggctggaagccccgacttgtgaagccctgttgtctcttctgccacatgcattgcaacaccgcagagacttcctgtcccctctcttcttaagccattgtccagctttgcagtaccaggagaaggtgctgtgtgccagatgcaaagccccgcaaagctggtgaaaatgccacctgcacatcttcctagagccctgagctctgccaaaccccaaaccctccttctccccgaaatgccccactttgatgctgtgtaagcaggtaaggcccattccaggagcagcaccccaaattcccagcacagaccctcgacctggtgcttcctccaaacccctaatctgtattaaattaggcagcccctgctatccacccagtccttgcacccaccccatcaaggacacctgtagacttcatgggggcacttgttcctcgcttggtgttgcctgccccacaaactcagaaacaaaccactcaagtagtaagtggtgagaaggatcagactgccacaaggtgggtgcctggaaattatctgagtctcatgccaaaggacagtgctcggtgcccacagggcccgagcgtgttcaggaggtgcaggcaggctgggggctggtgagcacagcaggtaaagctacatgctcaggtcccgcaggtggcgtggactgcaatcccatgccatcacctaaaaagctgcaccctcagcctctgaggaacttaaagaccaacacgggtgacatggcttggctctatgtccccacccaaatctcatctcatagctcccataattcccactgttgtgggagggacccggtgggagatctgatgggtttttttttttttttttaatggagtctaactctgtcacccaggctggagtgcagtggtacaatctcagctcactgcaacctccacctcccaggttcaagtgattctcctgcctcagcctcctgagtagctgggattacaggtgcctgccaccacacctggctaatttttctagttttagtagagatggggtttcaccatgttaggcaggctggtctcgaactcctgacctcaagtaatctgcccacgtcagcctcccaaagtgctgggagtacaggcatgagccatcgtgcccagtcaatccgatcgttttaaaaaggggagtttctccgcacaagctctctttgcctgccgccatccatgtaagatgtgacttgcccctccttgccttccaccagtattgtgaggcctccccagccatgtagaactgtaagtccattaaacctttttcttcccagtctcaggtatgtctttatcggcagcgtgaaaatggactaatacagtggggaaatgggaggaacagcctgggtgctcttaggcatggcatggtctcaggatggtggaaggtggagtggggtggtgccaggagcaaggacagccccacagggactcagtacctggacaggcttgatggtgggaaatgagccagccagacaggcaggtgaggaggacctggggctgtctggttggtcctcgccacagttctctgaggatctgaattccactgctcctattatatcaggcaacccctttcaagacagctccctagacagctccagcactgtgtgcaaaatacctccctgggctcaagacgcccacccgcacacccttcactgaacaccacaaagtgccgcatcctataccacctagcactgaacttggcctgctgtgatgctcttcctgcttcatgtaagcctgcattctgaatgacgaaatgactctccctgagcccagtggccgtgcggatttctgccatggtctggatatttgaggccccctccgaattcatgtgttgaaatggaagccccagtgtgagggtgttaggagctggggcctttgggaggtaatgaggtcatgagggtggagccctcataaatgagattagtgcccttggaaaagaggctgcagagagagcctcaccccttccgccatgtgaggacacagcaagaagaccaccatccaggaagtgggccctcatcagacagcccatctgctggcccttgatcttgaactcacagcctctggagctataacagatccatgcctattgtttataagccaccacccagtttatgtttttttttttttttttttttttttgagacggagtttcgctcttgtcgcccaggcttgagtgcagtggcacgatctccagtcactgcagcctctgcctcctgggttcaagcgattctcctgcctcagcctcctatgtagctgggattacaggcacatgccaccatgcccggctaattttttgtatttttagtagagacagggtttcaccatgctggccaggctgatctcaaactcctgacctcaagtgatctgccggcctaggcctcccaaagtgctgggatcacaggattgcacccagctcattttatggtattttgtgatgtgacagcctgaacagacaaagacagcgcccagcctgttgcacctgtcacccaggccagccccaggctccgacaaggtgccacaaagccctgccttcctgctcagggctgggacatgggcagcacatgcgaatgctcttcacagtggtgagggcgccatggagcgggactgtcgcctttgagtgtggctctcaggtggccagggccctggagaggctgtggacttgctgcagtgcccacagtgtgacctgttccctgacgccaagaggtagagcccaggcgagggtggaggccacctctctcctcatcacttgctcaacaagctcctgggatccacagccagaactcggaggaaagccactccaccgccccgacgaagcctccttctcttgccaaaacgaaatgtgcctcccgacacagagagctatttagaggcggctctgtgatcctgacaccccctcgccataactggaaaatggcttctcggaaaggcacgagagaaaccgagcacttgggatgtccccgtctttgtttccttccagataatggtgcttcatttatttcagactcctgtggcaactcaggaagccactgatgcccaaagaccccagggcctggtaagaatgttttaattacaggcatcctccaagcacggcagggagtgggcctgggctcctggctcaccaaggtcaggggtcgccgagttcccctgcaaacttcaagggaatctctgcccatccccaggctaaaacccagaatctggagaggcagttgaggcctatgtcgttccagaacagctccctggggctttgcgaaaaccccatgcagggccagggcctttgcaaatcgatgtgtattacccagaagcccctggttgctccgggactttacatctaacttgacagggctgaccagatagagccagggctgactcaagcaatgtccacaactcctgaagtgccggctcaggggagtcgtgggccaggacccccggccagaggaagcagctggggactgggaagctattgtaggagcagttccatgctgggtgacccagtgagcctcccaggttagaggaagaccctgagcatttgagtaagacttgcctgggtctcgtctgccagtatccccagaggctggggatgaaacagcccctcagtcccacagaaggtggagcaggtccagccctcagcacccctcccatggctgagtgaaggggaccccctgggttgtggccagatttcactcaggtagcactgtgcggtggtcaggaccacaggcttggacgttggacagccccagagggagccttctagcaccgataccaaagacaacctccccccttctcaggctcctgaaactgagaataagaataaaagtatgattcttctatgactatcatgagaattaaaatagttaattagcaaataataattggcaaatgacttaaaatagcgccattcagtatcaccaaattgaatgcagagatccatatattaaggagatgatatcatggctaggtgagtttattttagaaataagaaaattgacaaatataattcatcgcattagcagataagcaggggaaatctacataatcatctttgacagttgcaggatcggattttggataaatattttatcaagacacatcggatatgacaacatagattcatgataaaacttaatagactgggtcagacatgaaggctcatgcctgtaatcccaacaatttcggaggtagaggcaggcagatcacttaaggtcaagagttcgagaccagtctggccaacatagcaaaacccatctccaccaaaaatacaaaaactagccaggcatggtggcacgaacctgtaatcccagctacttgggaggctgaggcaggagaatcgcttgaacccgggaagtggaggttgcagtgagccgggatcgtgccattgcactctgcgcaacagagtgagagtccatctcaaaaaaaaagaaaaaaaaaatcttaataaactgggaagaaaagtgaactttgcctgctagtgcagcagtgaaacagattgttgcttaagagaccaccctaaaactaagggctgcatgggtctgaggactgccactctggactccctcacgtgactgcgtttaagtggagggtcagcctggctggcacacgcaggatggcctcacatgggcctcgctgttggctggaacacatctgttttcttccatgcatcctcccatcccccagcagaccaggctggcttccttacacggtgtcctcaggacagtgctccacatagacagcatgtcaagctgccaaggagggaaacagactccgcctgtgcatgggagtggctgcacttttcttcctgccacagtttcattctgcgattttgccatgactgcagctcagacatggtcatggggatctgcaggtgttctgggtgaccttctggttgaccttgtccttttggtcctgggatcgagcagaagctccgaaggctgcacagcaacctgggattcggaccaggcctccagagctgcaccgacattggcaagttacctcccagggatgctggggttcagcaccaaggtgactgtaattacaagggaaatgctgaaccaggggttggcggtgggggatcatatatgaggaggaaaaccactttcagcgtttgaaagtttctgacctaatcaacatcaacgtcaaaccgcgacccaactgatctacctccatttagtcgttcagtttccagccaagatgttgaaacgtcagccaggggaaaaactggccacctccttggaggaggccacatccccttacccctcttagggtagaagagaccttctgggcagtattatcctctgtcctgtgaaatacgtatggcagtcaagggaataaaaacctcgaaaaacatcagcgtgtaagtttaacaaacacacaaaagaatgggaaataattctttcatgtggaccaaatgcaacctccctctcccagaaggatttgccaataaaatgtaaatttttcctttgaaatagcaatggcattgaaggacatcatttgctcccagaaatcttgatagaaaagcaacagttctttgatgtttgcagaggaatgattttcaagagtgactctggtgggaccctggggctagaaaggcgtgagcccacagggcagttagacttttctacttggcctccaggaaccctagactcacggcacagaatgagggaggctgagtctagtgagaagaggagatttctggggattacagatgttgctaggctggctttcctgtgctgtaatgatgaggagagtgatcaagctgatcataatgataactacccatgtttacccaacacgacacgcagcccagcatctaaatacagtctctaaattccaccctcacggcatgccttgaggaagtagagctgtcgtgatccttgttctgcacatcagacaacaggtttcgagagctcaaatgagtgagatttcttcattgcataaaggaaggccctgtccattcgattccaaagcctaggagaaggcaggcattacacacatggctttgtgtggctctaactacagaaagttctcttgcacagcagcccaggcacagcctccctgcttaaaaaaggcaagagggagattagcaacgagatttggttccaaagcaagaattgaacaccattttctgcaggacagtaaccaaagaaagaaatcatggctgacaacggggtacgcttgcgtatgagtttgatcaggctgccatcactaagcaccacagaccgggctgcttaagccacagacacttatcatttcactgtcctggaggctggagtctgagatcaaggcatcgcagggctaggtcctcctgaggcctgtctccttggcttgcactgggccgccttctctctgtgtcctcacaccgtggtccctctctgtgtgtctgtgtcctcatctcctcttcctatagggacactggtcatatcagattagggcccagcctagtgacctcaatttaacttaattacctcttcaaaggtcccatctccaactacagtcacattcagaggtactgaggattagggcttcaatgcaggaatttagggggacaccactcaacccagaacaacttgcttagcacaagagtacgcagaatctctttgccttcctcagggacacctagggtcccccgcaaacacccaggtcagaggtgtctgaggcctgcacaaggcttgagaatctctcccctcacgtggtctgttttcagggagcagagggtgggaagaggctaccgcacactcgattgtcacagatggacacacaggagcagaagcaatcactgcctctcccatccccatgattcggttatgaaaagtgtcacacccaccgaaaaagttgaaagaataggctgggtgtggtggctcacacctgtaatcccagcacactgagaggctgaggtggacagatgacttgaggtcaggagttcgagaccagcctggccaaagtggcaaaatcctatctctactaaaaatacaaaattagccgggcatggtggtggacacctgtaatcccagcctcttgggaggctgaggaagcaaaatcacttgaacccgggaggcagaggttgcagtgagctgagatcgcacaactgcactccagcctgggcaatagagtgagactccatctcaaaaaaaaaaaaaaagttgaaagaatagagtgatgaaaatcaatacactgccaaactggataacacaattgtttacatgttgcttggtggtgcgtgtgtgtgtgtgtgcgcgtgcatgtgcacatgctgggggcacatgtgcacataattcgatttttgctaagccatgatgatgcatccctctctaaacacctcagcatttgcagaaacgaagggggtgctcctgtaagtaatgtcacactcagaagatcggcattcacccccagacttcctccaaaatcactccacaggcacaggtctccacatgcctctttcccctaattttttgtactgttttaattcagctaaaagtacatgccacgaaacacacaggccttaagcacagagttggatgagtttttttgttgttgttgttctttttgttttgttttgtttttgagatggagtcttgctctgttgccctggcttgaacccagaaggtggaggttgcagtgagccaagatcacgccactgcactccagcctgggcaacatagtgagactccatctcaaaaaaaacaaaaaaacaaaaaaacaaaaaaacaaaaaacaaaacctgccttctcagagcagggggttagcattccatgccctagttactccacattctcacagacaacacttggcactgtccatcttcttaattttggctatttgtgtgtgtgtgaagtaggtggttttaaactttatttgccccccaacttctccttttttgcaacctcaccattgctatcattagaataaaattaattatccgttttcccagagggtggaaaaaggcagtgattccaggactcaggccaagaactggagacatcagcctcacagaagctgtgagtgcacctgcagcttctatgggccagggagtacaactcatggctattgttgtttgctcaggaacatcatctcctaccccaaaatgacaagagtgagaatggtggtagaactggtcagtggccaggcgtggtggctcacacctgtaatccctgcactttgggaggcagaggtgggaggatcacctgaggtcaggagtttgagaccagcctggccaacatggtaaaatcccgtctctactaaaaatacaaaaatcagctgggcatggtggcaggcacctgtaatcccagctacttgggaggctgaggcaggagaattgcttgaacctgggaggcagaggttgcagagagctgagattggaccactgcactccagcctgggcaacagagtgagactctgtcaaaaaaaaaaaaaaaaaaaaaaaaaaaaaaaaaaaagaaagaaagaaagaaagaaaagagaagagaagagaagtcagcttatgaaggtggtggtggtgacacttaccacgtgaccttatgcaagcagaaaatattttacttcattcaatgatgtgaaggaagtttaacaaattatataagctaaaatcatgcttatggggtatcaactacattttttaaaattggactagttgggtgttgatatggtttggctgtgttcccatccaaatctcaacttgaattgtatctcccagaattcctacatgttgtgggagggacccggggagaggtaattgaatcacgggggccggtctttcccatgctattcttgtgatagtgaataagtctcaggagatctcataggtttaccaggggtttctgcttttgcttcttcctcattttttctcttactgtcaccatgtaagaagtgccgtttgcctcctgccatgattctgaggcctccccagccgtgtggaactgtaagtccacatgctaaaccatgatgatgcatcgtgcaccacgatgatacatctctaaacacctcagcatttgcagaaatgaagggggcgctcctgcaagaaacgtcacactcagaagatcggcactcacccccagacttccttcaaaaccacttaaacctctttttgtttccagttttgggtatgtctatcagcagtgtgaaaatgaactaatacaggtgtttacacggggttttatttggtcagcttctacagaaatccaaattaacaatttcattaaagtcactatcatgtgtcacatcggggaacaatttctgagacaggaacaaaaattgaccacaaaaagatctcccgggaaaactgtcttatttccttcagttctctggacttatcaatttacagtctcagggaactgaactacagattctaagccagttcctcattcatttcctttcccctccacttctccagcaaagaaaaggaaattaaaaaaaaaaaaaaaacctaccctcccatcctctcacagcctcctggtatgtttataaataaattcaggttaggtcatgtcgtttagaaaaaaaggcattcaatttataattaatcccagtgagaaagaagaaacttattatataaagagatttgttttccttcttttccttcatttgtcctaaatgatagaccctattatgacaacttggacccttcagggaccatatggaatacccagggggctctatgtgctaaaatggatgggaggtatgagaattaaattcaacacaattaaataacataaaattgcatttcaattcctccgggaacaaaaaaaaatcaaaaggcatttactgtattaggaaaattctaaagatcattattaagttccttgtaactggcaggtaaaagttcaggagaaagaagcaaacagagaaaggagaagggagggagaccaagagggaaagaaacagcaaagaaccagggatggttttcctcaatgttgtttttaagatccttgcaaataatttaaaaaccactaaaaatataagctaaggcctcagagttcccactttgggatctgggggctaaaagagaagattctgagtttagacgttggctctaaaccctgccccagacttcatgcggaaacataccctaaaaaggcatcctctccagagacgaggagcagcaggcattaggaccctacatggtgtcattgccggatggccaggctctctgtgcttctggttcaatcagagccggtcttttcatttccatttggaaaacaacactcacgtttaaccacacaatcatctcattgttcaggtaatgctgccacacttcattagggaaagcagctggcatcagggtgttctcgttagagcagtgctgtgagtgtttattgcttttcaattaatccacttttggatttagcatatttacactggggcggcaagcagagaacagggcggcggtgggggatttctgtaaggagttgtcgggccctcaaagcaggtgcagggccccgcccagccacactgccactgcagcatcttgttacagggccctgagaaggcacaccctgctcagctgcattggacagcctgtttccggaaatcgggctctggggctcatacagagccacaggaacaagtgtgcaatggggttccgctgagacacagagtccctcccccgaccctctcggtcttcctctcaggtagaatccacctggcaccaggagagcatgagcaatacccaggcttttctggcatcccctcaaaccaggggctagaaaaaggtcatcacaccacacctcccacctgtccatgctggggccttcccgggaatacagagagaagcttaaaaacccagcctcgcacagaaaggcctttcaaaaacacaacgcccttgcaaacacacacaagaggctgagtatatgaagaggagggttgggcacggtagctcacacctgcaatcccagtgctttgggaggccaagatgggaggatcacttgaagccaggagtgtaagaccggcctgggcaaggtcttaagcaagaaccctacctctacaaaaaaaataaataaaataaaataaaataaaataaaataaaataaaataaaataaaataaaacaaaacaaaacaaagtaaaattagcccagcgtggtagcgcacacctgtaaccccagctattcaggagactgcgaagggaggatcccttgagcctaggaatttgagaatttgaggctgcagtgagctataatcgcaccactgcactccagtctgttgacaaagcgagactctgtcttaaaaaaaaaaaaaagaaagaaagaaaaaaaaaaggaagaaaattcagttgttaaagtatttaactggaaacagcaggaatcttgtaggctacaacaccattcactttggaaatgcactttcctctccacaagctgcatctcagcttcctttccctaatcttagtaatgtgatctgtgggtgaagccgacagctattggctggcaatgactttccagatgatttctgggtactgctggcttgcgggacacgttcatcctcagctcccaatatgatccctcaaaaatacggatgccttctttaaacacagacgttgggccctcggagacactttgctgccactgggaatctcatctcaaatgtgcagggctgctgttcccaaatccgccagcacatgttagcagactgtacacacacccccaaaaaaatcccctagcaactacacgctggcgcctaacattttaattctttcagttatgattcatggtgccatctgtggacagataatgagagacaataatccaagaatagctatcaggcatttgttcagcagagtttcagcatcagttgcatccaagtatgggaagggacggtgccatcccaggagtgcctaaccactcccatggctaacatgggactcagtgaatcagatcagcaggtctggccgccgagcccacccgagtgacatcatgccctcaactgtgctcaaactcctgagaataccgagagcatggctgcaaggtccaggagggagttaaaggcaacaggcataagagaattcacaggagcccaccccacaaaagggctgcctgcctcgcgggacggacgggatgatggaggggctgtggctatgagaaaggggactcccttgaggcttgcttaagcttgccaaggagaaagatgcgttgctcagtcataaaatcaaggccatgctttaaagacttctggatgacttgacttatgacactcaggcacaacatcatttttttctcattctaaacactgtgtgtgttccctgacctccatttatttcagagcgcaggcctggctgtcagcagacacagacatgggtttctggacactacaccctccaccttgttgtgctcttccccgattcacatcaccttgctcttgtttttgggagccagacatgtctagggaggcctacatattttctgcagaaaagaattagagaagaatgaagggcaattaccaccttctttcagtggtttgcccaaagccattctaaaccgggcaatgtgtctacctgtgaatcctgagggataaaggacattcttggccgtcccttgcctcttgggagagggtagagttcagataagtcgagccccatgccccgtgtaacagttcatgctgagtttaatactcacgggcactgtctgggggaaaggttgggggacatggaaatggcctagttgcagcagagtgggaggcagcatagaacagtacccctcgccaacccggctggccatcacatggccacacagtggacagaggtacagaaagctcttggcacttctgaaatgcgaggctggcagacagcagaaaagctaaatcctagcatcagtcactcatgtgtatgtgtgtgcgtgtacacacacacacagctgccccgccaccctttcacacagtagcacagcaagcttcaggaattatttccagaattctaatggagcatgattcaccggcaagaggatgatgacctaattatccacctgtgtcagttaaatggcaagaagccccctcgccctcccttcgcctggcacagcattcagcatcttcctgctgtctgaagagaggcttgcaaaatgctaatgtgactccagggtctctatcctgaaagcttgcaggtatccaagcagcctggggaaagggaagccaggagcacatggagtccaagaagaaactgaaccccagcaggctctggtgtcttaatgtacaaatgtcctcctatgataagcaaatgtatcatttctcaatctccacggtacctgcgaccttaagcaccaggtgcatgtggggagggtatggagggaggttaggaaaccattgcttttggatgctttgcttaatttttattaggacacagaaaatgaaaagtcagcatgaggagagggaaagcgaccaagagaagccactacgcagcagggcagtgagctgcttcgaaggaagacagcaagtcaggtcttggccccgatgtcagctgaacatcccagcctactccaaacatcacaggaagttaaggatgcaagaaaaaaacaaacaactcccttgaaaagtgggcaaaggacatcagcagacacttttcaaaagaagacatacatgcagctaataatcatatgaaaaaaagctcaacatcactgatcattagagaaatgaaaatcaaaaccagaataagataccatctcatgccagtcagaatggctattattaaaaagtcaaaagacaacagatgctggtgaggagaaaaaggaactcttttacaccgttggtgggagtgtaaattagttcagccattgtgaaagacagtgtggagattcttcaaagacctaaagacagaaatgccattcgactcagcaatcccattacggggtatatacacaaaggaatataaatcgttctattataaagatacatgcacacgtgttcactgcagtactattcacaatagcaatgacatggagtcatcctaaatgcccatcagtgacagactggatcaagaaaatgtggtacatatacaccatggaatactacgcagccataaaaaagaacaagatcatgtcctttgcaggggcatggatgaagctcgaggccattatccttagcaaactaatgcagaaacaggaaaccaaatacagcatgttctcatttatcagtgggaactaaatgttaagaacacatggacacatagagaaaaacaacagacacaggagcctttcaggggggtggagggtgagaggagggagaggatcgagaagaacaactaatgggcactaggtttaatacctggttgatgaaataatgtgtacaataaacccccaagacatgtgtttacctaggtaacaaacctgcccgttctgcacatatacccctgaacttaaaagtttttttttttttttttttttttttttaaataaggccaacagatgaacatctcaaggcaacccatattttaagtcattttactgtgaggaccctgacccaggaaagaaaagcaattgctataaaacaggtggcccactgatctgccatgagagccaactcaacaagagattcatctcccaaaggcagaacgcttgcagccgctccatgcggggcgggggcctagggaagaaaggtcactagactctcctaacagggctcctgcatcagctacaaggtcaggtcaagtcagacgtgtaccctctccacggagagaggccgattggtatcaattttattgatacaatttatgtcctagaatcacaaggtcacccagcacccacttgtagtttcatcatccatgccaggtatagcccaggtggctctgccagtcgaagtggaattggggaagaatgtgccaaagtctacatggatatccttattttaattgattttttatttttttgagacagagtgttgttctgtcttccagactgatggaatgcagcggagcaatctcggctcactgcaacctccacctcctgggttcaagtgattctccggcctcagcctcctgagtagctgggactacaggcgcccacaactacacctggctaattttcatatttttagtacagatgggatttcacaatgttggccagactggtcttgaactcctgacctcaagtgatctgcctgcctcagcctcccaaaatgctgggattacagggcatgacccaccatgcccagccttaattgactttttaagttgacaaataaaaatagtatacactgatggtgtacaacatgttttgaaaaacgcatacaggccaggcacagtggctcagcctgtaatcccagcactttgagaggccaaggcggatggatcacttgagcccaggagtttgagaccaggctggacagcataataagaccccatttctacaaaaaaattaaaaatgtaccgggtgtggtggtacgcacctgtggtccaagccactcaggaggctgaggtgagaggattactggatcccaggagatcgaggctgcagtgagccgtgatcaccccactatactccagcccaggcaacaacagagcaagaccctgtctcaaaaaaataaaaacaaacagaaagagaaacatgcatacaatgtgcaatggctaaatcgagctgatgaacacgcacaccgcctcacatgctgaccatctttttgtggtgagaacactcaaatttgactctctcagctattcaagtatacaatgcattgttaactgtggccacaatgttgtaccacagatctcagaacttactacttctttttttttttttaactctttttttttgagaccgagtctcactctgttgcccaggctgggatgcagtggcacgatctcggctcactgcaacctccgcctcccaggttctaagcaattctcctgcctcagcctcccgaatagctgggactaaaggcgtgtaccactacacctggctaattttgtatttttagtagagtcagagtttcaccatgttggccaggctggtctcgaactcctgacctcaggtgatccacccgccttgacctcccaaggtgctgggatcacaggcatgagccacagtgcccagctgatctcaaacttacttctcctatctcagcgaaattgtgtatcctttgaccaacaccaccccagccctctccccaacctcccagcttctggtagccactatcctactctctgcttctatgagttcaacttgttaagattctgcacataagtgagattgcatcatgcttgtgcctggcttgtggtgcttaacattatgtcctccgggctcattccatggatgtcttttaaataatcaatcaagagcaaccaacccaagcttggtaactggcagcttccaaagctgcagagacatagccatgttgggataagacctggcttctagtctcaagttcaagtttaccagctgtagcactctggccaagttacttaacatctctgagcctcagtgttttcatgtgtaaacagaggtaataacagaccctacctcatagggcattttgtcaattaaagtgagatagtgcatacagcataattatcagtactacccaatacacaagcacttaataaatagtagctactagtataatcataattattttaaaagcactctctataaatagaaatattatgtatgtatgcatgtatgcatgtatgtagagatgggatcttgctatgttgcccaggctggtctcaaactctaagctcaagccagcctcccgccttggcctcccaaagggctgggtttacaagtgtgaactgccacacccagtctattttaaaaaatgattacctatgatgaaggaagagacaagagtggaaaggagaggcggagggtggaacttctttgtgtataacttggtttatagatttgactttaaaatgcaaatattctatagaattacaaaccaaaattaaaatttaaaaagcaagtcattaaaaatcaaaaataaaattaaacatagctgctggcaaaaacaaatagagagaaattattccaaatgtctctcaagcacaatagtttaattgcatgtccctaacggggtctactccagtgacagcacgccactgcaggggagaatctgaaaccactacagcagagtattgctggtaagtgctggcagcattatgtgaagaattttttgtgcatggtagaataaaccaaaagaagagtgatgttgctcattaaaagttaaagtttttagcatagctgaaggcgatacagatgttaagatcaaggaggttaagtcaaaaccttgtcctgaatcacaacaggcaatatcaatataactcatgatgcatattacctaaaaagtaagcccccttaaacttagacgtggcccttaaacaccagtttcgactaaaagaaacaagcttccctgaaaaatggctgattccatgtctgagacaagaaatctgaaatgtctcgccataccagaaaatcaggaagctatcaatgactatgaggtcatgtccaaaagactcaggaaatggtcggaatcagcctccactgggcacagacagatatgatgaagtagctagaggcagatgaatgctcccaccaaaaagagaataaacaacaaaagacaacagtaaacatatctttcaaagcatcagggatctactgaagctacaaagaccacaggtgccaaggtttggaaagaggacagctgttgagaggtgagcagatgtgctaaagctgcttctcccctaggatcatttgtacatcccagactcaggaaaaggactgagaattggtccttgggccaagagccgattcctgctagctgtagagaaatccctggagtttttagcagtgaagtagggctcctaaggcaaaaactgcagacccgaaggggagttgtctgggctagaggaaggagtagaaaaatgaatgaggcattcggctgcttttcctttcaatatttgccgaattctgaaattgggaggagcagaaggtgaaaaagcgaagcataagaaatggagggcagggcccacccaggagagaaatgctggtaagcacacgaggctctcacttgaaagtgctgagggctacaatctagaaggaaaggagaactggagttagaatgaatcctctcaaaactacaacccagccttgactcagctcagtctctgactgcatcaaggtgacaaggcttctctctatctgcctgacagaagaaatgataatcctctctgaaagaaaataacattacctagagtctccataatttttaaatatatatgcaatgcctgacattctataaacaattactagtcattcccacagacagtaccatgtgttggaaaacaaagagaaaaaacagtcaatagaaacagacccatggatgatccagatattggagtgagcagcgaagaacttaaaaatgattagtatgatcaagaaggtaaaagtaaaactgaagaaaggagctgaaaagatggagaatttcaagaaacaattgaatgcagaagggaatcaatcgtaaactctagaccttaaaatccaacgtctacaattaaggacctcaaaggtaggcttaagatcggattacatgtaggagatggataaggaaattggaaaattggtcaataaaaaatgcacaaactgaagcacagagagaaggacaaatggaaaacagaacggacacatataagacacactgaaaggctctgacatatatgtgaatcaaatcctagaaggagagatgaaaaatagagcagaagtactacatacattaagcctaaactgacaaaacatgtaaaaccacagactcaaaaagctctataaatctcaaatgagataaacacaggaaaaaaacatagctaggcacacaaatactgaaaaccaaggacaaagaaaatttctaaagcaaccatagcaaatggccattatctacaatcacaccgacagcagtctttcaaaagaaactagataagggatgtgacaaagaaaaaagaaaataactactgatctagaacctgtacctcacaaaaatatcctattaataaggctaaataatgacatttttggaaaaatcaaagcaggcattctatcaccagcatgaattctaaaaaggacttcttttagcaaaagaaagatgatcccataaaaaaaattcagaaaggaataaaaagcaaatggaaaataagtgagcaagtaataaagaacaggaagatgtaggagtggtgagtttctaaacgtgttaccacagctaggagatgcaggggaggaagctgacctggtgacataaacaaaatacaacatcccctatactttaaacaaacaaacaaacaaacaaacaaaaaacccataagcaaagttgaaaggagataaatttgaaaaaaaaatccacacatttgtaacttacgattaatgagttaaagtacctattatattactataaatctacaacacagaaatccaaacccaaaacccaaacaggcacaatccaactgacactttttatgacagggagtcattgatggtaaaaacccatcaactgtaaggaagaagaaagaaatttgcagttgcatggtcaggagggggtgataatagatgatgggtccccactgtttccctccaatatgactgccctgatcctcagctttcctctttttgttttgttttgctttgtttttgagatggagtctttctctgttacccaggctggaatgtagtggtgtgatcttggctcaccgcaacctccgcctcctgggttccagagattctcctgcctcagcctcccaggtagctgggattacaggcatgagctactatggccagataatttttgtatctttagtagagatggagtttcaccatgttgccaggctggtctcaaactcctgacctcaagtgatccgcccgtctccacctcccaaagcactgggatcacaggcatgagccactgcgcccagctgcttgcaacattttttgagagagacaggatcccactctatcgcccaggctggagtgcagtggcgtgacgtaacctcagttcactgataactccacctcccaggctcaagcaatcctcccatctcagcctctcaagtagctgggactacaagtatgcaccaccatgcccagtttgtttttatatactttttttgtagagtcaaggtctcactatgttgccctggctgctcttgaactcctgggctcaagtgatgatcccgccttggcctcccaaggcgctgggatgacaggcatgagccgccacacctggccaagcatcaatgtcttaaccctgattagcctaattgggcagctcctcttctcttccagccagtgacatccagcctataagaatgcagaccggtgaaccactgcccagtgatggctcccccagtgcccttgtgagacactgcagtgagccccgtgtctgctcagggggaggcacgagggagcagacaggggcaggaggctggccaactacacagaaaccaataccatcacagggaaagccttgccgggccctaggtgccatcataaaacctttgctttcaaatgcacaagactcagcatccctcctgccacactccccaccaccctgcaccgttaccagagtccccaggagtccctcctgacggtacagatactgaccggcctgacctgccatattgaggacatgccccagagcaggtctctccatggacaggagctcagtccgtgcctcctgggtaagatgctgcatcccagtctcacctgggacacgctgctcctaggatctcggggccgggctcaggtgtgagagtcaaacaccaggggctctgtccaacagccagcgaaatggtggggctgaaggaaagccatgcccttgcctgatacttttttaaaaatttttatttttaagacaaagtcttgctctgtcaccctggttggagtgcagtggcacgatcctggctcaccacaacctctgcctcctgggttcaagtggttctcctgcctcagcctcccgagtagctgggattacaggcacccgtgaccatgcccggctaatttttgtatttttagtagagacagcgtttcgccatgttggccaggctggtctcaaactcctgacctcaagtgatctgcccgccttgaccccccaaagtgcagggattacaggcttgagccaccgtacccagccccttgcctgatacttgataagggttttacacttttattatctcattaggcaccacaaaaccttataagagaaatggggcttatttcagagaacagataaaggaaaagctacgcagacagcacagggtctgccactcccggaacaaggcaaggctggagctgctaactttgtattggaagcgttcaccaggaccctcccttcccatcaccatccgggctcacaggggggcagattgagcacccacttgcccagcagagatgcgcactctaagcttccctccaccaagcggtcaggaaatagacaaagccagatacaactctccatggcggtcgacactgcagaggggagtatgtgtgggggtttcacagtgggccactatttatatctgcatgaatcagcagccttaagctgtttctgaaagcttaagcagttcctgtatgtttaagaaagcaatggttaaatatatgccctatttcatcagcaacgttatggaataaatatttcaacgataccctgctatgttgactctgtgctaagaaaaaaacaagcatttttattaaagatgacccgccaaagtgaagaaagccctgttaattcttgcagattaggtgcccaataggagtaggtatcacctggaaaccaagctgtgtaataaggaaacagcatgttcacagaacatgtctcttccagtgcctggtgccccaccccatgtgtccataatcaacaccaagcagacatgcacctgtgcaaaagtcagatacttaaaaactggtagaaaaaacatatgaatcaaatcattcctatggtagagcttcatgcttgtgttaggttaaaatataaaagcaaatccactacaaatgactggtaggagcaccctagtgggaagaaaagccggatttgcacagcgtgcctactggatgttacatgaacatgaacttgagaggtgcttgacctcccctgcttgccttgccgtgtgcagacagcactaacttcttattgtccaggatgtgtaaagagattattctcatggtctgcggtgctaacatcctataaacctgccacaaatacaaaattagcaatactgagctgttgctcctaggagaaacacagtgttaggttcctgagagcctctggtcacaccttcatcaacccatcaatacataacctagttttatgtgtactcttgattaaggacaccttatttatacatattgttgactcattaacattgtatcggctgggtgtggtggctcccatctgtaatccaccaatttgaaaggttgaggcaggtggattgcttgaacccaggagtttgagaccagcctgggcaacatggtgaagccccctctctaccaaaagcacaaaaattagctgggtgtggtggtatgtgtctgtagtaacagcactttgggaggccaaggctggcagatcccttgagctcaggagttcgagaccagcctgggcaacagagtgagactccatctctacaaaataccaaacaaaaattagctgaacatggtgatacgtgcctgtagtcccagctatttgggaggctgaggcgggaggatcacttgagctcaggaggcaggggtggaaaggacatgcttggctcagtaagccaagatggcgccaccgcactctggcctgggtgacagagcaagaccctgtttccaaaacaaaacaaccaaaacaaaaatggtgcattcacggccaatggcactatgactcagacatgaatgaagtttctctaaagtgtgttttcttcatgagcacaccacagccttctcgcacttgggaaccccagacagcactgcagcactacgataggggccattccatacagcaaaaccaccaacaaacggcacacaatttcaaaaaccatagcactaaagagatggcaaaaaggacacttgtttagggtacaagagctgagaccagaaggcagagcgtggccccattcagcctcagctgggcacctgcgggctggatgactcagactctccactgctctgtgtggctgtgaataactctgaaggcgcatgagcttttatatttcagtgttacaaataaattttagtgagtaggcaaaatcacaaatatggaatctgtggataaggaggacgaactgtgcagaagtgtgaggcgtccatggtctgacccactcgagctggaggaggcatctgatccttacttaccaataaccacttgtctctcttctgcctcctgctgggtccctttccacctgcttaaaacaggcaaaagccggtgatcagaatctctgccgcacgacgtggcagggaaaaaaagaataccaggcaggcacacatcatgtgcttgccaaggcatctcaatatgttaatttctttgttttaaaaaaataagggcctagagtaataagaagtagactccaatgcaacacacggagacaaaagattctttgtagctattttataaacaataatacttcccatagtgttaaaataaataagagtccctgaacgctgactctgaattccatttaaatattcatgaagattctgaactcgatctccagaaaagatttcacaataaaatattccgtttatcccatctctcttgctatgctcccagggtcatttcactgcctggtgtgacggacttgagagccgttggaagcacaggagactcagcttgttctatgtgaccagcgaatctaggccaggttgggactgatggggcccgacatggggagagggcaggcgagtcaacacaaggaaaagaaccccagagagcagccatctccacaagcagtgagttccccatctctgcaggggttcaagcaaaggcaggcaagatcttaaggagatggaaattcccattaagacacaggcagggtcctggtgaccttcaaggccagtgacagttcattttatgcatcaccttgactgagttccagggtcctcagagtaaactgttatttctgggtctatttgggaggctgttcctggatatatctgggagaatgttcctggatcagcatttgaatcggtaaacccagaaaagcagatgccctccccaaagtgggtgggccccatccaatccgttgagggtctgaatagaacaaagggaagaggaagggggcattagctctccccagctgactgctggagctgaacacaaatcgttttctgcccttgtcctggcatttacaccaccagctttcccaggtctttggtttgcagatggcagattgtgggacttctcagcctccgtaatcacatgcgccaattccttataataaatctctcctcattctctttctatatatatgtatatatttatatatgtacacatatatacatgtatcttattggttccatttttctagagaaccctggctaatacaaggcctgtcgacaccacaaactgcatgccctgaaacccagagggaaaagggcattgtcgccgatacctgttcccgtcgatggagaccccagccatggagctgccccctccaccatgcattccaaaggtgtctagaagggaaagaaaggcttgtatgcttgaagggggaaaactggaaggcagagatctgagacagctggtcaacttgctacaaagccttattcagggcagaacaggctcttgtggcgcacctggcatggatcaagggctgcccaggacagtcctaagatgcattttttgacatgagaaacagagcatggttgccagaacaacctcacccccagaagatgcagcaaagggtttactgcttgcttttatgtggaacacgagatgggatcacagggcctcagaatggaggaaaagcctgtggtaacagaaaaaggcatttgtttcaaagcagatccctgggggggaagaggaagactgggtgggggcataggaggtggtcccctggaggaagaaccagcccctccaatgggatccatggggcagaattaggaccaagggagaaaaacttgcaagccggccaagatatgagcactgataaaggtgcctagggctggaagttaggagcccacctacgaccgtgaacccggacaggtggtagagctgccttcaaacccccacaccaaaagcctacaccagaggagagaggcaggaagatgcacacactgaagaacggtagggggtgacctgaaagtgactccccatctctcctgggagggtggggctggcagagtcaggaagcagacaaatggtaatgcagaccctgggggagtgcagacctgtggaggtgcacacgtgtcttgtggagagagaagctgggagggcactactttttcagcaaaagaagcaacaccacccacaggacagggagaacaatgcgcccaagggctcgtcacttccttactctctagtgtgacttccagaacttgtacctgaggttgccatctgttagtggtgtgtgtatcataaggaagcctctgcttttgcagaaatatctgaggggtagaatggagagacaggatgccgaggtttaaatgtggctctgccccgaggcacttactactcaacctcggtctgggcaatttcctcatctgtaaaatgggacgtgcctcaaagagctgctgggaagattcagtgacttgcacgtgagtgtcagttccctgttgctgctgtaacaaatgatgcaatgtgaatgtatgctcttactgttctggaggtcagaatcctgaaataaaggtgtgctgtcagcagggcagcattcctcctggaggcagtaaggaagaatccatttcctcccctctgccaggttctagaggccatctgcatttttgggctcatggctcctcctccatcttcaagaccagcatggcagcatcttcaaatctctctccgacctccgtgcctgttgtcacatgactgctgactctgaccctctgccttcctcttataaggacccttgtgataacatgggcctgactcagatagtccaaaactatctccccaactcaagatctcaaacttcatcacatctgcaaagtcccttttgccatgtaaagtaacatgtgcacaggtttgggggattaggatgcagacatgtttggggggacattcttttagcaactgcaatattgaaagctgtcagatcctgggtgactacagaaacgtgagctttaagtgccacagaccgtcactgaaatgacagtggtgagtaggatgctgatgaggatacacatctggtgtgagcaagccctgcagaaagccagagagtaaacaccttcagctttgaggaccacacggtctctgtcacagctcctcaactctgccctcctagcacagcagcaaacacaggtaacatttcaatgaacagacatgactatgctccagaaaatttttatttacaaagataaggctacgggccaagtgcaggacctactgtgtaaacctcaatgcagaatattttcttggttccaatcattcaatctctccctggatgaggatcagaaagtcctgccttctgcttccctgtggaaggaagcatgtccttcccacaccacagacgtcatgctctgccggtgctctgctccctctgcccagagaaccacaatgtctccttttgtctggatcctgggacacagaagaaactggggcaaattgatagtcaacctttagacgcagttaccagatggcttgaagccactgggaatgtggggatgtttgttatgaggcataactgggtccaagctgactgatgcaaatacaaagtgttagttattaatattgtatttattgttttaatgctattccagcaccttctctgttatctcacctggccaatgtgagctgctgaacctaagccactctcaagtcactgccacatctgggtagaggtcattggtctcagaggttgatcttgcaaacataaatgccttttctcttgtttttatttctttgtcttttttttttctttttttttttgagacaatgtctcactcagtttcccaggctggaggctggagtgtagtggcacaatcatggctcactgctgcctcaatctcccaggctcaagcaatcctcctgcctcaccctcccatgcagctgagactacagacatgccccaccacacccagcggtttttttttttttagagatggggtctcactattttgcctggggtagtctggggctcctaggctcatgcaatcctcctgcctcagcctccaaaagtgctgggactacaggcatgagttaccatgcccacccacaaatgcattttctgggtacggctacagaagccatcaatggataaatggatgcacaaaattcagccatgaaagggaatgaagccccaacacacgctaacacatggatgagacttgaccacaccatgctcagtgaaagcagccagacacacacagccacatgttacatgattccattcacatgacatgtccagaataggcaaatccatagtgacagaaagtagactcgtggtgccaggggctgcagggagggaggttaaggggaggctagtgatagggtttctttttgaggtgatgaaaatgttctaaaattgactatggtgatagttgcacaactgtgaatataccagaaacccctggactatacacgttagacgggtaaattgtatgatctgtgaattacatctcaataaagcagtcttttaaaagaatagcacaaagcactgggaaaccagcaccagagatgtctgtctacccctccgaacagccctcagaaggtggcagcgctgggacacccttgaccacaagtcagagctgctggcgtggccacggcaagtcaggaaagggaaaccgaagaggctatagaatcacccgtccttgtgttctccttcctggtggcggcactgtccaccggtcaccagggccagcccttcgtaggtcatctctaagccctcacccgcccctctgaaaggggcaagagaaggtgtctggatgccaaggacacagctataattagagaccacttagtggcacacagggcaacagcaaggtgctggcgccaagcgtctatcacagcaatgaggtctcacatctagaaagccactgcctgctgctgaagggccaatctcttctgagcagataccctctcaacgacgcttattatttttccaaagtgaaaatcatactaatgttttttataaagaaagaaaaacatcatccatcttcaagcctgtagaaatcctagcaattcgaaattagcataacaaatatttttttaagaaacactgaaagagcctctacgtgcagtatttattaccaatttccataagcccactctaaacttcttagaattaccataatctctatgatacggtatcttccatcggaaatgagtggaaatgtctttttcaagctgaaactgtgatgttctgggaagaaaagaaaacattttgtagacatctggttctggacaaaagtgttgcttctgccttagccatggaaatccaccccttggggaaatctgaacagccgaaacaaagttccgtggaggaaacaaaggcagtgtctctgataacagccacgggaaatattaatttccagatgcactcatttttatcttaaaatcttgtcctatataaagcaagccctcatcttagacactccgggagctagaaggaataaggggtcttcagaccccctccgcagcagaagcagcaggactctgctgggtccgcgcacgtgcggccccgctaagggaagcagatgcatggaaactgtccagaccagaggcagatccatgcccctaagacttcagaccaattcccaggaaactacctctgtttacaaagattaaagccaatttccaagtcaggcatctgggccacaccttcccattgtgtgagtagagatccaccctcaagcattcaatcttctgcacacactgaccaaagcaaatgccagggtaccttagaagtggccaggcctcagagaccccatgtggggaccacctggcggggcaggggctctcctaactacaccccctgcctaggctcatgccttccatacaatattgtcctggtggttgccacagaaaacagaaactattgaaaagcacagcataccacttcacgtgaattagcatggctactacatagaaaaaaaaaggaaaaagaaaattacaagtgctggtgagaatgtggagagactggaactcttgcacactgtggctgggaatgtaaaatgatgcagctcctatggaaaacagtacagccgttcctggaaaaatcagaaatagaattcctatatgacccagtaatttcacttctgggtctatacccaaaagaattcaacccagagactccaacaggtatttgcacactcatgtccacagcagcatgattcacactagccagaaggcgggagcagctcagtgtccaccggcagataaatggatgaacaaagtgtggtgcatccatgcaggtggaatattattcggccatgaaaaagcaacgagattctgacacaggctacaacatggaggaaccttgaggacactgtactgagtgaaataaaccagtcacaaaaagatgaatactgtaggattaaacttaaatgagctccctaaagttctgagattcatagagatggaaagtagaatgatagttaccagaggctgggggaggagggaacaaagagttggtgtttaatggggacagagtttcagtttgggaaaatgacaaaattctggtagtcatggctacaccaccccatgaatgcacttaatgccactgaagggcatgctgagaaatgatcaaaattgataaattttaggttatgtgtatttgactacagttgagaaaaatatgaatttctaaattctcttgaaaaccaggaagatctgacaacaatgggtatatatgtatttattgtaattttttaaaaaagcaacaacaggctgggtgtggtggctcatgcctgtaatcccagcactttgggaggccgaggcggatggatcacatgaggtcaggagttcaagaccagcctggccaacatggcgaaatcctgtctctactaaaaatacaaaagttagctgggcatggtggcgcacacctataatcccagctactcgggaggctgaggcaggagaattggttgcagtgagctgagattgcaccactgccctccagcctaggtgagagagcaagactgtgtctcaaaaaaaaaaaaaaacaaaaaacaaacaaacaaacaaacaaaacaacaacagctgggcgcagtggctcatgcctattatcccagtgctttgggaggtcaaagtgggagcataacttggccccgggagtttgagaccagcctgggcaacatggcaaaactcatgtctacaaaatatcaaaagaattagtggtgtgtggtggcacatgcctgtagtcccagccactccataggcagaggcgggaggatcacttaagcctgggagttggagggtgcagtgaaccatgagtgtaccactgcactccagcctgggcaacagagcgggactgtgtctcaacaacaacaccaccaaaaaaaaaaaaaaaaaacagcagcaacaacagtgcccactgcacattaaaaccaggtagtcacttcctgccgcacactcaggttcctcaccccaggtaatggaggcccgtgcagccggccggcctccctcctgcttctcaggccgcctctgcttcctaaacagcccagccccgcccagggtgcagcctcaaacacaggggctctgcctgggaagcagtccttggctgtccccaccctgctacagggtaagctccttggctttccgaggccagatgagatgatgctccccaggaaggccactgggtctcagactaagtcacccccagatagcctctcctggcattctttgcaattgtcagaccaaattccatcaaatcaaagccaccatcaattaaggaggctccttattttatgtcccaatgataagagaaaatgctgctgctgaatatttcaaatactattgattatgatatagaagaggcgaatgggaaccccttaggctgacatgccacgtgtgggtaaatcacgagtggcgtgattttcctcccagagaccagtgtggccgttcaaagaggaggacctccttgctggggaatgtcctgtccccaggttttcaataaatgggagttgaactgcctgcattttgccggggaccgcgatgcaaaccaaagcgacgcagcagccgtgtggaagcattcacggagagaagggacggggcaggtctggagctagccgccctgcttcctctctccacgggtaaacggccgtgcctatgacaggagccctccttacctgcggtttcagttacctgcagtccaatgcaatccgaaaatatgaaacaaaaaaaaattccagaaataaacaattcacctgttttcaattgtgtgccattctgggcaatgtgatgaaatcttgcctcctgttgctccgtcctgcccaggatgtgaatcatccctttgtccagcgtgtccgtgctgtctaggccacccacccatttgtcactcaggagctctctcagttctcagatgaaaaacacagcccatacatgtaggggtctgtactagcctccatttctggcatccacccaggtcctgaaacacagcccacacaggtaagaggggtctgctacagtctcattttgcagattgaagaaccgagtcctcagtttgtaattagcccctattacgtggttagccaggagtgaaagggagagtgacagccaagcagacgggttcaaggacacctctgaaccacctggaatccatctcaggaggtcactccccctgggtcatgctgaactttccaacagcctaaaacctaaaaccacaaccgagtctattctggcctggacatgaggtcttttctgaaactgggatgctaacctgttatttatttatttaatcagcaaacacatctaccatgtgccgggccccgagtgggacagctgccttgaatgaagacatgaaaaaaacagactctgtcctaactagacactttccaagatctgaaaggcctactccaagagacagcaacttgggaatgttttaaaactccatgttctgaaaagcatagcgactctttgccctgagttcctcgtcatgtgagcgggcctcttacaccgcccccgcaaaggtgaaccattccaggttaagcagggatttggacgtgcccatcatgaacagccttgggttcacacccgccaaggaccatctctttcccctacctgtccctgctgcaccggctgaagtgagcaccattcctggaggcctgcggctgaggtctcacacggattgaaatcaatttggccacattaatgtctcagctgactgagatttctctttctcaagtaaacaccattccttaaatgccagctctgtggagcttattctcaaaatgttcagaaaaaggaaaaacccatgaagaagaatcatagcactaaaaccaatgcgagagttttcagatacctttaaagcaacaggcgaggccaggcgcggtggctcacgcctgtaatcccagcactttgggaggcctaggcaggcagttcacctgaggtcaggagtttgagaccagcctggccaacatggtgaaaacccatctctactaaaaatataaaaattagccaggcatggtggcacgtgcctgtagtcccagctactggggaggctgaggcaggagaatcacttgaacccaggaggtggaggttgcagtgagccgagatcaccccactgtactccagcctgggtgacagagtgaaactctgtcttaaaaaaataaaaaagagagaattatataaaaaagtaaaactaaaataaggcaacaggcaaaagaagcaagaccatgtgtttgtgtgtttgtctttgctatttatttctctatcttgttgacaatcattttggtctctgaagatcatgttagcaaccaaaagccagagctgaaacagttctccactaacgaacaggttcatagagagctggtgcaggccgggtgggttcaggcctcctcgcctcccggactccagcccatgtgcaccctcagggttcccaacagccctccctaaagaacagccagagactgtgagcaggaaaacacctccaatgaagggtaacgcacactggtacccactgtaagtcctcaaggtgattcagccagcactgggtttccagttccaagtaaccttcatttctccttggtactgactcttccaccttcctttccctccctgagatgtcttgattggcctgaccttttttgaaatgtcactgttagctgtcgcttttaagttggaagaccgagatttgtagcatcagtcacatacttctgccctgacaaaccccagtcctctgcgtggagtcagaacatgtcacttaccagccctgtacaagctaagacgctgtgcagggacctctgggttcctcaggatcgatagagcctgtgtctagaagagtttaagagtcaccaaacactagatgcacagatgctctcaaagctcaaaggagatggaagaaaacatcccttggggagaacaagtgacgggagcacagaaatcttttgaaactccccaagtcatgtggtaacagggacgtgtccaaaacaaaagccccaaatgccttcagtgatcactgctgcctgcctgatggaggctccccaggacctcgcttccctgagagcccggtgaggcccctcctatgtgaccttcggatgatggacaagtgacatcgtcagccccctggggtctcccagatcctacaacttcctgaggacatttaccttcatcaattggtggccaatgcacctggagtacccagagggcctggccttggcaagtgtgcaaaagatgggggtggccaccattggatcatgtgcattctgctatcaaagatcacggtcacagtggctactcccatcttttgagtactttatagtgtgtgtgcgtgcatcttttttttttttcttgaggggcaatagaacattttttaaaaggcaaagcttggagaaaaaaggtctaggtcaagtcctggtgttgtccctgtttactcaggaaccgcttattgttgaggaacacaaatccactcagatgggctcagtcccagaggcagaatctcacaaaaacctagtgcagggtgtgtgacctctcagaagccagagggcctttggggcctctctcttcatttgcatgtgtgtgtggatgcctgtgtgcatgcctgtgtgtgtgtgtgcatgtgtgagcgtgatctatcttattctctccagttctatatcaccttctcactttatttttttctggcatgtccttctccagcttctgcctccctaggagcagagggctcttcataattacagcaggaatgagtctctgccccaatcccagtttccccaaggacaaatccgattggctcaaaattagccaattggctagggacagagtggggtgaaggtcggaacggaacccagagagggttttcaggtgggaccagcatcactgtatgtgtgggtgtggtggaggggggtgtcctgggcacaactttaacccctttgagcctagaggagatgtgctgaggataaaataacacagaaggagcaaacgaaggtagaaccacttcatgaatgtgatccacttagttaatactctggaatattgttgaatacaggattccctccccaacaaggaaaggcatgttcctgaaaacttacatgcagctctactcaagggattactgaaacaaaagacgggaggcacagaggctatcaggggacttataaaaatacatatatgtgtcattttgctcactaagatttagccaaagaaacagtatttactcacagccacctgtacgggtcaatcctgaggaatgtgctgagcacaggcagtccctgccctttggaaacgcggcttctagtcgaggagatgataaagagcccagaaggcaatgggcagccagccaaggacagggagagggaagcccaggagctgaggaggaggaggagagttccaggcagaggaacagcatatgcaaaatgccagaggtcagagtcaggctagtggactccagttccacacacctagagcatggaatgcagtgagcacggcagagaagggaggtgacgtgataaccgccacactcagagggcccttcttagcggggcagctgcagggagtgacacgaccccatgtgtaatctagaaaggtgaggagagggtctgggccaccagcagtgggagagaagctggtggctaatccaggagagacactagggcgccggaactatgggtggcagcagggacagagggaggcagacaggctggaaagaccttccaaagggagatgacagaccctaagggaacccggggtgactttctttctcatgaataagatgatgaggaccaggctgttctttctgactttccctccggggctttgggttttgctgggagcttctcaagatctcgtgcacttacgtttaaaaagaggatagctccaacatgttgggaggccaaggcgggcagatcacctgaggtcaggagtttgagaccagcctgaccaacatggtgaaaccccatctctattaaaaatacaaaaataattagctgggtgtggtggtacgtgcctgtagtcccagctactcgggaggctgaggaaggagaatcacttgaacctgggtggcggaggttgcagtgagccgagattgtgccattgcactccagcctgggcaacagagtgagactgtctcaataaaaataatagtaaaataaaacaaataataatttccaaaaaagaggctagcaaggtgctagcaaggtgctccatgtctggggcagcctgctcaccaaggcctctcctgagcttcgttctccatccaacagctcaacaactttgggatttgctgacctgggccctcctggtccaccctggtcctacagaacttctcacacctcattcccttccccatgatggaccaagaaaggccccgtcctacccgcagccctccccgctgcgtggctcctctctttagaggtaggcagaacaacggcctagaagagatcaagtcccaatccctggagcccataaataagtgaactttgtcttcatagatgtcatgaagttaacgatcttcagatgcagagactatcctggatcatccaggtgggccctaaatgtatcccaagtgtccttctaagagggtgatttgacgcagaagagaaggtaatgtgaccacaggggttgagctggggtgggggtccagagattggtgtgatgctgccacaagccaaggagcaccaagactgcccatcaccacccagagctggaggagatgaagaatggtttttccccagggcttccagaaggaaggcagccccacccacaccttgatttcagacttctgaacccctcaactggaagagaatcaatttccttccttccttccttccttccttccttacttccttccttcctgccttcctccttcccttcctccctccctcccttcttctctctctctctctctctttctctcttttgagacagagtctcgctgtgtcaccaggctggagtgcagtggcgcgatctcggcttactgcaacctctgcctcctgggttcaagcgattctcctgccttagcctcctgagtagctgggattacaggcacatgccaccacgcccagctaattagctaatttttgtatttttagtagagaccaggtttcaccatgctggccaggctggtcttgaactcttaacctcgtgatccacccaccttggcctcccaaagaatttcttctgtttctacccacccaggcagtggtcacttatcacagcaggcccaggacacaaaggcatctctcccattacccagtgcccctcctcctctgataattccccccagaaccgactcaatttttctcagaggataaattataactgccataaaccattgtcaaaaggggtgacagcaacaccctgacgagagggtgaacattggttgctggagggggcttgaagcacagcaatgcagtgataactaaaaagatttacagcctatgtggggcattaaaacttcatggagggtgcaagaaaaaaggaaaaaatggctgaaaaagcaccagcttaaatgaacaagcaccacacaggggtcatgggcacttccttcctttagtcataaaatatctgctgagctcccaagtgtgctatgtggcagggagatgatgaccacgggactggcctctgcccttctgaaggattctttctggtgggagacaaagatagagatttatgggtttgaatcccaggaggcagaggggctgatggaaaacaagtttggtgtctgatagtccccaatttcaattcttcctcataagcttgtcggtaaaattggttcataatatttaaacatgcagaacattcaaggaccatgtcacaccaataaagtatctggcccctatgtgtatacagtggatactcaatacacgtagtcctctctcccctcccctgagttctatctattcatgaactagacagatagctaactccacacactgcacaaaaatggaggctgacacacttagacacacgatgcctcccagaactacatctgaaggatgacagcaggccgtgtgttgaaagcaaaatattgcagaactacagataacagaagcattacggtaaactgagaaaactacttaatactcctgacctgaaacatatctcctaaacttgctgttggggtcgctatggactaaattgtgtgtcccctcccaactctcccaaattcatatgtcagagctctaatccccaaggggatggcatttggattgggaccttttaggggtgtttaggtttaggtgaggtcatgagggtggggccccacgataggattcgtgtccttataagaagaggcaccagagagccagctcactctttctttgccacatgagggcacagggagaaggaaatcagcccccatgagaaatggaatcagccacaaccttgctcggacttccagcctccagaactgtgagtgataaatgtctgttgtgtaacacctcccagcctacagcactttgctatagcagcctgtctttgtctgttttgtgttataacaataatataatatataataataataatataataatactggagactgggtcatttcaaaagaaaagagggctgtgtgtggtgactcattcctgtaatcccagctatttgaggggccaaggtggatggatcacgaggtcaggagtttgagacctggccaacatagtgaaaccccatctctactaaaaatacaaaattagccgggtgtggtggtgggagcctgtaatcccagctactcaggaggctgaggcaggagaattgtgtgaacccaggaggcggaggttgcggtgaactgagatcacaccactgcacttcagcctgggcgacagtgtgagactctgtctcgaaaaaaaaggaaaaggaaagaaaagaggtttatttagctcaaggttctgtggtgtgggaagttcaagggcatcgccttggcttctggtgagggtttctgtgctgcaacacaacatggtagagaaggtcaaaggggaagtagacacatgcaaggaggaaccacacctgaggggtgtcctggctttataacaagccattcttatgggaacaaacccattcccatgaggactaatcccatctagagagtgaaatctcactcactactagagaacaccaccaagctattcatgagggatctgccccagaacccaaacaccttccactaggtcccacctcccaacacccccacattgaggaatcaaatttcaacatgagatttggtggggacaagcgagccatatccaaaccatagcacagacctagcagactagcagagtgtcatttccacttcacttctaacagatgaacttgaggatttacattcagggacagatacttcttcaggatagaaacagtggattataagtatctcaccaagcatcagttgcactctgccctcaccttttgcatttcacaagcccttcctccttaactctgcaccaagctgtaccgggttaacactgccactcagtggccagctcaagaaattacatggagccataagaccagacaggccctttgcctgttcacttacatttgttactgagggttctgggtctggtgctgggtgccaggagaataaagatagatgggaaagtgcatccctctcaaagcactttaaagtttagcttgggagacttatgcatgaaccattcattgtaatacaatacagaaaaggtacccagcaagtactgtgggaatcaaaataaaagcttcctgcagaggaagcacttcggctctgaggggtgggaaggagttcacctggcaaaggtggtggcgatggagcaagcagtctcacctggctggagagacatcacatcattgagaagatggtgctcagtcaccgacatgttcaaaggggtctgtctgtgtctggaggagattatgtcccctgttggaggtggctcagcagcagagagggtggctaaggcacttcttagataaactcaacaaagaaagtgtggccgtgctagggagggcacctatggagccctgcccatgaaactggctaggactacaacccactctagtgtccttaggtggaaactcaattggatgcccaggcttgaagcaccttgagaactagggctctggccaggctgctaagcaggccaaacccaggaggaaccaggagcttttcccatgcaaacagagatggcaatgggtccagatttagggcacagcaaactcatggggtgagcaggtggcaatacccctgggcggcagggacaggggctgaggaggcaggagaagagcctgggccagaaggatggcaagtcctgagtgctgtggagcactgaccctgaaatgcagtcttgtttgcaacacccagtgccagatcaggagacggagaagaggtaatattaaagattttctctaaacaaatgaaatttaacttttacagcaacaatgtcctgtctggatggatgctttgttctacatggggtatgagctgctcccctcccacccaatcccttcctcaccacagggccaaccacatcccacgccacagtgctttttcaggtgcttgctgcctatttgtaaatagcaaacatctgatcatccgtcttgatttccttctgtttaaatattacttgttgacttcctgccagggaagatgagagtttcactcatttatcacacagcccaagacagccacaggcccacttggttcaatcatggttcctgtgtttatgctattatggctagctacatcttgtccacagcaaggtaggcagtcgactgcaattctatttccctcgagtatataacagctacgttttgaaatctgcctttctatttacatgtaacgaatttatcaccaagttctgacagaggtgtaaattgcagagcgcaggtctattcctgtaaggtggaaacacatctggcaatcactgttgcctgggtttctgagtcaccctctcccagagccatccaccctcctgtgcccacctaggccgaagctccacactcatcccaggcccggcccggcctctgcccggtgccagggccctccccggagtccaggtcttcctgtcccctggctcactccctctctgggtgaagctcctctccagcagcttcctgagaaagcagcataggaggggccgattcgagaacacgtgcatctgaaacacctctgggaccgtctcactgatttgctagaacactggtttgaaaggattttcccactgcgcttcccatatggctgctgagaggtcagaccccagatcctctatgcgcaacttgatttttctctcttgaaacttttaagattgcgtttctgtttctattccctgagttctgagcttttaggacctccatcctgcctgggggtgtcttctcacaccagggccctttcaactgggaatcacatccatctgctcagtggctttgtcttggatgatctctttgtttatttctccctcattattcagatgctgaacctacaagatgactcctccaattctacctgattccagggctctcttccgcctccttgtgttcatctccaacattactgctatgccatttttttgcaatcattattgatcttcaagagtttctcaaatgctccctgtttcacagatgctattatattctcttactgcactgaggatattaggtacagtatctcctttggaaattcccttctgttccccaaattgtcttggtttctgcccggactatttagttctgcttgtttcatatctgcctttgagatgacagctttcctttaatgacaggtgattatcagctgcccatctccatcttctacttgaggcacttatgcaggggatggaaattgtgtatgggcggctcttgtcaaaagaaggacttccctcggggtgctttgctggggagatgaaccataagatccttggaggaagcattctagtcagagtccacagcagtgcaaaggccctggggtgagcatgtgtttcctgtgcttgattaaaagcaaaagtggaggcctgggaggcttgagcagagggaggaggtgaaggcagaaggctggtgagatcagcaaggcccccaccagcctggtcgtggttcctccaaggtgctgttatcagccacacctacggcctcatgtggaagggccaggcctccaatacgctgagctccgacggcttccagcccttcctgctgccatcagggatggttttctccagactgccacctcaccacaaccacttcttcatttcacacaacggagcccagggttgtgtgcctgccaggccttcagcatcactaagctcatggagagccttgacccgcaggtaccttgcaggccccagcctgagtgcatcagggcatgtgggcagggttgacctcaggtggctttgcttagagagacaacagaatgactttagactcctgagacactaggttaccaccaaagctgcaggtgcctggggatgcagcacccctgagtgggaggttatgggggaagagctcgagggctcacccttccagcgcacaaggaatggctctcctaattattggatctacagcccttggtgggaatgaacgtgacctcaagtcctctctttcacagcctccctctccactaaccaaaccttcccagttcaacctccctctccactaaccaacccttcccaggctctacctccctctccactaaccaacccttcccaggctcgccctccctctccactaaccaccccttcccagactcaacctccctctccgctaaccaacccttctcaggctcaacctctctctccactaaccaacccttcccagacacaacctgcctctccgctaactaacccttcccaggctcaacctccctctccactaaccaacccttcccaggctcaacctccctctccgctaaccaactcttccccaagctcaacctccctctccgctaaccaaccctttccaggctcaacctccctctccactaaacaacgcttcccaggctcaacctctctctccactaaccaacacttcccaggatcagcctccctctccactaaccaacacttcccaggatcagcctccctctctactaaccaacccttccccaggttcaccctccctctccactaaccaacccttcccaggctcaacctccctctccactaaccaactcttccccagcatcagcctccctgtccactaaccaacccttccccaggctcaccatccctctccactaaccaactcttccccagggtcagccttcctctccactaaccaacacttcccaggatcagcctccctctccactaaccaacccttccccaggctcaccctccctctctgctaaccaactcttccccagggtcaacctccctctccactaaccaacccttcccagactcaccctccctctccactaaccaacccttccctaggctcaacctccctctccactaaccaacccttcccaggctcaacctctctctccactaaccaacccttcccagactcaccctccctctccactaaccaacccttcccaggctcatcctccctctccactaactaacccttcccaggctcaacctccctctccactaaccaactcttccccaggctcaccctccctctccactaaccaactcttccccaggctcaccctccctctccactaaccaacccttcccaggctcaacctccctctccgctaaccaacccttcccaggctcaacctccctctgcactaaccaacccttctcaattaaccaactgacttggaaaatctccctgtgctgaccccaatctggtgaaattcttgaggcacctctccaacacacacacacacacacacacacacacacacacacacacacacacacacacacactcgtgacgtttcaaggttagaaaacagccctgcagtacccaaatgtaaggaacaaggccagcattctggactaagaacccatcaacttccagaacattgtgcagtagggtctggctgcagagcacctgaaacatgggaaatgtgcttaagtaactgacatctacattttttttttttttttttgagatgaagtcttgtccgtcacccagactggagtgcagtggcacaatcttggctcactgcagcctccacttccagggttacagctattcttctgcctcagcctcccgagcagctggaattacaggcatgtgccaccaccatgcctggctaatcctgggtaatttttgtatttttaatagagacggggtttcaccatgttggccaggatggtcttgacctcctgacctcaggtgatcctcctgccttggcctcccaaagtgctgggattataggtgtgagccactgcgcctggcctgaactctacattttaaaaaattatagttacatataaatacccatgtgcgtcctgtggttactggactggacagggagctctagaatattctgccaaatccagatgcctcactcagcatcttcatgagattttaccaacgttgcttcccatccaggatagcatctgggtgggtgacggatgcacagattaaatgccattttagagttctcttctgcactgctggcactgtacatctcccccagagtaaagtccctgccaagcaacgtggccctctgtggtctcatttcccaccactggtgtgggcaccatcccacccccacctctgcagctagccagtctcctggctgcttcccacacaccccaggcatgcactgaccccagggcctttgcacgtgtcagccccactctttgagatgcctttccctctgacatcctgagggcccactctttccttcctcttttcctggtctttgccccaaatgtcacagaagccgccctcggctcccagcgtgaaggaaactcgcttccgcattgccagctccgtaccattccaccctcaccctgctgtatttttcttcctgtcatttaccaaccccgacatgttgcacgtttctctgcttacttgttaattatctaatgtgcacttccagagagcagagtgtggtgtggctcactgatgtgtccccagcacctagaagacagcgtggctcttacgagaaactccatatgtactggtggaaataatgaattcgatccctgattacttttcatcatagatatgcaccgaacatcagccacactttgggttacccaggtttctacgccctaatctagaaatacaacttccacttccctgtttctatgggaacacagagtctgaatcccaaataagactcagaggaacttttaaaagaagctacttctaaatgactgactccgccaactgcgtgccctcagcagggccacgacgctgcaacgtggaggaggtggaccaggggcgggctgcagggagcggtggggagtgtggcaggctgaagagcacagcctttccagaggggccacgctcccaacccctgccgaatgtccacatgcacagaggctgcctgggtgtggccacgtttcctaatttttcaagagaagctggaaagctgaattttttaatgaaattcctggaagtttaaataccagcaacacattcaattttttttaaattaaaaaaattaaattttaacatctgggcaggttacaatcaagctctcttgggtcagatccaacctccagacggccgacggtgaactttacactacggctcattctatcaaccaaacgagagctgggccccgggcccagactcactgcctgccctgcaggaggttgactgatcacaagatgaatggcaggtaccagccagtgcccagctccctgccaaccagctgcttctaaatacactggataaacacaccaaaagaagaagggaaaagaaataaaaataatgatttgcttggtcactcacatgtggaagagaaaaggctaaaatcgaagctgatactccctcattcagtctgcaagagcctcagtaccgcccctcccggctccgcccacagaacacaggcagcgggggtgaaagtgggcgaagaaccctgtgcacagcaacgtccccaggcctggcatgctgcccggcaagcagctccccgggggcgcatcatcttagcaaactctcccaggaccctgggctgcacaagctcagagactccgcccgtcatgtggggagacgtcctcactctcaggctccacctgctcaccctcccttcacactgagaataggaaacctgagacggaccagaatcctggaggtggcaccagccatgtttcttcaccctgctgcatagccacccaggaacccacagggtgacctgggctccagagtagggcaccaagcctcacggttggagtgtttgcagggatcatggggggccggctggacacaaccacctcctcctgccatggaaggaagtccccatcccacacactcgctggcactgccctggcccatgctgcaggcctccctgggcccccgtggcctgggccagcctctctgggctcccaaggttggcctgttcctacggtagggctgatgctgatgacagtatccacagtcatgaggcactgtctgacccctccacctgcgcgtcttagtgagtcggggcctctatgccaaaacacctgaggctgggtcgattataaatggcagaaatctatggctcacagcgctggtggccgggagtccaggatcaaggagccggtaggtgcggtgcctggggagggctgctccctgctgcacaggtggtggctctcaatgtgtcttcatgggcggaaagacaaggcagttgccttcagccctttttttggagatggagtttcgccctggttacctagactggaatgcaatggcgctgacctcagctcactgcaacctctgtctcccgggttcaagtgattctcctgcctcagcctcccgagtagctgggattacaggatttcgctctatggcccaggctggagtatagtggcaagatctctgctcactgccacctctgcctctcgggttcaagtgattctcctgcctcagcctcccgagtagctgggattacaggcgagcaccaccacacccagcccatcacacccagctaacttttgtatttttagtagcgacagggtatcaccatattggccaggctggtctcgaactcctgacctcaggtgatccgcccgcttcagccccccaaagtgctgggattacaggcgtgagccactgcaccaggtccacctccagccttttgtacaagggcacgaatcccatcacgggggctctaccctcatgatgtaatcacctccaaaaggtcccacctcttcgtgctgccacaccagtgattaaatttcaacacaattttttttttctcagacaggatctcgctctgtggcccaggctggagtacaatggcgtgatctctgctcactgccacctttgcctctcaggttcaagtgattctcatgcctcagcctcccaagtagctgggattacaggtgcatgccaccatgcccagctaattttgtgtgtgtgtgtgtgtatgtgtgggtgtgtatgtatgtgttttttgttttgttatgttttgttttggtttttttgtagagatggggttttgcatgttggccaggctggcctcaaactcctggccttaagagatctgcctgcctaggcctcccaaagtgctggaattataagcatgagccactacgcctggccaacacatgaatttgaaggcacattaagactacagcacctatatgtgatgctatgcaaacttctggacactcccttaactgcagtgattagccccatttcaaagaagtagagaggagttgcattcatctcccctgactgctgcaccgtgacgtcataaattcatttcccctggctgctgcactgtgatgtcatacattcatttcccctggctgctgtgccgtgacatcataaattcatttcccctggctgctgcaccgtgatgtcataaattcatttcccctggctgctgcaccgtgatgtcataaattcgtttcccctggttgctgtgccgtgacatcataaattcatttcccctggctgctgtgccatgacgtcataaattcatttcccctggcggctgggtggtgatgtcataaattcatttcccctggctgttgcattgtgacatcataaattcatttcccctggctgctgtgtggtgatgtcataaattcatttcccctggctgctgcatggtgacatcataaattcatttcccctggctgctgcgctgtgatgtcataaattcatttcccctggctgctgcgtggtgacgtcataaattcatttcctctggctgctgtgctgtgacatcataaattcatttcctctggctgctgtgctgtgacatcataaattcatttcctctggctgctgcactgtgacatcataaattcatttcccctggctgctgtgccgtgacatcataaagtgggtggcttaaacaatggaagtttctactctcacagttctggaggccagaagtctgaattccaggtgttggcagggctgcccacccccacccaaaggctctaggggagggtctttcctgcctctcccaacttcaaggacattccttggcttgcggccacatcactccaatcttggcctccatcttcacgtggcgttctaacccttgtgtgtctgtctcttttcgcttttcttaagaggacatctttcaagattagggcctccccaatccagcatgaggtcgtcttaactcagtgacatctgcaaaggccctagttccaaacaatatcacattcacaggttctagatagacatgaatttacgggacaaacactttgactcagtaagggagcatttggagacttttaagtaaatcctaagtggcctgcccaggggcaccagctgagaagaaacccaagccagatttaaacccaggttctgcagacgggaatgctaggcccctgctgtgccgtctggccagatctgtggctgagagtgggccggtttccttggggcgtctctcctggccgaggtcttgtgcctcagtaaatgcagacccaaaataaaccaccttcttgggtgactgagaaccaggaatagaattctgaaaacaagttccatcttgttcatagaaatggtgttggacacaacacaaaacctttccaagggtgcgctgtggaaaccgtagtcctttgccaattcccagctgcatttgctccctcctcttttaaagtggatagacacaagctgtctagctacttggctgtcttgttcaaataaatggaattttatcaaatcacccagtaagtgcaaaatgcagtctctgggtggcgatggagctagtacccgtctcagtgctgaaactgttctcaagttggctcctatgccgtggcttttctgtgtggctttcgttggtggcaaacagcagagacgcacccaagctgctgacgattttcatgcaaaggtgaggctgcttcagggcagcactctgggggacgcagatggcagggcggccctggcttcgtgtgtccgggggggcctgagcagcagaagtgtgggaactcgccactgacacccacctatggtctctggtagctgctttctgtggctgtgggaacaaatgatcacaaacaaggtggcttcaagcaacaaaccttccatgcagtcctgtaagccagtgtccaaaatggcatcactaagctgaccccgaggtgtcatcagggccatgttccccaggaaggctctgggggagggtccttcccaacctcctggcagcaccatctgatctctgcccccatcccacgtcccaatcccaccgcctccaccttcacgcagcctccttccctgtgtgtgccctacgaggaccttggtgattacgctggcttacccagtgctacactttgaacactggccctttccaatcctcacattaaaatttaatccccagtgtggtggtgttgggagctgggcctagcaggaggtgtccgggccatgggggtggatccctcatgaacagatccacgccctcccctccgaagtgagtgtattaaatcagggatctccagaaggacagaactgataggatacatttacacaggaaagggagttttttaagggagaattggctcacagcatcacaagcagaagtctcacaacaagccatctataagctggggaagagaggagcaggtagtggcccagtccaagtccgaaagcctcaaaaccagggaagctgacagtgcagccttcagtctgtggtcgaaggaccaagagtccccggcaagacactggtgtaggtcccagagtccaaaggccaaacaacttggagtctgctgttccaggtcagcagtggaaggaagcatccagcatgggaggaagaaggaagccaggagacccagcaggcaaggtcatcccacctgcatccacctgcttagttcttgccgtgctagcagccaactggatggtgcccacccatattgagggtgggtcttcctctcccagcccaccaactcaaatgtccaccttctctggcgacaccctcagacacacccagaaacaatacttgaccatccctgcgggcatccctcaatcaagttgatgtgtaacattaaccatcacagtgagtgggttcttgctctgccagttcccactgagagctggttgttaggaagggcctggcacctccctgccagggagctgggccagctcccgcctgtggactgacaggcacgtgcacctctaggagagccgtgtgtgtatgtgtgtgtgtgtctaatagacagtcttacatgaactttacaatttgcccacatcagctcatagaaattgcaatgcagacagcagcacaacagggacatcctgggaccctgcccatggcactcatcggggaagaggaaggtcctgggagaaaacgccatgaccttgttcccacatccacgtggatttccacaaaacagggaaggcacaaccaaacagtcttgttggggctcatttaacaaggaaagaaactcagaaagccacctggagggaagagaagggtccgctgagcagatttcgtgggtttctgaaaagtgcaacgccaggaaccacaatatcacccacggtgtcaggcagccttcatcacggactgtccctcaaccacacagttgcctccaccagcatgatcagaggaactgcagagtgcacagccactggcagagtgctctggcagccactaccatgcgtggcatgagaaaatgtactcatccccctctggctaaattgctaaatgtgggaactcagtttggagctctgtgcaaaaggaaatcagacgaagggtctggggggcaaaagccaggctctgacatttcgggagatccgccctcactttcatgggctgagtcctcccccagtgaatgcactggggacaggccacatccaaaaacgccttgcccgggatccttgagtgaagagcgcaatacaacacagaaccattgccaacggcattcctgggcctctgccatcactggcttagcctgtggcgatgctggggtccatcacctgattgccagagaactggaaattcagttctttgtttctggcttcggcctttctcctccttctatgtgcagtgttaagggttaaggaagaacacggggtctggcatgcagcagcctatgccctgttcattgtccctttaggagctgtgtgacctgggctcttcatccacaggaggccctgcttcgtgggaccacatggaaagggctcagcacaggactaggcagggtgcccccatgcactgaaaggtacccaaaccaccaagcacagtgtcattcatcagaaagacatccacatcaaggccttctttgtcgtttccctcccatttcatccttgtccttccctgcccatattaaatttgggccttattaaaatggagccattctgaacgtctctcattgccactgcctttttttcctgattttctccaccctttctttgcttctggatgtctggttaaaaactgttgaatacagcctggagaccgacagaatgacagcacgtggggagaaggctgccctctccaaaaatacaatgccaggtgctaaagtccctgtatccaaaaaacagtggaagtccctttcagaatgcagctgctgggaggcaggaacaactcctccagtcagttcccctatgcttcagccagggttctccagagacacagacccacggggtgtgtgtgtgtgtgtgtgtgtgtgtgtgtgtgtgtgtgtcctgctgcttctacattcagggtgtatcagccagggttctccagagaaacacaacctctgtgtgtgtgtgtgtgtgtgtgtgtgtgtgtgtgtctgtgtacatagatacatttatatgttatatatgtatatgcacgcagagaatttttaaaagtttagagcttagacacataaaattaaagatagaaatattttaaagagttggctcatgcaatcacggaggctgtaagtctgaaatctgcagggcaggctggagacccagggcagtgttcagcgggaatctggagtctttttctggcagaattccttctttcttgggatctcagtctttttcctcttaaggccttcaactcattggatggggcccacccacatcatggagggtcatcggcttaactcaaagtccactgatttaaatgttaatcccatcttaaaaaacaccttctcagcaacatctagaatattgtttgatcaaatatctaggagctagagcctagccaagttgacacataaaattaatgatcacaggggaaaattattttcctttttcataaagaaaagcacaataatgacaagaaatctcatggcgggtgcatggaagaggacttccaaagaccagtcattactgcttccctgcctgcgggctccagcttgggtgtgggccgggggctgccatgaacagccccacagacccctactcatccctcgggaggaacaggggcttctccaggctgcagggccgacgatgaaccagaactgacctagcacaagaaagcccagggagggcggggcctgctggcacccccactgcccagtctgaccacagtgggcagagtgcataacctcccttacaggtgtgtaaggtggtaatggcagaggagaacacaaggtagccagagaaaccatggcagtcactgtgtagagaaccaagcaagaaaccagtcagggccctctgtccttgacctccccttgctgttccagagcctcctcttgacctcctaggtagacaggtgctatcagctctcccagacccacctcacccctctgcctggagaccctggcctgcagcctgcaccacagcactccctcactgtcctccaactctggcagggctcagccaagagaagagaggcagatattccttccctgagtcctccctgacatgggcctgcgggccccctcctcagccctggctctcctgctcccgggagcatcatctcctctccctgcccatcagctcacaggtgctgatggctccccaagactgctcttctatggggtcctcagcctttaaccccgtccacacctctacctgatcaggtaaagacttttcactggagacagccggtgaaatctgtttcttgccaagaccaggctgacctacctcctaacccaactgttgcaaggttgggcctgaaaaacacgcccctcgtgcgtgcaaatcaggacttcctggggctcacctgtgctcagaaaacaccggtgctttctggtatcctgccctgtcaggacggtgggaacttggagagggcagggctcctgggaagggggcgtccaccccataactgcagggcactcctgctgtgcagaaactcagcagccttgcctcatcttccagtttctccagagaagtcagaaatgtctatttctatgcaaatgtgtctgttttcaaatactgacgttcacattttaaaatcatttttaattcacatattttcaggaactctgggcaggccaaacaaaatacctgaaggcaggatctaacctttgggccaccctgcttatctgcgggatcggaggagaaggggaagtcagttcgtgggtacaacagagtggagaagcgggcccacgtacctggtggatctcgtgccagccgttctcatctttgcagcacacagtggcgtgttcgtgcaggagaagctcgcagcagtagggatcacctccgacgatggctgtgtgatacagcggggtgaggccgtaactgtctttataatctggggatgcaccaagctctaaaagggtctaggaaaaaaaaattgaaagccgtcgttattggtctcatgaccccttttgcagagtgaggtgatccagaaagcagcaccaggaccaccctcccccaggtcaaggcaacccacaccctgagtacccagtgcttctcctgggctccccagaattaagaagggtataacctggccgggtgtggtggctgacgcctatgatcccagcattttgggaggctgaggcaggtggatcacccggggtcaggagttcaagaccagcctggccaacatggcaaaaccctgtctctatgaaaaatacaaaaaaaatagccagcgtggtggcaggtgtctgtaatcccagctacttgggaggctgagacaggagaattgcttgaacctgggaggtggaggttgcagtgatccaagattgcaccattgcactccagcctgggcaacaagagcaaagctcagtctcaaaaataaaggggggggggggcaggtataactttagacaactacatttctagttctgaaatagcaaacagtgcccagaaatgcagggcaggctgacatttgggagacgaggagacctgcagcactcagacccttcctcggcctggtcaacattttgtgccagtggtgtggcatgggcagcaatacagtgactgcaacatttgcggaagagagaaaaggtgcatggtttaacctacatgcccagtggaaaaccacctcattccgcacgctgagggtggcgaacctagcaagcatcgcgtcttcaagaatgctcctgatttccgaggaagccaacgggtacggtgtggctctgcgtccccactcaaatctcaattcaaattgtaacccccagtgctggaggtggggcctgatgggaggtgatgggtcatgggggcggattctcaggaatggcttaacaccacccactcagtgctgctttcgtgatagtgagtgagtgctcatgagatctactgtttaaaagtgtggcatctcctccctctctgtcttcctcccactccggtcacaggaactgcctgctcccgcttcaccttccaccatgattggaaacttcctgaggcctccctggaagcagaaactgctctgcttcctgtacagcctgcagaatcatgagccaatgaaacctcttcttataaattactccgatctcacatttctttattgcaacgcaggaacagactcacacaccaacagaaggggtgcagctgaaatgaagtgaaagtcctgagactttagggacagcgaggcccccgtcttgggggtcaacctgcagcggcacgtcccatccctgctggtgtgggctctggtggaggatgcctgggcgtgcaccaccctgtccagaggcgccgtggctgcagtgtgaggcaggggcacggagcagtaagacagcagcaggggaaggtgaggcgcggaacccacaacagggcaggctcccacggacccgccacagggtgctggggggatctaccatgtggctctgtgtcccctcccaaatctcaattcgaattgtaacccccagtgctgggggtggggcctggagggaggtgatgggtcatgggggcggattctcaggaatggcttaacaccacccactcagcgctgctctcatgatcatgagtgagtcttcctgtggatggggttggggttcaccactggccttacgggttgaaaagacaagtcccttgactgaatagaaggtgaaagatgacttcttgggaaccattaattctgaaagcatcgacaaccaggagagagaacaggaaaatctgaaacctggcttcacttccaagctccagccggaacactgtgcacggactcctagggtgggccggaacactgtgcacggaccccctaggatgggcactgcggggatgggatggggcagccgcacggaatcagagcacggggtggcacccaagtaagatgggcccgagtttaccttcagggcaacttggttcctcgctcgggcagctttgtgtagggcggtcatcccatctttggcacggaagtccaggtgagctccaccatttttgagagctttgatgacctccacagagtcgtccagctgagcggctaaggtcaggggggtctctgaggaacccaaacacacacactttagaaccaacatttgtcacactgctcacaaagccatattcagatgcccaaaactaagctgaaagaactgactcccctcctccacctccagggtgtttacagctcccaccacctgggaaccccaagagtccaggcgggcagcgtggctcaggcacccccgtgcgatgcagtgacacgcagggccacgcgtacaacacagcggtggcagaggcagggattcaacaggactgctgtgtgggccacagtccaagaggctcccttgctgcccttccctctgagtacacagaatcctgtggtaccatctgggtgcttcccgtacagaaggagtgacggactaaagccctcattagagatgggaaaggcagacacccacctttcctcattcaatgtcacatttatgggcatcttgggagatgccagccatgggctgcagggacacaaacacaaatgagacatgaagtccgtgccccctggagctcccaatctgggtaagtggaaaccttccttcattaacgcggcgcaggatgacccaggaggcagggcagaggcccagcagacagaaggatgccgtctgcctttgtagggacaagggtcccgtgcagatgaccctggaccagtctgcagatgagcgtggctaaggacgtcagtgtctattacaacaaatctttccgtccactcttcatctttctaatatgcccaccatggccactgctaaacaagaggaactactttgaggtcctcttttgagagttcctcatttgagaggctcttaacgttccagaaaagtgcacagagtaccaggacaacacacaagttcccatgacccagaaacaccaacaatgaatattcactcggtctcgaagcacattccagtgaaagaaaactcggatgcctttcacaaggcgtgtgtcttgctgacccctcaccccatcccatccccctccatcccagaaagggcacctgccttgtgagtgtgcactgactattcccatctatttttaattgtgatgtttacttatccatacatgggtaccctcctgaggacttttaacattcaccctaggaaccactctgcagcttggcacttcatggtgatatgcacatgcttaacccctccatgtcaggagtgtgctgtgtgtagacatgccagcatcttcattcatcctgtctccatgtgaaaagcaggcttcctgtcttccccaactaggatgctgtgtgtagacatgccaacatcttcattcatcctgtctccatgtgaaaagcatgcttcctgtcttccccaactagaatgccgtgtgtagacatgccagcatcttcattcatcctgtctccatgtgaaaagcaggcttcctgtcttccccaactaggatgccgtgcgtagacatgccagcatcttcattcatcctgtctccatgtgaaaagcaggcttcctgtcttccccaactaggaacgatgttctcatgaatgaatgccattgcacatgactctgttgcataccctcctgatgcagaagttttaaagaaaaatagaaattttctgggactaagggacttcagtggcagtgggggatgtttcttgcatagaaaacagctacaaggcaaggaaggctcagcaaggggtgtggggattgagaccagttggaacatggccagagttccacatgtgcacagagaggtggaaatggggcagacgccagagaaaaacaaactcaaggggtgacccctgcctgctagagagaggaacagtcagcccctcattctctgtctcttccctggtggcatccaggctgaagcacgagtgtccgagggcatctggggagtttattccttggagcataaaggccaccatgggagagtggacagtcagggaagtgactgatcctcgaagggcacgaaaagactggggctgtcgggagccaccaatatcgacgctgaacattcaaatcttacagcgacttaatgagcgtgtgacactcgttcggggcaaggttagccttcaaaacagttaggattttctttcccatttgactgttcccttttgcccaatgcaaaaaggcagtccaaagcagattttttaaaagatattttaaattaacatataattttcatagctgacaacctcagctgttccattttataaatgagaatgctgtctcagagagagctggtggcaagtggtaaaatcagatcagaggcttgaatcctgacttttgactcagaattacagatgcctgcagccaaaccacatcctgttggtcagtgccaggcagttaaaggtggctgcataaacgcaccggtggagaaaatgatcccactctgttcatggctgtgtctcacgtgcaggatggggagctatgtgtggtccttgggtggcttccagggccatccaatgacaagtggcagccttctcaagggttccggaatccctcctcaagtgatgttccagacttgcatgttcacctctggccaggacccaccctggggaggtcaggagaccccctcttcccgccctggcttagccaccacatttgcaaagagcacgtccgctgaggttccacatttggggctgatggaatcacccccgagaagatgctggttgatgagctataaaccggtgacagatataacagcactgcccgggatgcacacccagtgactgcactatcactcccctgatgagcatgggaaccacacagttatctggcaccatgattcttaagactattcctcaggttttgcattttgaaatttctttagttttaaaaatagactggaacctcaacaagcataacctcagagtggccccagtctccctcaacgtgaacaacgggtgggagtagaaacacctgtaatattttgagataacctcagagacacgcagaccctccaactagaggctgcccagcagactgttggctccagggataagcaggatgtgcttcgaaagggtgagaagcgggggctcccggaagcgcagcaggagggcactagccacggctgtttgtcctgacactgggaggtggcacagcaatggggggtggggtgggggcaggaggcaggaggagtgtaagtgtttaagacagctgctgctacccagcgggcacagggcagtgcaggctggagcatgtgtacgccagtgtatgtgtgcacacctatgtgcatgcctgtgtgcctgtgtgtgcatggctgtgtgtatgcacacctatgtgtgcatgcctgtttgtgtgcacgcctgtgtgtctgtgcatgcctgtgtgtgcatgtgcctgtgtgtgcatgtgcatgcctgtgtgtgcatgtgtgcctatgtgtgtgcatgcctgtgtgtgcatgtgtgcatgcctgtgtgtacatgcctgtgtgtatgcatgcctgttgtgtatgcaggcctatgtgtatgcatgcctgtatgtatgtgtacatgcctgtgtgcatgcatgcctgtgtgcatgtgcatgcctgtgtgcatgcctgtgtgtatgtgtacatgcctgtgcgtgtgcatgcctgtgtgtctacatgcctgtgtgcatgtgcatgcctgtgtgtgcacatgcttgtgtgtgtgcatgcctgtgtgcatgcctctgtgtgcatgtgtgcacacccgtgtgtgtgctcctaggtgcatcctagtgtccaagatcagtgggctgcaaaaatcaaacgactgggcaagcgattcttcctatgaggggaagtgactggtgtcaacaaaacccagctctttccctgaagggctgggtggcctccagcaggttttttagaagatgatagttcaggaggctggggatgctcagaaggaaaccatgatgtgagagaagaccacagaacatatcacaggtgtaggaatcaacctcgctgaaagggatggggaatgaaccgctgacctcagtagctccagacatgagtggagtctgtaagactaaaggcaaaaggaacagaataaataaagctgggttataagtcaaccagaaagtgagtgcaaccacattgatagaaataagcaagggattcacaagtgaacgggaggaaggggccgatcttgcaatgcagacaaactccaagcaattcgcatcacttctctgtcctcagggggtgatgcgtagcccgcaccaccccccaccccgatccccttatgtgtgggctgtgcacagtggcttccttctgagagcatagtgtgggaaacagaaaaacgggaccatctctccgtggggaaacctgatggacacgagctcagccaggagatgggggggcagcatcgcccaagatgagccacaccaacaggacgggccctcggcaccaggtgatgagaaaggctctgtgctcttcctcctcacacccacagcccctaatcgtgaaaacaccagatggatcccaataaggggcaccctacaagcacctgaccagtcctcctctgaaactgtccaggtcatcaccaacagggagagcctgggaaacaatcaccaccaagaggtgcccagggagacgaatgagggaatgtcatgtgggaacccgggtggggcccagggacaggaaaggacaagcaggtaaatgcttatgagagaagaaaaaggtgtggacttcggttaataataatgcatcgatatcggttctctaactgtgagaagcgtaccatacgacttccgctcagaagaatactggagtaagatgctgataaggggggaagctgggtataggatatatggtaactctgtgtactatctttgcacttattctgcaaatctagaactgttctaaaatgaaaagtttgtttacaaatgtctcctggctattgtgcgggttaacagatttaatgtaaaaaatgctgctgctcagagaggcagaaaatgtttgtgaaaagcgtataaagtacttgtagccaaattatacagagaacccttaaaactccacaagaaagcaaaccacccaattaaaaagggaacaaaatatttaaatggatacctcacaacagaagatattcagatagccaacacacacgagaagatgctccacaccgtatgtcattagggaactgcaaactaagacagcaattagaggctgtgttcagtggctcatgtctgcaattgcagcactttgggagccaaggtaggaggatcatttgagctcaggagttcaagacctgcctgggtaacatgaggcctcacctctactaaaaatttaaaaatttgccaggcatagtggcatacgcctgtagtcccagctactcaggaggctgaagcaggaggatcacttgagcccaggaggtcaagtttgcagtgaaccatgatcacaccactgcactccagcctgggagacagagtaagaccatgtcaaaaaaaaaaaaaaaaagacacctcaacacaatcgtcagaatgatgaaaatctagaacactgacaacaccaaatgctggggaggatgtggagcaacaggaactctcatcattgccagtaggagtgtaaaatggcgcagtcactttggaagacagtttggcgagttgacacaaaactaaaaacgcacttactccacaatccagcaacccagctcctaggtgtctccctgaatgagctgaaaacttacgtccacaaggaaatctgaatgttagtgtttacagcagctttattcatcgttgccaaaaatggcaaacaatccagaggtccttcagtaggtgagtggatacattatccattgcacatgcagacaacaagatgttgttcaacactaaagagagacaagctgtcaagccacaacacgatacgaaggaagcttaaatgcatattgctaaatgaatgaagccaatctgaaaaggctgcatgctgtgtgattccaactcgatgacattctagaaaaggcaaaactatagagccagtggttggccaggcacagtggttcacacctgtaatcccagcacattgggacgccaaggcgggcagatcatgaggtcaggagatcgagaccatcctggttaacacagtgaaaccccgtctctactaaaaatacaaaaataactcaggcatggtggcacacgcctgtagtcccagctactcaggaggctgaggcaggagaattgcttgaacccgggagtcagaggttgcagtgagctgagatcacaccactgcactccagcctgggtgacacagcaagactccgtctcaaaaaaaaaaaaaaaaaatcagtggttatgaggggttagagggcaagggagggatggacgggtggagcacagaggagggagggatggacgggtggagcacagaggagttttagggtaaggaagctatgctgtgtaattctgtaatggtgggtacaggacaagatgcatctgtccaaacccataacatgagcagaccctcatgtaaactatggacttcagttattgcaacaaatgccctaaaccagtgcatgctgtcaataacaggcgagctggaagtgaaagtgcataggggaaaactccatgccttctgcctggtttttctgtcaacctaaaactgggctctgtccccgaccccaagacaggctcctgtggaccctggcccctgcctccgtgtcacccttaccctcgccactccctctgccgcattttccttactgaaggcacggcacctcgctccatctaagagtcacctatattccctttcagaacatggcagtgtgtacatagaaaaaccctgaaagaatgagacactgtatttgaaataattggacccttaaaaacaggtctctttttatgagaaactgtactgaacaaaccaaaggcactggtagcaaagggagttatttactcgaagtcttccagctccttcattggcactgggtaatttctgcacctctcaccctctgcagatggaggtttacgaggttccagaaccattattctcttgaattgcctcacattcccgggtgccgttagttctggggaatcgcacttggcgattcattcaggggccaacgtgagactgcggagcatgaaccgtcagtcactgcacacatcaaacaagccccttctgctcttcaagacgatgctctgaaggtgctcagtgcactgggacccagaatgtcctcgaggcctcctaactgagcggtgcgggagctgggaaggggctccccgtgacacagctacagcagcaagaaggggaagccggagttggggggcggccgaatgggaggagctcagcctggtatgcaatgagtacaccccgaccctggaaacagattcagtaactgaatctcatcagtgaggtccagacacatcacaggtgctctgcagaatctggatccgtaaaggaaccatctctttttgacctctcattcagatactaaaagagtcgaaaggcatttctagctttattagccagatctcttttgtggtgcctgaggcttctctcaaatttggagacaacagtgcaagataaaagggccaacctaaattttgttcaagttgccaggttcgcttcctgtttggggcttggaaacacaactggtctcatctcagagtttccaaccaaagcaggagaagaggcctgagactctgctggaggaagtctttattttttttttttacactacttttatcattgttacttaataaaatttacatttagaacaggtaccagatggtcgcctgcaatcacacaggctgttttgttttcattgacaggtcgttccactgggatttaattatctcaggctagagggctgcttccctccgctccggccccatgtccagccccaaaacagggacgcggggcccaggtctgcagggcccgggactgagcatggcggcatttcctgagcttagcaaaaaggctgctttcaactctaagcacagactctgctgtcccctgggtggctttgagaagtcaccaaactcactgtggagaggctaaaatatgggatgggaacatgcccaggctgctgccgacaaccaggtggaaagtgggaatgtgaacagcttgtccccgacctgggcctgcctgggtcatccacgtccagccaggccggctcatgccaagagacccctgttcgtcccactgccttttcccccaggagttgagagcagggaccccccagggcaagtggagcccaggccctgcctctgccctccctggtgactcagtgactggcccagactgggctgtggtaacaagatcccagaggctaggtggcttaaaagtgacagacatgcattgctcatggttttggaggccagaagtccaagatcaaggtgctggcagatttggcgtgtgtctacctggttcacatagggcaccttcttgctgtgacctcacctcacaaagtggaaggagcgagggagctctctctgcctcttttgtaagggcactaatcccattcacaagggctctgcccccaggagcccatcacctgctgaaggccccatcctcctaataccatcacctagggggttagggttcaacagtatagaggatgcagacatcagccctagcggccacccagttgggctctcagagcttcagattcctcccaggacagcggtgcctgcaggggacccccttgattacagagctgaggcctggcaaggccctgtgtgctgctggagcacagcaggtcaccaatagactgcagctatcactctttaagtgcccttgttactggtagggtgggtaacagtgccagtctccctgggaccaacaggcttcccaggatatgaggcattcagtgctaaaaccagggcagtcccgggaaaaccggatacactggtcaccctgcctgtttcctggaggcagcccgccaaagccaactctgtgtttctccctctgcatccaaaaccaggagaaaacaacattgactgagctgccgtagttgatgctgatgacaggaacattctggaactctattaaaggtgacgcataccccatacgcttaaccactgatatggtttggatgggtgtcctgcccaaatctcacgtggagatgtaatctccggggttggaggtggggcctggtgggaggtgactggatcatgggggcagatttgtcatgaatggtttagcaccatccccttccttggtgctgtcctgacaattgtgagtgaattcttgcaagatctgattgtttaaaggtgtgtggcacctctctctctctccctccctccctccccccctccccttctccctctccccccctctttctctctctctctcctgctttcaccacgggatgcacctgctcctctctctctctctctctcccttgcttttgccatgcaatgcacctgctctccctttgccttccgccatgcgtaaaagctccctgaggcctccccagaagcagatgccaccagcttcctgtacagcctgcagaacctagagccaattaaacctcttttctttataaactacccagcctcaggtatgtctttacagcaatgtgaaaatggcctaatagcaccacaacgctcacctaacgctcacattttcccggcaccaccgtaggtgttatcattcaatttaggagacaagaggatggaagctgagagaggttcattaacctggtcttcacacagccagctgcagagaagtaggggttaatgtctcctctctgggggctctccatggactggcactgagctgggcattggaagggtcgcctctgcagtcccaacacagggccccccccatcctgcatctctgaagcccagtgtctccaacagtgatgtcatccgtgtggccaggtagtgtctgcatttcagtcaggaggatgcgtatccgtcccttatgctctgccttgacagaagcaaagtgaaggtggtgtcttccctggcagcactgggctctggcctctcgttggaacttgcgtttagcttgtccccactgatacttgctccatgtgtgcctgagggttgctataagccattgtgctggaattacccgcagcttcctttgtttctgagagcacccaccctggttcacttttctcttttcccccgtcaccctgggtcctcacttttctcttttcccccatcaccctgggtccccacttccctgcccctctaacagcactgctggtttctctcctgatttggaaaaaacaaatgagaattcttgagacactggtggcaggcgcagaagctgggaagcagggtggtgtgagaccagggccatctgcgctgtctgcagccgacctgtgggtctgcacttggccttcggtttcagaactttctgccttagttaccccttttccctttttatttgccataagtaatgtttttggccttacaaaaaaatgccactgtgtatgatcgctgttagtttgatctgtacaaaaacccacacacgggtgtttatggcagcttgacccacaattgccaaaagctggaagcagcccagatgtcctttaggaggcaagtggataagcaaactggggtacattggaaaatggaacattatccagcaccaaaaggaaacgcgcttccaagctgtgaaagggcctggaggcaccttccgcacgtgctgccatgtgaaagaagccgatctgaaacccactgtgtgattttaagattccagctctagaacattctggaaaaggccaaactacagagacaatgaaaaggtcagcaaggttgagtgcggtggctcacacctgtaatcccagcactttgggaggctgaggtgggtggatcacttgaggtcaggagtttgagcccagcctagccaacatggtgaaaccccatctctactaaaaataaaaaaattagttgggcgtggtggtgcacgtctataatcccagctaccaggaggctgaggcaggagaatcacttgaactcgggaggcggaggttgcagtgagccaagatcacgccactgcactccagcctgggtgacagagagagactcagtctaaaaaaaaaaaaaaaaaaaaaaaagaaagggtcagcagctgccaggggctcagggatgaagaggggcacagaggagctctcgggcagtgaagctgatctttatgatactgtgacggtggatacaggacatctggcaaaactgacaacgtacaacaccaagagtgaactctcatgtaagctccggactggaggatcactgttgggtacaactccaggcgtaaaccctcatgtaagctccggacttgaggatcactactgggtacagcaccaagcataaaccctcatgtaagctctggacttgaggatcactgttgggtacagcaccaagcgtaaaccctcatgtaagctctgtacttgaggatcactactgggttacgactccaagcgtgaaccttcatgtaagcttggacttgaggatcacaactggttcactgattgtaacagatgtcctatactaaagcaagatattactaacagaggaaactgggggagcagtcaatatgggaactcacagtacttctattcaattttctgtcagcctaaaactgctctaaaaaatcagctctgctcatttcacaaaagggaggcaggggaagaggaagttctgctttatagagaaatatcagctactacaagaagcaaagctggttcataaaattgccatttggcaacaaccaggagagaactgattccataattctgccttaaattttaaaattgaaaataagaggctgggctcagtggctcacgcctgtaatccaaacacttcaggaggctgaggtgagaggactgcttgagcccaggagtttaagaccagcctgggtcacatagggagacccccatctctacaaaaaaacacaaaaattagcccagaggcttgtcatcatgagaatatttcagaacattcataaggtaactctgtgctactgtctccatggatcaggctcccaagccatttctactcagctctgggaaacatggtcaggtctttctcctttaattatgctgcttcacaacggctcacaacaactatggaccttctgctttggtaccggcctaatccagaattccagcggcagaattccaagtatggtggcacgtgcctgtagtcccagctattcaagaggctgaggtgggaggatcagctgagttcaggaggtcaaggctgcagtgagctgtgatcctgccagcctgggtgacacagtgagaccctgtctcaagaagaaggaaggggagggaaggggaggggagaggccaggcgtggtggcacacacctgtaatcccaacacttcggaaggccgaggccggtgatcacttgaactcaggagtttgagacctgcctgggcaacatggcaaaaccccgtctctacaaagaataccttggtgtggtgccacatgcctgtagtcccagttacttggagggctgaggtgggaggatcacctgaacctgggaggatgaggttgcagtgagctgagattgtgccactacaatctagcctgggtaacagggggagaccctgtctcaaaaaaaaagaaaggggagtggaggggtaatgatttctgtcaaggccaaaaccaaaacacaataaacccccaacctctatgcgtggtcaccatctccctgggtgacgcagggaagtgtcccgtaaggaagcacgcaggcattcttccctgcacgcattctgtccttgagcaccaaacccactgggccctgtcccagaccctggccccgtgggtctctgcctttgctggagaccctagaatgcctgtccttaactatgtgctctttcccaggagccacttatcggggacctgatgacaccaggggttcctctgtcttctctgggtttggtctttgtgatcagtaaaccagcccagaggcttgtcatcgtgggaatatttcagaacgttcggaaggtaactgcgtggtaccatctccacagatcaggttcccgagccttttctactcagttccggggaaagtggtcaggtctttctcctttaattatgctgctccacaacggctcacaacaactatgaactttttgctctggcaccagcctaatccaggatttgagtggcagcagttttaactccaggcaggacccagagaaatcgctgcttacctgtttcagagtctgcactgatgtgtttttagcagtgaattgagagtctattctggaataacagtcatctcagaaccttaaagtcgagacattaacagtctggtggaggaagccagggggaggcttggctcaggacaggggccaattacagggggcacatcaggaagagaggtgcagagcagctcagaggggacatccagcctccttctactgctggccaggccaaggcgagacagagagccacgctgcccagtcccccgcagcagcatcagaaatagccctcgacgaggccaagatgaagacataagtggctctgccagggtggtgagagccacggccaaaggctgcctccagggagaatccgggtcagcagctcagaatgaaggctgcccctggatgtgccccaaggctcaaggtcatgctcaggagcacctgggtccatttaccttcacagcctcacatggaaagggctcatgccctcacagagccaggagctggcacaggggccatcactgaagagaagctgccacatcagcgcagcacgagacgcatccacgtcagggaaagatggtcggccagggccctcccaagcctcctacagacgtacacgccctccatcgcaccaccatgcctgagctcaggcctctctgcttcccagctcagctcctctcctcctcccactgcctgccccacagctgagggccactgcagctgcccacctgccctccagatgccctactacccacccctgcccaccacatgcccttgtcccaatcactccctttcccctctccccttctccagatgtccctaccaacacaagcccaacccagcctcctgctccaggccaccggctgagactgcccagacctccagcggaagcccagccttgtccacgtcactgccctgcaagcagacccccaggcttccctgcctcatggaggatcggcgcagggcctggggctgctcagctgtagccaggcactcaccttccttctttccccctatccccgggggcactctgtcccctctgagcctcgctcatgcagtcctgcctcccaacgtcacaggcatcaaagctaccagcagccacaagcccgtgccggcttctcctgctgctcacagcgaagcctaagggacacagacaattgcaaaaaggcaaggacagtcccccggcagtgctcagacagagctgtgcaggctgaatccacacccagcgggcccccccccagcgttcagaggtcgagggggctcccacaaatgatgagaaagtggcattctttggttgacaaacacatttgttgtgtattttatatttttgaggtgtgacaccagtatgtgatgatggcactataccatgcaggggccagaagcagggctggcacactcaagacaagaggggagggagtccaggaggagtattcccagcccaggacagcccacctgagggggcatactctgctttgcatggagaccctcacctccacccctcttggttctccagtaggacctaacctctgcctgccaactccagctggtgccctgctggcaagagactgtcacctggggtgacagtgcccacacccagggacagtgggtgatgtctggagacactgttggttgtcacaactaggggttgctattgatgctgagtggaggcgggtactgccactgaaccctgtgatacataggatggccgcgctgcaaagactcacacactcgtggaaccaccaagggcctgggccatctttcccgaccgatgcccagaggcccgcactcatgaggaatgtggtttccagcaggggaataagatgcatgggtgcagatgcccatctgctgggctgcccgtgcccagcgggaggcagaaacacacatcctccacctttacaaacatacgtgtctgtaaagatctgtgtgcccaaggctggcacaacacatgcgtgtcatctgctcattcattcactcattcacctcctcaacaattctgcactgaacacctgccgtgctccaggccccacgcaagatgctggggatgccccatggacaaggcgggctcggccccttctgactgagaagacagaggagagtgagaatgcacctttaaacaccaaacaaaaccaagtaaaaggtaactgcagcgttattcacaggtagcctgagcagtgggctggccttctctacgcttccgtaaagcctggtaaggtcccctctagcaagtgctcacctccggtctccgggtcgtggaaattgggatccaggcctcggtccagcatcttggtgatcttctccaccaagcgatgctgaatgtgatccatgcatttcttcagattggtctagaaggaaaaacaatacaattgaaacatctttataagaaatgtcccaacctgagcaacaaagtgagaccccgtctctacaaaaaatagaaaaattagccagacatggctgcacacggtggctcacgcctgtaatcccagcactttgtgaggccgaggcgggcagatcacgaggtcaggagatcgagaccatcctggctaacacggtgaaaccctgtctctactaaaaatacaaaaaattagtcaggcgtggtggcgggcacctgtagtcccagctactcgggaggttgaggcaggagaatggcatgaacctgggaggcggagcttgcagtgagccgagatcgcgccactgcactccagcctgggcaacaaagcgagactccatctcaaacaaacaaacaaacaaaaaattagctagacgtggtggcacatgtgattccagctacttgggaggctgaggcaggaggatcgcctgagccgaggctgcagtgagctgtgttcatgcctctgcactccagcctgggcaacagagaaagacctgtctcaaaaaagaaaaacaaatgtctttccaggctctgggaaagttcctgactggtgcactcgggagacccaccctcgccagggtgcaccacaagccctgaggctcctggagctgaggcttttggaaccacagggtgagcacagtgtctggcacgtgacaagtacaatcggcctatcctggatgaatgtttaaaatcccctcaccgttcgccatcctagtgctacggacttaacgtgtgtgtccccgcaaaattcataggttgaataatctccaatgtaatagtatggagaggtgaggcctttgggaggtgacgaagtcaggaggatgaagccctcgtgaatgggattagtgtccctgcaaaagaggtcccagagagctccctcgccccttcctccacgtgaagacacagcaagacaatggccatccaaaccaggaactgggccttggccagatgctgaacctgccgatgccacgatctcagacttgcagcctccaaaatggtgagagtcacacttttgttgtttataagttacccaaggtattttgtaaaagcagcgtaaatggcctcagacacttgctgagagctatgaatgctcctttgctttcgtaagagacagctgggccgctggagcacttttccaatctccagtttccaggacccacctcctgcctccatccccagggagtgaggcccgcagattggtacttaacccactttgtggtgaaccccatggccacacaggcagaaatagcgatgcctggtccccgagtggctcaaggtgaagtgcgggactcatttcctgtgaggtcatgatggtccgcagatcaacctgatggggtgggaactttcccagcctctgccagcctcgctgtaagaaaagtcatgattctctgcccatccagagccagtctgggctgtctgagcaggactgtgggacttggcacccttccgcctgctgcgtctaacactcctcaccagcctaattctttgcccctactccgtacctctctcaaaacacacagaagggggacaaatgcggcttctgacacagcaggttcctgggcccttcaacctcctggcacgtgctagatttccacctgcccattttctgtatgtttcggaactagaactgatcaaatgccctcaaacacatgacttacacatggtgtcactgaaaacctgcattgctatttacaaatcagcatttttaaaattcacaaatacgtttttatctgcacatcagagggtgataaaaaacaaaagccaaaacccagaagcacccagatcttgccgtctgaataccgctttccaggcaaattccagggcagaggcaggggaagtatcggaagagcccagagcatcttgtgccataaagtggctggtgtgtcaaggatggtggggatgcaccacatggcagaacaccacaggaagggcaactgccgcccacatctggacaacttgagcacaaaaatcaataatgataatgacagattagaactcagtgagcacagtaagaatcctgccgggcacagtggctcacgcctgtaatcccagcactttgggaggccgaggcggatggatcacctaaagtcaggagtttgagaccagcctggccaacgtggcaaaaccccatctctactaaaaatacaaaattagccaggcatggtggtgcatgcctgtaatcccagctactcaggaggctgacgcagaaggatcgcttgaacccgagaggcggaggttgcagtgagccaagattatgccattgcactgcagcctgagcaacacagcaaaactctgtctcaaacaaacaaaaaagaatccttgcatgcatctgatataaggaggaggggcagcaaaacaaaaaccgagaggatcctgctggctgagaaagccattggtgagctcgcagctgcaggggagctcacctggagagcatcagggccctcaaagggaagcgcttcaggcagctgcccggactctccaccccatgctctgcagggagtgcaattgggctctccttaggaacagcaccaggggccaggggccaggacaaaagcctcctgggtattacagattcctcctcctgttggttaagcaaagtgctccgcccacacaccctatgcctcagccccctctccacgcctcctcctcgactcgcacagcaccctgaaagacagcagggtgttcatggtgtggatgtcttatctgggactctgagctcaaggcatagtgcattccgccaggttctgaacactctgtgcaacgcccctgctgctcacctgcagtctaacttcagtgcaatttatgtgaacagcactttaacaaggtttttcctgaagcaacaacagcagaacactaatacggggctcactgtggacccgcttccctccaccacgccaggcgtccagatcccactctcttcagagatgccgcttttgaccctccctggagcagccagtaggatctgcctcccttcccccagcacccacggccacactaagcagcccctgctgcctcccgggtgggtctccgcagtgtgcaccgtaagggccagtctgcctgtacatcccagcccagccacacgccatgccaggtacacagcaggtgcccctggaagaggagcgtctaaagataacacaacaagataacaaggaggacgccgcctgcctaacgtgtaaataacagcccgttccctgcataccttcgtgtggagcttggccaactgtttctcatcgagactggcttgtttatacacccgcttcttgtatcgaaactggcacagaaaacaaaaaagagagagaaaacaagtcaatacttctcagagttgttcagagggaaaacgggccttttccttggctatgtcacagaagacggggaaccccacagcaaacttccagttttaaataaatgactggtatttgcaccccagagcctacaacatcctcagcatcacttttgtcaagattctgtagcagtttagctaaaaagccatataaagaaacaggagcaaggggaagggaagatcctgcaggtgagaagctgggaggtctccctcccggtgaccggctccccagctaactgagtggttatggttcctcccaggggaatggatcagcccttggcaaggcatttttggtaaatgaggatgctgcttcaaacaccaggtttttctcctacattgtccacctttgttaaaacacaccctaaaagcctgggctgggaaaggccccacctcctgtactcctgcaacctctgcccagatcgctgaagccactgtttttccctccaaacagcagcgcctcctttgaactggaaattacatcactgcatgaaccaaggagcacatcttcctcagatgcacggagtaagcaacattgtcggagtgggcttggtgagactctaaaatacctcctccctcctccagccccccgcttggctggagatgctgcagaaggtctgggaaggatgctgagcatttaggagtcactggagtttggagctgggacctctgttccaatcccagccctaatgctctcaactcacagagttaactcagggctgggcactttcccatctcagtttccttatctgccccatggggataatagcacccacctcccagggtggcctgagcattgaatgtgagcttcctggcacagacctggcactagacaagtccactttatctctccctccttactgcccttgatgccgtcaccctgcacggttacacatgtgctcagagccagcaaaaaccgcccctgggtaaaatgatggtgcggggcaggtggcgggtgagctcatcctgaaactgaaagtcgcatctcacagaaaagcttccaaataaacaaccctagtctcctttctccaccacgccaaacaaaatggctatttgacaaaagacaaaattcttgtgcacagactgatacttgtggggttttgttttcaactggccaaataaaccagctgtgaaatcggaaagttctgtgaagcgcaggctgcacagagtttggggagaaagtgcgctggtcagaagggcatccattcatttcccagaacagagcaggcaggaggagctacaggcccattttagaacttccacttctgattctagatttcaggacagcaggttctgtgcgtccatgccccgggaccaatcacacctctggtccagatttcagaagccactgagaatgatgccaggtgccttctcaggctcatgatcatgtggctaagcttaaaagtctcagggaattcaattccacggggcccctttccagacataaaacaatccgcttgggcccacagcatctctggggcaggagggtaaaggactcaaggagggagtgtttattccagagtcacaaacatttatagcccatagctacagaggacaccggctcaggaccacagaccctttttcttgctatttctccaacatttcataagcagcccaccatattgtgctgaaattatctgaggcaaagagcccagactgatgcccgcccctaatgtgtcaatccctgagccaatctcagcctttgcagtgggtcatgcaaaggagattaataaacctaagtatcggcatcaattttggccgggcgtggtggctcacgcctgtaatcccagcactttgggaagccgaggcaggtggatcaacctgaggccaggagtttgagaccagcctggccaacatggtgaaacccatctctactaaaaatgcaaaaattagctgggcgtggtggtgggcacctgtaatcctagctattcaggaggctgaggcacaagaatcgcttgaacccaggaggcagaggctgcagtgagccgagatcacaccactgcactctagcctggatgacagagcgagactcggtctcaaaaacaaaacaaaacaaaaaacaaagtatcagcaacaatttcatgacaatgaaaccagagcagcagctgcaaagtcaatttggggacttgtggatggccaggctcacaacgcacacactgctccatgaacacttcctctgggcctcacgaccactcccggacatcactactaacattcactcaatgtcatgaatgggaatccggggctgagagagcatgggtggctggctcgaggttgcacagctgcaggtactggggccagatgtagaggagactcccaaattctctggtcttctcgcccagttttcctgccgttatggaaatgatcagcccctgaaatgaactgcatggatttactcttcctggtccatcacctcccactggagtgtaaggtccgtgggatcagaaccttgacttttctgtgccagaaaagtgtgtggtccttagttggccctcaatgacaatttttttcccaatggatacccattttacagataagcaaactgaggccaggacagctgagtgatttgctctaaaccacacaacttccaagtggcatctcatctttttctacactgaaacccctccctgaatctgacacatggtccacactggggatcccaataacctcagcctcagtgtcacaacggaactgagaaacgtgcagacgcggcatcaccttagccctgggtgggcgtccatgacatcttgggcttcagaggaatccctagtcactgagtagagaacccacttaggttgctcaagtgccagctgcaattacacacatgcagcctcttgctgttgactaagctaaaatgagtgcaatcgctgaatgatgccaacatgttgtgcaggagtagaaatgatccgtttctggcttctcttaactgacgtaacccaacacgtatacactgcaggaaacaatgcctgtaaacttggggcgtagcaagcctgggtgagagaggtagggacaggggtcgtgcatcacgtggaaatgtgtagggctgccccgtcttacggatcagccacttctggagggaggcccaggagcttgtggctgctgacagcagctcaaagagccccggtcacccgggcaggaagcagaagtgaagctgtgctgttgagaacagctggatggtcacagccgccctgttactcaaggactcagagatgaattggagaatggtatggtttgactgtgtgtcccctccaaacctcatgttcaaatgtgatcaccggtgttggaggcggggccaggtgggaggtctttgggtcctggggcggatccctcctgaatggcctggagccctccccatggtagtcagtcaattctcgctctgttagttcacgggggagccaggaactactcctcccctgctcgctctcacaccccctcttgccacctaacatctgctcctgctttgccttctgccatgagaacaagctccctgaggcctcaatgctgagcccatgccggcaccacactttctgtacagcctgcagaaccgtgggccaattaaacctcctttctcttagccagcctcaggtttttttgttgttgttgttttagatagagtttcagtcttgtcgcccaggctggagtgcaatggcaccatcttggctcactgcaacctccacctccagggttcaagcaattctcctgcctcagccccccgagtagctgggattacaggcacacatgaccacacccagctaatttttgtatttttagtagagacggagtttcaccatgttggccaggctaatcttgaactcctgatctcaggtgatccaccttcctcggcctcccaaagtgctgggattacaggcatgagccacctcacccagccagttatttctgtatagcaatgaaagaacagactatcgcgaggaatatgatgtaatttaaaaattccttctttgtgcctgactcctggcagagttcctaaaacctttgtactgtcctcagtgataagagtatctctggagcactaatgagatgactctcaactcccaggtagcttccaggatgggggctggtggccggaaggatcagactatgactcgagggtcaggactcccagtcgccctgctgactggcaggatggagtccaatcaccatggtcagtgatttcatcctatgtaatgcctatgtaatgaaacttccataaaaatacctcaacaatggggcctgggggcttctgagccagcaaacacatccacatactgggagggtggtgcacgcccaactccacagggatggaagctcctgcacgctgggccctcccgacgtcgcctagtgcacctcttcatcagctgtgcgtttgtacactttgtaataagccaggggtagcagttaaaatgccttcttaggttctctgagctgctccagcaagggatggaacccaaaaagggggtggtgggaacccctagttcacagccaaatgggacagaaatgtgggtggcctggggacttgacgtttatggagggcagtcttatgggactgagcccttaaacttgtagttagtgtcagaattgaattaattattgacatccagctggtgtctggagaggtggagaaggaaaatacaccacccattaggcgctgggaaggaaaaatttaaaacccctcagagaagcatggggagccccgttctccatgcccagggcccatggtcctggttatgaaagcctgaatcagacccacggtttattattcacagcaagatttctctgcagggattctttgaatctgtagtgaaaaaaaaatgtataaaagttgtacaacagtgtgagattcatggcaaaatcagaagcaaccttttattagtccattttcacactgctataaagaaatacctgagactgggtaatttataaaggaaagaggtttagttgactcacagttccatatggctgcggaggcctcaggaacattacagtcatggtggaaggcgaagggaaagcaagcaccttcttcacaaggcagcaggagagagaacagcaaaggaggaacttccagacacttataataaaaccatcagatctcgtgagacctcacttactatcatgagaacagcatgggaaaccgctatgatccaatcacctcctccctcaatacatggggattacaggtccctccctcaacatgtggggattacaattagaggtgagatttcggtggggacacagagccaaatcatatcaaacctcaagaccccagactgatttttaaatgtggggataatttcccaatgcaaatggaattggtctcgccccaccaccatgtctcccccacccaccatggcatccaggctgtgacacaaccacagtccatgcactgtgggctgaaatatacctccagggaaggaacgccctcacccacgggctgtgggtactcgcgcaggagccgctcctcatccaggaacttgccgtcacgcccattgctggccggctggaacaggccgtagttcaggacatctttcaaactctgggttaatgtacacaggatccgctgctttgcaacccacactgtggcatccgggttaaatcgaatgcatttctgccaggaaggacaaagacagctgatgagtgacagaggacgctacctgagtcacccatgtggggcgcgtggtcagagaggcaaagctgcttccaccccttcccgacacttcctctgagcagtgaacccacggcttttcacagtgaaaaataaagcctactggttgctgggacacagacattcggtaaatataaaagggaaaaaggaaagaccgaggcattggtctctttggccttgatctcaccatggactcaaatctccagcactggccgggtgcggtggctcacgcctgtcatcccagcactttgggaggtccaggcaagcagatcacaaggtcaggagatcaagaccatcctagccaacatggcgaaaccccatcgctgctaaaaatacaaaaatttgctgggcatggtggtgcgtgtctgtaatcccagctactctggaggctgaggcaggagaatcgcttgaatcagggaattagaggttgcactgagccgagattgcaccactgcactccagtctggcgacaaggcgagactccatctcaaaaaaaaaaaaaaaaattctctagccctcatagtgtctttttggtcatcaatgaccacctgtcacctcagggccctctctcacttgcatggcacttctcaaactccagcagtttgaaaaacacaggtcagagaccccacttatgtctccctaacatgatgtctgattcagcaggtctgggtgggacctgagaacctacatctcagacaaatcccaaggtgctactgctgctgccgtcctggggaacacacattcagagccacagcccgcgcatatttcaatgtgacttaattttgacatggatcgttctttagcatttcagattcggtggaagccttgtcttataaccacactgacgagaaagttttcatactacctacgctgactctgaacacaaaagctttaaaaatgcagtcatcacctctcctcccaaaggacacaggaaagcaattacggaaaaacgatttgatggaaaatcaaatcagttgccatgagagttcatttttgcaaagttaaatagtgtcaacagggcctgcaaaccaatcacaacacttcaaacatataatagcacctctgaggactgaaataacaacaacttggtcatgttcccaggtcccctctgtgagactcaccagtgagccaggaaaggcaaaggccaggcaaatccacttctagccatgacttctaatttttgttgaattaaaattatattctactgaacagctgtcagcaggggctcaataattcactttgtcactgtcaaagtgttcagaacaaaaggaggtttgattgaatataagactcaaaccaattctctatctgaggattctgtgggtttgtgcccaagaaagcaaaaggccctatcatcttcccaagacagcccgagggtaagttcctcatcgctgggaaaatgatcctgggacggccaacaggaggtcgggttcagtgggcggccagagtcctccctgccaggaaacctgaccctgtgcacaaaagctcctgtttctcccttccaatgtcaaaggctgagctcacgtgtggctctcaaagctccccacagggctgtgaggctgggtgggggcagttgtttattccagaaagatttccagacccgcaccctcccccatccttggctaagcaaggactctctggaaactcctggcacaagaaacaagctgtatcaggtgtgaccaggtggggccgctcactactcacccttcagttgcaggaatccttctaggcccctccaattcaagctccaacatccacagagcccatggctccctccctgacacctgcagagaagcttcagccaaggggcaattccttggaggagcacagggctccaaactgcctctcaggggacttctgtgccactgcaggtgattgcaaagataggtgtccaccgtcatttgtggacagggtggggatgctgtgtctgtgcagcacgggggccaaccccacaaagcaagaaccatctgctccagaaaatgctaagagcaccaccttgagaatcatctagaaggagcaagagctcaaaggtcggaaagcctgggtttgcaacccagtggggcacaccaaccttgattcctagggaaacccacccacccagcagtcctctgattcccccatgaaaatcagagccactacttaacttcagggctgctgtcaggatcaaacagaatataaataagacatgttgttatgggctgaactgtgcccctctaaataaatgttgaagtcctaatgcccataccctatgaatgtgatttatttgggaataggatctttgcagacgtaatcaagttaagatgatgtcatacaggagcagggtggaccctaatgcaataactgtgtccttaaaaagggagtaaatctggatattagccctttgtcagatggacagattgcaaaaattttctcccattctgtagattgcctgttcactctgatggtagtttcttttgctgtgcagaagctcttgagtttaattagatcccacttgtctattttagcttttgttgccattgtttttggtgttttagtcatgaagtccttgcccatgcctatgtcctgaatggtactacctaggttttcttctagtgtttttatggttttaggtctaacatttaagtctttaatccatcgtgaattaatttttgtataaggtgtaaggaaggcattcagtttcttctgcaaagaacttaaacaaatttataagaaaaaatcaaacaaccccatcaaaaagtgggcaaaggatatgaacagacacttttcaaaagaagacatttatgcagccaacagacacatgaaaaaatgctcatcatcactggtcatcagagaaatgcaaatcaaaaccacaatgagataccatctcacaccagttagaatggcgatcattaaaaagtcaggaaacaacaggtgctggagaggatgtggagaaataggaatgcttttacactgttggtaggagtgtacactagttcaactgttgtggaagacagtgtggcaattcctcaaggatctagaactagcaataccatttgacccagtgatcccattactgggtatatacccaaaggattataaatcatgccaccataaagacacatgcacacgtatgtttactgcggcactattcacaatagcaaagacttggaaccaacccaaatgtccatcaatgatagactggattaagaaaatgtggcacatatacaccatggaatactatgcagccataaaaaagaatgagttcatgtcctttgaagtgacatggatgaagctggaaaccatcattctgagcaaactatcgcaaggacagaaaaccaaacactgcatgttctcactcataggtgggaattgaacaatgagaacacttggacacagggcaggggaacatcacacatgggggcctgtcttagtgtggagggttgggggagggaaagcattacgagaaatacctaatgtaaatgacgagttaatgggtacagcaaaccaacaaggcacatgtatacatatgtaacaaacctgcacattgtgcacatgtaccctagaacttaaagtataattttaaaaaaaagtgagaaaatctggacacggcatcatgcacacggggagacgaccacgtgaatgggaaggcagagactggtgtgtcccatctgcaaacccagcaatgctaagatttctggtaagcccccagaagctggggtagaggtagagaatctgggacagattccccctcaagcctcagaaggaaccaaccttgcctaccccttgaccttggacttccagcctccagaatttgagacaatacgtgtctgggatttaaggcaccagtctgtggttggttatggcaggcatgggaactcataaacgtgtgaatcacctgccactaattgtggcagcaaaaaaacagcagcatcatcatctctgagagcggaactcagcaggtcgagcattcccagctcccagggagctcccctccctccatacgtgatgggagccacccacgtgttcacaccagctcccggcaagcccacgacgtcagaagacactttggatgaatcctacttcaattcttcacctacccatcattgactcactgtccaatcaggcaaaccccaggtccaagagcaggcctgacacagtacaggtgactgacactggctgaatgatgtgggagccacaaagacaataaataagaagcaaaccagcctgaggtcaccatttgtagtggggaaaaacacctactcaactgtcacacaatatggaaaaggtaaaaatccatgctaacacgagctcccttggggacccagaggaaggagtaagtgacgctgcttggtaaggagcacacatcataggctgctgcccaggaatacagagggatatgcgagtctggggtaggacttccaggttgagggcccatcataaggagagggagggaggcaaaggtagaacagcgatgagtctagcaggtggatggcccaagacagtttctgccttaagtgacccttcctggtcccactgttaccagtgtgagccttggtcatgtcaagttctccttgaggagaacagtatctgattctggtctccccacagccctgcgaggtggctattcctttataatttgttagagatgttctgagtgagtgagtgatttgttagatgactcacagatagtacagaaaggatggcaaagacaacagtgtataggaagtcccaaccctggccaactcctctaaaggattactggaggaaacaactctcttctccttgagcttctatcttctgtgcacagggtcctataccagcaccaggacaggagtgggtgagaggacacgaagatgaccaagatgtgctcttgccccttaaagagttcagtgtctacagggaggggatgatgatgatggtggtgatgctgatgatgagggtggttgtaatggtgatgatggtggtggtagtggtggcagtgatggtggtgataatggtgatgatggagatgttggtaatggcgatgatagtgatcatgatggtgatgatggtgatggtgattgatggtgataatggtgatgatggtattatgatagcgatgatggtgatggtgatgatggtgatggtgatgatggtggtgatgatgatggtgacaatgatggtatgatgatagtgataatggtgatgatgttggtgaaggggatggtagtgatgatgatggtgatggtgacaatcatgatgatagtgatggtgatcataatgaggatgatgatggtgatgatgacagtggtcactgcaatgatgacagtagtggtgatgatgaagatgatggtgatgacagtgataatgataaccatgacacagtgatgattaccatgtattgaatcctaataagccagaaattacgctaaccttatcaccttcaccacaaccctaagtggatattattattactttttgtataatattattattactgtttatataataatattattctcattctctagataaagaagctgagcctcagagactccaagtaactaccccaaggtcacacttctagaaagcagtagaggtttggtttaaacccaagtcaaatctccccatctcccgagttcttgctgttcaagtgatagatgatgttcctctctatacacacccactgccaatcttagtgcaggcaaatcataaattagaggcatatcccattctatttcacttgctttattgagcttcacagagaaggtgtttttgcaaattggaggtttgcggcaactccgcaacgagaaaatctatcggcattatttctccaacagcacacgctcacttcatatctctgtgtcacatatgagtaattcttgtactgtcaaatttttcataattattatatctgttaggatgatctgtggtcagtgatctttgatgttactattgtcattgttctggggtggcatgaaccacacccatataagataggaaacttaataaaagttctgtgtgttctgactgttccactgaccagctattctcccacctctctccctctccttgggcctccctatgccccgagacacaataatattgaaattaggtcaagtaataaccctacagtagcccctacgtgtccaagtgaaaggaagagtcacacatctctcattttaaatcaaaagctaggagtgattaagcttagcaaggaaggcatgttgaaagctgagtcaggccaaaagtgaggcctccagcaccaaacagtaagccatcgtgtgaatgcaaacaaaatgttcctgaaggaaattagaagggccactccagtgaacacacaaatggtaagtgaaacaggccttagtgctgacagggagaaggtttgagtcaccaaactttgatgatcaagacggtcacaacattcatttaaaccaaagcctcatccagagcaaggccctgactctcttcaattctctgaaggctgagagaggtgaggaagctgcaggagaaaggctggaaaccagcagaggtttattcatgaggctgaaggaaagaagccatctccataacaggaaagtgtgaggtgaagcagcaagtgctgatggagaagctgcagcaagttctccagaagatctcgctcagatcattgatgaaggcggctacactaaacaacagattttcaatgtagacaagacggtcttctattgaaagaagatggcatctaggactttcatagctagagacaagaagtcaacatctggcttaaaagcttcaaaggacaggctgtcttgttaggggctaatgcagctggtgactttaagttgaagcctatgctaatatatcattcaaaaaaaccgagggcccttaagaatgatgctaaatcaatcggccaggcgcggtggctcacgcctgtaatcccagcactttaggaggccaaggtgggcggatcatgaggtcaagagacagagaccagcctggccaacatggtggaaccccaactctactaaaaatacaaaaattagctgggtgtggtggcaggcacctgtagtcccagctacttgggaggctgaggcaggagaattgctagaacccaggaacaggatgttgcagtgagccgagatcatgccactgcactccagcctggtgacagagtgagactccgtctcaaaaaaaaaaaaaaaaaaaaaaaagaattatactaaattaactctatctgtgctctataaatggaacagcaaagcctggatgacagcacatctgtttacaacacatgttactgaatattgtaagcccactgttgagacctaatgctcagaaaaagagattcttttccaaatattgctgctccttgacaatgtacctggtcactcaagagtgctgatggagatgtacaaggagataaacgttttcatgcttgcatacacaatatccattttgcagtccatggattaaggattaatttcgacattcaagtcttattatttaacaatatatcttgtaagactatagctgccacagattcctcagatggagctgggcaaagtcaagtcaactgaaaccttctggaaagaatttagcattccagatgccattaagaatattcatgtttcataagaggaggtggaaatgtcaacattaagttcggaagaagttgattccaaccctcataaacgactttttttttttttttttttgagatggagtctcattctgtcacccaggctggagtgcagtggggcgatcttggttcaccacaacctccgcctcccacctcagcctcctgagtggctgggactacaggtgcccaccaccctacccagccaattttttgtatttttagtagagacagggtttcaccgttagccaggatgatctcgatctcctaacctcgtgatctgcccacctcggcctcccaaaatgctgggactacaggcttgagccaccgcgcccagctaagaatattcacgattcataagtggaggtgaaaatatcaacattaagtttggaagaagttgattccaactctcatggatgactttgagggattcaagccttcggtggaggaaggaactgcagatgtggaaatagcaagagaactggaattagaagtggggctgacgatgggactgaattgctgcaatctcatgataaaacttgaatggatgaggagttgcctctttgggatgagcagaggaagtggtttcccgagatgcaatctactcctggtgaagatgctatgaacactgttgaaatgtccacacaggatctagaatattccataaactcagtggataaagcagtgcagggtttgagaagatttcatccaattttgaaataagttttactgtgggtaaaatgctatcaaacagcattgcatgctacagagaaatcgttcgtgagtcaattaatgcagcaaacttctttgctgtcttattttatggaattgccacagccaccccaaccttcagcaaccaccactctgatcagttggcagccatcaacatgagacaagacactccaccaacaaaaacattacaggccactgaagatgcaggtgattcttaagtatttttaacaaagtattttttaattagggtatatacactgcttttttagacatgatgctattacatacttaatagactacatagagtataaatataactttaatgtgcattgggaaaccaaaaaatgtgtgtgcctcattttattgcaagattcattttattgcagtggtctggaaccagactcactatctctaagatatgcctgttatgtaagtcattgagaatactgaagaagatgttgatgttcaggtcatttctggatcagaagacatattccctttgttcagaccttccaggctgcatacaaccccgcgccccagcctctggtggaccagccatcctctccgcgtctgccggctggagccccactctcctttccaccggggccgaggtctcacgatgtcatctccctggcctcctgcaggctgagctgaccactgggcaccttgggtgggaacacaaggagctgctccgactgcccacggccctcaggccagctgactggccctgctccctttcctgtctggcccatgagtctcggcctcttcaccttgcatttcctgtctcccaggaaggtgggagcagtgctgagtttcatattttgccttaggatgtttctcctcactctctcctaactggtaggcaggagttggtccctctgtcactcaatctcctaaaggctgtgatgtccagatccttccgaaacctgctgcgtgcctggcccaaggggctcaagacacagaaaacctgcaaatggatgtaacgagatctccgagacacaaaccaggctgtcttctcccttatctccagaaaggcagtacatacagcatgagacctgggtggtgatggagtgggacaggggctgacatggtcaggagctgtggagacggagtttgtggctgacaccagccttgcgatgatgtacacaccgatcccggaaagttctcaggacttcttcaggccagcctcagttctctctaagttcccttcataccacaaagcccctcagccacaaaagggagctgtgtcctagcacagatgaaccatccacatcttcccgtccctcctactcctccccatctctctctcccccgacatctgtctcagcaccactgcaacgtccagccagttaagtgctcctccctgccccagcccgagctgcctgaggacaggggtttctttttttgagtcagagtctcactctttcgccaggctggagtgcagtggtgcaatctcagctcactgcaacctccacctcctgggttcaagcaattctcttgcctcagcctccagagtagctgggactacaggtgcccaccaccacgcccggctaatttttgtatttttagtagagacagggtttcgccatgttgaccgggatggtcttgatctcttgactccatgatccatccgcctcggcctcccaaagtgctgggattataggcatgagccactgtgcccggccatttctgtctttttctttgcataaccaaaccaaagctagtaaacgtggatggcattgaacagcattggatcaacattccagacatggaacactcctgggtagtatcatccaacagtcaagaaaggtctggacttcacagcggggctgacgggagtttctgcctactgagtcttgcttgtactcagtggactgtgcagaccattaactacagcaatgattctggcgaggggaggctacgccaccgaggtctgcagagctgtaagttacagagctagggttggccatgctgttgaacagagtgatacatctacacccctcttagtacagttcatggtcaagctcaaatcaaaaccaaagagcaggcgaggcaacatagggaaaccgtctctacgaaaaatgaaaatttttaaaaattagccaggcatgatggtacgtgtctgcagtcccagctactctggaggctgagatagaagggtcccttgagctgggaggttgaggctgcagtgaactatgattgcaccgctgcattccagcctgggtgacagagcaagaccctgactcaaaacaaaacaaaagaaaaaatggagacagtgagggaaggtcactcacacttggttcacatgagttacaagtattctgcaaggtgagaggctaagaactgagactactggactgtgggcagaatgcgggcactggagacaggcagaggcagctgtgtttggcctgagtctgccacttacgctgagttatgagtcactcgggctgctgtggcaaagcaccacaaaacaggctgcttaaaccgcagacatttattgtctcccattctggaagccataagtctgagatcaagatgtctgcagggctggttcctctggaggcctctcttcctggcttgcagacggccaccttctctgtgtccccaggtggttgtccctctgtgtgtgtctgcgtcctcacctcctcttctcataaggactccagtccgatgggatcagggcccactctaacaacttcatttaacttgattgcctctgtaaagacccaatctccaaataaagtctcattctgaggtcctgggctatgacttcattcaatatagaaattttggtgggggagagacttagcccacaacactgaatgaccatggggcgagtctctgcaacctaccaagggccaccacctgcctgtgttgggacacgtccgcactgctgagtaagacacataaacaatggtggagcagcaaaccagcgccgaaaagtatccggcctgccagggtcacaggagcttcttgggcaaggctgttttgatttacagcaatgtagcaagaagagtttcctgtgagagactaaattgctttccaaatctgttttgggccctgtaaaatggcgatgatgacgggtgattttggaagattgtagtgagggcaaggaagtgtctagacaaagcttgagaaaatggtaaatattataccatataaaataggtcttattgccatgggttatctgaaagctgtggaaagggccatctacaacatgaggcttggattacacagatggattcagggacctccacctctacggcatctgctaactcaccttcctcaggtgagacttacatccaccttcctcttgacttctacccaaggagcccaggaaaagccaagagaacaagggggaggaaatgccagagcatctcaggtcgtggccccacagggatattccctattcaggatctggagccagaaacgcagaccccggggacgatcaagatgccagctctgcaaacgcatgtaagcagcgttcagcaagaacttaggaaagccggaaaaaactccaagtttctgagcacgtcattcattacaaagaagcgcatttcacattcagaatttcctctgcagctacggtttctgtcatcatcaagttctgcatgatgcatttttaaggacccgtcataaacacaagcttggcaggggccacggaaaggtgcgcgcaggcgtcttcgggtctttgatagctgttcacgtgcaatccgtgtacttgcacacctccaacaaataaccaacatcaaggtcaccccaaactacaattggtttattcccaaatgcaattatccaaatgaaataatacttcttactgcggacagaggcccattgggctggtgctcgtggtggcaaacactaaaaccccggcacgggtaacacacgaagctgaaatcagacatgtcaatggaacagggaaatgtggggtgacctcgactcagaaggacagcctagtcggggggtgctgaggtccaagagtcaggcttagtgcttctgcatgtttaaacgccaataaagggtaacggagctgtggattcgtttttccaatcagaacatttttcgcacagtgaaagcttcatggcagccgctggatgctgtggcgaagcggtgggcagactgtatctccaggcgattagtaagaggctgcctgtctgtctctgctattgtcaaggtgatgctaaactgggagacactgcttggttctgccagtggtccatggactccttgggggtgacttaatcttcctcttttcatagccatgatttcaggcagagccattgtaaagcagagatcagatgctggccagagaagtccctttagaagcaataaattgaagtgaagtaagtcagccatggaaggggggttataattaaaaagtcctgactgcagacacaaaacacttactatgtgcccatagcctggctcgtaagcatgttaaacacatcatctcttccttatgttctccgggaggccgcattagcacccccaggcccaaagaggaatgctccaaaaatgccagatcattcccagagccacacagctgcaagaggaggagcagggattaagggggtccccgaggccgagctaatgagtccaactcgatcctggcagcacacagacggagccatgagtcaggaagattaagccagcaggaggtcagaaagtggattagcgacgaggccacagaggcaggtgaggctgctgccgggacgcagatgctgctcagaagctgtggtgtgggaggccttgtccgcccagaagggagagcagcgagggaagggtggaggctggcggggaggcagagtcggagccaggctggaggaatcgcccaggtccaacctcagagcaaagatgctggaaaaaagcctcacccttggatttaacacagaaaagtaaaaactgatgatctgcggccctggtattgccaccctctggataagccttaccagcttgggatgccagcaaagaggggacggctgctcctcaccagcatggccccaaaccacaatactccccctacactgtgggatttacagagctttgctacagaacttgtagtaattccagaccaaagtcacttttcccgtacattgttttctccatgagatttaagtaggcattaactctaagccaacgatgaagagcacctcaagtcaagacgttttatgtgcaggctacggagaccctgcaaactgggccaatctctcccatatacaaagcacgaacccaatacgtaacagaggaagggtccacatataatccttacaatatttgctttaaatgacgtgtaagaaaacaaagtccttctctgcctttatcgaggatgccctgtgacgtgaataataaccaatatgatcaaggcttgactttccatggcaactttcattggaaggccccacagccttccctttttttctaaacaatttgtaactcaccagtttcttgactaaaatagtcaagtgtaaaccactcctcttaaggacaggtaggctagttttcattgttgtattacagagacagtggaggcagagggaaggctgaggggctggggagcagcactctctttggtcttagcaaccagttaatgaaaccacaatcagattccatgccttctacctccccaagaggtaatccaaatgcatactacaaaggacatggcggggctactcaaagtggagaccaaagatcctaaccatgtatttctataatcaagagaatggatagatgggtgaatgagtggatggagggagggagggaggggtgaggtgggtaggaggatgagtggatgcatggatgggtggctgggtaggtgggtggctgggtggatgcacagatgaatggatggatggatggatggatggatggatggatggatggatggccggccggacggctggctggctggctggctggctggctgggtaggtgggtggctgggaggatgcatggctggctggctggctggctgggtaggtgggtggctgggtggatgcacagatggagggaaggatggatggacagatggagggagggagggagggacggacggacagacggagggagggagggagagagagacagagggatggacggacggatggatggcaggcagacaggcaggcaggctggctggctggatggatagatagacggatgagtgagtggaggggggatgtggatggattggagggtcaggggatgggtgggtaggtgggtggaagcgtagagtggaggggtggtctagggggcctccctggttaggctggagtcagtgttgggccacactccatggactcaaagtttttgaataaagaccattatcatgttaccatcttctgcccaagtcctttttgatgacttttcttttagggcagaaaatgtgctcatgtcaaggcaacatatacctaaacttctaattaagtctataatcccagaagaatttcatttagctaacaagcaactgggagagaacattctggaacaaaacatctgaaactgaaagggcagcccaaaggaaaactatgtattttttttttttttttagggaaggggtctcattacgttgcccaggtgatccccctgcctgagccttctgagtagctgggattacagttgtgcaccactgcacccggctacattcgtggataaaagagcttttacctttctcggtggactgggtgacttgacagtgcagaaagctcctccgtggcaggaggcccggagtgggcactggacacagcacaggtgggaggggaggggctcatctccagcaggagaggcaaagaactgagacaaggcttccctctcagtccacgtgcggtgccaccccatcactgacgatggccagagcaggcatctggggaggggagagggggaaaggggaagtgactgccaacaggggtggggtttcctcttggggggatggaagcttcctgagattcacagtggtgatgggctcactcatccgtgaatttcctaaaatccaacgacttgcacacttccaatgggtgaattatatggcatgtatattacatctcaattttttttttttttttttgagacggagtcttgctctgtcgcccaggctggagtacagtggcacgatctcggctcactgcaacctccacctcccaggttcaagcaattctcctgcctcagcctcctgagtagctgggattataggcgtgcatcaccacacctggctaatttttgtatctttagtagagatggagtttcaccatgttggccaggctggtcacaaactcttgacctcaaatactccacccgcctcggcctcccaaagtgctgggattacaggcatgagctgagaaactgcaaagacgcaggcctcacatcttaaaccctctctccaggacagccccactggctttgtcatagggaagcgtctgtgggtctccagctttccctgcacttcccagggtcccagcctccagcaccatttacctggagcccccatctcttctaatccttctcctctcaccagagaggccaagattacccttttcaaatataaacgatgtcacatgctctgtaccaaacctctgcccatcaaatacaaccatggcctccttgtcatgaccctatacctggacgcccaccgcccacctctgctgcctcacacacactgctcccgcagccctcagccttctctgctgagccaacacaccaagtttgtgcatacctcaggctggctgtccctgaagaccctcaccctagaagattccaagcaaagaccctctcccatcctctgaggctctgtacagccattggcgcctcaccccacagaggcaagggtttaaatgaattcactcactccatagccagatacccagcattcactcggttgtaccggctgatggggtacaaggatgagcagagcctgcactaggtgtccttgtggagcggaattgctgcccagctgccccccaggcgcttagctgtgaaatccccctgtaaacaaagagaccgaggagaagccatggagccatggaatcctcaggaaaaagaatccactgacttgcacacttccaataggtgtgtgcccagactaggggggatatgtttttttttttttttttttttgagatggagtctcacttttgtcacccaggctggagtgcaatggcacaatctcagctcactgcaacctccacctcccaggttcaagcaattctcgtgcctcagccaccacacccaggtaatgtttgtattttcagtaaagatggggtttcaccatgttggccaggctggtctcggactcctgacctcaggtgatccacctgcctcagcctcccaaagtgctgggattacaggcatgagccaccgtgcccagccggggaggacctgatttttatcctcagaccgggaagaagtcacaggagggctgggctcagcggtggccacggtgttcacatgtacacaaccacccaaggcctcacctagagaacttctgacagtctggtctgaagctgttctggttgcccaagaggaagatgacaggaaaggtggggtggtgatgaaggctgagggaacaacacaggcttgcgggggtctagaaggtacagtgaccagacttagggagggactggctataggagctgtagagatggaagctcaggaggacgcctacattctggttgcgacggctgaatcaaagatggtccccacggcgaaaaagtggaaagaatccagctgaccattgagtgggaatggatccacaagatgtggtccctccatgcaagatgatgagaatcagaacaaggctcaacagggctctgctaaacgccaccctggggatggacctcaaagctgtcatgcttcagcctcagggtccaccaagactggatcaaggaaacgtggtgcatatgtgcaacggaatactactcagccataaaaaaggagagcatgtcttttgcagcaacagggatggaactggagaccattatcttacatgaaaggacttggaaactgaaactcaaatcctgaatgttctcacttataagtggaagctaaataatgtgtgtgcaggaatgcagagcgtggaatgatggacacaggagactcagaagggtggtggggggtgagaaattacttaatagatacaaagtacatcattcaggtgacggtcacacgaaaagcccacactttacctctatgcaacattcccatgtaataaaactgcatttgtacccactgaatttatacccaaaaaagctgattatgctgagtcaaagaaatcaggcacagaaggccacatgttgtttgactccatgtctggaataagcaaatccacacagacagaaagtggcttcctggtcgtcaggggctggaagtgggggtggggatccactgcaacccagcataagggatggaaacctcccacaccaggatggtggtgacaggtgcacaactcagcaaatccactaggaatcatcaaatggtattcttttttattttttgagatggagttttgctcttgttgcccaggctacagtgcagtggcgcgatctccactcactgcaacctccacctcgcaggttcaagggattctcctgcctcagcctcctgagtagctgggattacaggcatgcgccaccatgcccagctaatttttgtatttttagtagagactggatttcacaatgttggccaggctggtctcaaactcctgacctcaggtgatccacccacctcagcctcccacagtgctgggattacaggtgtgagccactgtgcatagccctgaattgtattcttaaagtaagtaaatcctataatttataaattataactcaagaaaactttttgaaaaaaagaaagttttagtcttttctttttttttaaatccttttttaaaataagtattaaaatccttacttaaaaaaaaaaaaaaaaaaaaggtaactgctatctaagagagcaaataacagtggggccagacctggaggttcctagagaaagttacggtcatagcattggttttgcacaacttgagttgaggggcatctgggctttcaacagagaaggtatggagggggaaataaggcccagcccccccaaaggaggctgcagcaggagatgtgaccgtggatgctgtgtgaatggaaattctatcgccgccagggtgctgggtgcagggagccgctaacagaagttctatcggtgccagggtgctggctgcagggagctgggcctggccgagaagccctcccgccacccactccctggaaggcccaggtgttgaacagaatgcagcagaaggcaaatctgaccagaactggctttctacctggaaaaatccacccgagggaaacaaggacaaaccttcttgaagtggaattaagaggctgccattcaggatcacgaccacccaagctgccaatctctcaggcacatggactccatcaactcctagaagacacccagctctcaccttgcagggtccaggagcaaggaatcagacacacacacagcaaagcatcgaaacgcagcttctaacggtaacgaaccacccctgcaccagccgcccagagccctctctcacaatgggcgggcgcacacacacagcaaagcacccgaatgcagcttctaatggtaacgaaccacactcctgcaccagccgcccagagccctctctcacaatgggtgggcgcacacatacagcaaagcacccgaacacagcttctaacagtaacgaaccacacccctgcaccagccgcccagagccctctctcacaatgggcgggcgcactcacacagcaaagcacctgaacacagcttctaacggtaactaaccacccctgcaccggccgtccagagccccctctcacaatggccgggcgcctcatggtctctgaggatgaggagccagccccaggtacaggaggggaagataggctcagacgttgccagcacaggtagagtcctcccaatattcaaaagtagaggaatcctcaaatacaaaatgcaaatgcggtaattatgtgcctgtgaccaaaaagaggggattaaatcctgaaggtggaggaggtgaaacctccttacttttggggttctattttaatccacaataataagcagacgggccaaggccactttggaatcaagcatatccggccgggcgcggtggttcacgcctgtaatcccagcactttgggaggctgaggtgggaggatcacttgagcccaggagttcgaaacctctctggacaatatagtgagactctgtctctactaaaaagaaaaaaaaatcccagtgtggtggcgtgcacttgggaagctgaagcaggaagatcccttgagccaagggtgcagtgagttgtgattgcaccactgaactccagcctgagtgacagagcaagaccctatctcaaaaaaaaaaaaaaaaagaaaagaaaaagaaaaagaaaaagaaaaatctgagagtccatttggaagcagcagacagacgagaggacatccccgtcagcagatgcatgccacagggtgaggcagcacagcgggaatgagagggcagggccctcccagcatggcaaaggtagtggggattttgagtgactgtacaggcggggagagagggaggacagctgagtgacaatgcatggtctttgagggggtcaggttggcagtgcaaatgctttttcctaaatgaagtaccccactggaagatgcacgtgctttataaatggaagcactgactcaagcacagaatgggacactcattttccctgagcgtctgctgggaggtgggccaggtcgcaaggatcagccctcagagtgacagcttcagctgagctactcggtgccaggcctcagggagaggcggatgcggggccgacgtagacaccccagcagagcccgacaaaggccgccacagccccgttctattttcttctctgctctccttgcaacatggcattcactgtggattaaaggggtagggggaggggggagggatagcattagaagatataccttatgttaaatgatgagttaatgggtgcagcacagcaacatggcacatgtatacatatgtaactaacctgcacattgtgcacatggaccctaaaacttaaagtataataataataaaataaaataaataaataaataaaagaaaaaccactttgggccacggggccagttttcttccctcttcctcattcacactcccccagaaataacagagctcaccagtttgtattgattttggcacatgccacttgttttaaaggccatgctgaatgtccagagccagcactccaccactgtgcatttgagaggatgcagagaggctgccctccctgtgcccagagcccaccccaccactccctgcgtggcccgggaagcccacccacacacgactattcaagtgagggctccggttgtgcctgaagggttgtgagcactgctagaggctctcactcaatgacttaaagcttcagttccactggagggtgaggctcagaaacagcactcactcggccagcagcagtgggcccggacagcagcggaggaggggtggcattgggggagaaaaggggccgcccaggtgcttctccagcaccaactcccagtggacgggcactggggcctcggtgcagactcactcggcagctcctggctggctcctccgggcagggttccaggaactgtctcgtgtccctggctccacagaggactcagccccacaagggatttctcacacgggaacaatgtctgctttgttgctgagagctcacacccgggggatttctggtttcagcctccaggggctttgtttgtcttgaacagagtgaagcaaagtggtcttcagaaggttccagaaacaaccaggctcccacgagtagagactaaaccctgaagaggccctggctttcacgaggaggtgctgtaggttaaatctgggctggagcagacctgtggctccatccatcactccaacaggtctccagtgactctagcaaagtgggcagaacacctgctggggaaacagcccctgccctgcaaggggaagattaccctgccaaggaaagcgtcaaacaggcagggaggcagggtccggccgggtgtagaaggcccctgatctcccaacacccttgccccagtgccgatggaggacctcagtggctgagatgaccggggcctcccttctacgtggctgatgagagcctccgagtgtgggtagcaccagcaggagggtggacccaggagaacagaaacagtaatgggccccttgtggctgctccccgggctgaacgccaacccgcaatggctcacttcacaagtggtgtttgttcccgacaggtggaaccccgaggctcagatcttcagaccctcgcccaaaagtgtagagtgaatggcgagggagacgtgcttctgactcatgccaggacgactggggccggggctgcttcccacgcagcgctgcctgctggctgccttcctgccgggaattcaacttgcaggtgcaaatcagcccagtaccaagcagttggtggcacacccaacgccagcctcccagggcttccatccagcaggtttcaaggcccaaggctgggtgtccccaggacagtggctctgcccctcactggctctgaagtctgaccctcctgttcccatctgtaaagtgggattaagcataaaccctccccatgagtaggagggagcagtggggctcccggggctggctggcgtcctacgccttcctccacctgcaggttacatgctgcgttccgtttgagtgtacgggacacatgccctgtggacgggtgtgttatccttcaacaaagatgctcacagtgctgtctacctcaaggctgacagcagtttgggagatcgaggtgggcagatcacctgaggtcaggcgttcgagaccagcctggccaacatggtgaaaccccctctctactaaaaatacaaaaaaaaaaaaattatctgggtgtcatggtgggtaactgtaatcccagctactcaggaggctgaggcaggagaatttcttgaatctgggaggcaagagacagaggttgctgtgaggtgagatggcgccattgcactccagcctgggcaagagagcgagactctttctcaaacaaacaaacaacaacaagaagatgtgactttgctcctcctccaacttccaccataattgtgaggcctccccagccatgtggaactgtgagtctattaaacctgttttttattacaaattactcagtctccggtagttagcagcgtcgttattaccagcatgagaatgggctaatacaatgtctcaggaaagacagggattccaggccctgcacgtagactccactctcccagccctgggcctgctcctctccaaaggcaaacagatggccaaatctaacttcatgatggagccaaacggaattcacccatgcactatgcgaaccaacagaaagcccaaactactgacagccaacctagacgagacaggcagaaatgtcagggaagccacagggaccccgcacagacacaaaatgaaccacagcaagaaagacggcatgcaaacctccaacggtctctgagctgcatgaaaactcaccacaattaaaagaagaaaagcccccgagaatgcttgatgccagggaggacaaaaataagacagaaaacctaccaaacaaacaactcaagagagtattttcaaaaagaaagagtgcagggctatggaaacaaaaactcaaaggagcatgactacagtaaattagaaatcacaaaaattagaacgggtctaactgagaacacaacaattaaaagctcaagaaaatcatggcaggccgggcgcggtggctcacgcctatgtaatcccagcactttgggaggccgagacgggcagatcacctgaggtcaggagttggacaccagcctggccaacatggcaaaacactgtctctactaaaaatacaaaaattagccaggcgtggtggcgcatgcctataatcccagctactcaggaggctgagggagaagaatcacttgaacccaggaggcagaggttgcagtgagctgagattgcaccactgcactccagcctgggcaacagagcgagactctctttcaataaaaacaaacaaacaaacaaaaaaaaatggcaaacaagcagaaaaatgccaagcaattaaagcaattagagaaaaagataacagatatgaacaaggaaaatccagtataggaattattactatccctgaaataaaggatccaaccgataacacagaaaaagtaacaaaatacaggaaaacattcttaaaatgaaaatgtccttaaacagaatctgcagagagaaagtttttctaggaaaaaccaagaatgcccaacaccaaacacttcctggtgtagcaacggaagccacttctttaggaatctagtccaaaaaaaaaaaaaagtcacctatgagatggaaaaaataaatctgttggcctcaaatgtattcaaagcaatgttcagggcaggaagacaatcaaacaacatccccacagacgggaaattgtgactcaaaaatacagagcaggtcaggcacagtggctcaggcctgtaatcccagcactttgggaggccgaggcaggtggttcacctgaggtcaggagttcaagaccaggctgggcaacatggtaaaaccccgtctctactaaaaatacaaaaaattagccgggcatggcggcaggcgcctgaaatcccagcaacttgggaggttgtggtagaagaatcacttgaacctgggaggtggaggttgcagtaagaagaaatcacgccactgcacaccagcctgggtgacagggtgagactccatctcaaaaaacaaacaaacaaacaaacaaaaaacccacagaggaaaagagttttcaagctggagggaacaagctgacattttcaaaacacagccaatcctcactattcatgaattttgtattggggtatgcctacttgctaaaatttatttgtaaccccaaaatccatgcttttcgcacaaaacagccaaaggtttcagcctgcccgatgcgcgggttcccacgggaggttgatcaaggtggtggtccgacttcttgtctcagctctcatcttgtaaacaagcgtctgactgcagcccatggaatgtcattctcacattgcttgtgctttttgttggtgattttgccatttaagaggggtcccagcaaagggctgaagtgctgcctacttgttcctaaggcaagaaggttgtgatgagcttcacagagaaaacatgccacagaagctccactgaggcctgcctgagagcactgttggctgtgagttccatgttaacgaatcaacattacatagtaaatatggcatctttaaacagcaacatacataaagtaagattccgtattgacctatggtcaaacatgtgaccaggggcttgtaggaatcgaacactgcacttcctctgggagcaatggccaaggcgtcactcattcagcatctgtggcaactttttagaacacaagtaccaccgataacgagcatcgaccatccattcaccgagaaagcactgctcttaggaactcttgctaaaaaaaacccactgaacagtgaattccctccaattaaaagcaaaataacaaccagaaaaggatctggcaaatgaaaagggcattgcaaaggcaaatgatggcagtgaccccggcaagagagacagagtggctccgggccctggaggcacagtggatagtaagtgggagggacagtgacagtgtgaaacaagtcactgtccacacccaacaaggctcaggaggtgggggagggaaagtgtgcgcatgcgtgcacccatgcacacataactagctactcattcaccaaactgatgcccttttcttcctgggctcagacctccactgcgtttcccagcctactctgcagtcaggtgcaacctcctcatgaaaccagggaaggtgatggatgcactttacaagttctgtctcttcctccctcatcttctgggcagatacagaggaccccgtggaggattccagagctccagggaatggtccagctatctaatggaaagagcctgggtacctgaatgtctgtatggatcagaacttccctcctgtccatcctgccaacccaggtggactgagaagagagaaaaaaaataaagcatctatgtgttaagtgcctgacatttggaggccttttattatagcaatgagcttagtttacccctaaatgatataggaagaggggacagtgaaaagggaaaaaaaactgtaacaagaaagaaaaaaaattccagccttccagtgtttcataatcacttcttttaccttcacagatttagctggaaaaagtctcttgtgacaaaaataaataaataaaagaagcatttccttcaccatctttttctcctcttatattcaaataaaataacattgatgatgctcatttcttaagagcgtgtgtggtttgagcccacgcttaccaaggtatttctatccatatgcacttccacccactgcctgtaatcctgcagagggacgtgtcggaacagggctctgccaagtattgatgtgatcaccattgctaagtctggcatttgtgctttcctgcattacttgaacttttcataacaatcatttatagcttttataagaggcattaaataatataggagaaggaactccaaaagaccacgcctatcctcctgaacagcctttgtactaccagggaagcccctggggccagtggcatggccagattagctctagggcatcaggccaccctgagcctcccccacaacgggtgtctaatcttttggcttctctgggccacactggaagaagaaccgtcttgcgctacacataaaatacactaacactaaagagagataatgagctaaaaagaaaaaaaaagttgcataaaaacccctcagaatgttttaagagagtttatgcatttgtgttgagccgcattcaaagctgtcctgggctgcatgtggcccacgggccttgggttggacaagtttgtcctagacggtgaagccacttggctgagttcatccctagagggcacgtgtcagcacgttagtcccctcagcccagttagcgtctctctcagagggagcagggctgggggtgggctgagcagagggtgcctgctggaccgcaagctgctggcactgggggaagaggagacacacatttagccctcgctggggaccaagccctgagaggtgctaaccccagggcatctcttagctcctccacagcaccaggagctgggaccctggatgggcaccaagtgaggcaccagcaacactcagccagtaggcagcatgatgcttccccgatctccagcacttgggccccccttccccatcgtggctggggccgggagactgtactcatagaggtcggggtggatgcagagcactgggcttaccccctcaagcacctgcagcagcctacaccaccagcccacctctccccattcctttaacccaaagctaaaatgagaagggtcctcccagcccactgagggagacccttctagaaagcacagatggagactgtgacgagcctcacccagatgcccctctgagtcctaactcttggatgtctaccatgtctactccacagcaaatgggcttcgtaccaactgcccctactactgccacccccacccacattccccaggtggacagacggcgtgtgaaatgttcgcaggccaaccctactaggcgcctgtttgcaaccattatgtctgctccacgcttccagctctgtcccacatctccgatttgaggccacatgtggcacagtccccgccgtgagcaagagggaacgtggctgggcgactggcccccagcttgctctggtggattcaggcaaaagatgaagccacaccccttcctctgcacacgaagctcccctttacagacaagatgaagccacaccccttcctctgcacacgaagctcccctttacagacaagatgaagccacaccccttcctctgcacacgaagctcccctttacagacagccccagttcccaggggccaacctcctcggggaaggcaaatccaacaaaagggacccccaggcataaggacagacatccaggacacagccagcgtgggccagggcagcctgagggctctgggcggcacaggaatgacattaggcccagggctggagggacaggaggaggcggacagcagccacgcgggaaggagtgctcagggctgtaccccctggaagtgggggagcatgggatgctgggcctctggcacagcagagtccggcaccaggaagaggcagggccaggcctgagagcctcctgcacttggtgctagaagccagttgcgggtgcacctgccgcccgggttttctctatgaggctgtgaaacactcctctccacctctgggactcttgcttcaggtctggcacacagtaggtgcccagtcaatgtttgtggatggagttggggacaatgacagcaacagcatgatgtgaggccagcggcagcagggaggggaggcgggcacggcagggagcctggggggacgggggcagaagtatggagcgaggaaggagcacggtgtgcccagagcagtcaggaccgtgggtccggggaggaccagagcaggcctctggcgttcaagccacaggtgacattgtccagatgtgaaccaaagggcagaccacggggctcaccgtctgctgcaggtcatggatgaccacgcggatcaccagcgtgttgccctggctctcctccgtcctggcaccgcccggcttctccgcagtggcccggatcgtgtcatagatggtctcttctttggagctgtctgactccgaccccacggagtagtcggagaagctctgggccatctcgtcctcgctggatgttgggctgcgcggcatggctgcctgtgtcttcgaggtggggagaaggaagacaaagaacgggagatgtgaaaatgaaagaaaacccaggggcacggtggacactggcgctggaacacacgtgggctcggtttcacagtctgtgtttgttggtgtgaccaccagccgagggccccaggtatgcacaatgtacagatcccagagggcggacacaagtcggcaccgcctgctcctccctggagcttgagccagaggcggcagccaggacccaggaaaaccctgcaaactctggtaccagcgctgtgaaaccccggcactcaaaaggagcctgagctagccacggggatgaccacagcttacaaagatgatgcagagggccactggggctgtctgagctacccaaggtaagaaaaaaggctgccttttgttttccttggaggacagagcttcaggagaggaagaaacatgggcttcaggtcagaatggcagcaagttcacgctataataaccctctctgcttcaaacacagagcaatgataggtaccgtgtaaaaacagaacaaaaggccagggccaggcccacagatgagagaatctcccagaccaggactggagtggaaccaagagtcatgagcagactgcagccatcagacttgggggtccccaagaggcaggggcagctgagagtgcagcttcctcaaggtcaagtgcaataaaaattaccccacaaagagtcaggccaggttgccaatggccaccttagaccaaggcttcttgtttttttttttttttttgagatggagtttcactcttgtcgcccaggctggagtgcaatggcgtgatctcggctcaccgcaacctccgcctcccgggttcagacgattctcctgcctcagcctcccaagtagctgggattgcaggcatgcgccactacacccagctaattttgtatctttagtagagacagggtttctccatgttggtcaggctggtctcaaactcccaacctcaggtgatccacccgccttggcctcccaaagtactgggattacaggtgtgagccaccgtgcctggccagaccaaggctcttaagaaggacacagaactctgggaacagccatccactatttggtggctgcatctatgacatcccccacctctgcagggcaggagtacagaaagggttggataaaagttggcttgacccagggatggcagggactgggggaggaggggccatgctgaaccagcaattccacttctgggtgcgttctgtggggaaggacgaggccacgtgcatatggaaaggcatagaagattgttccctgccaaagcagcatgtggaaatgcatggtcaccctgattgtttagggaccccttgatcaagctgtggtctcttcattcccatgaactccacagctgtgacaatgaatgaacccaagctacatgtggatgatccctgaaacataacactgtgcaaaaggaaggcaattcacggaaggattcaaaccacatactatcatttccagataaaggctggaaagatgccacacagtcctacagatggtacatgggcattttcaccgtgcgtaacggcacagaagcagtcaactggaaaggcacatgcccaatgcaggagagcagttccctctcggaggaagacagggtgggccgcgctgcttggagccatgaacttcctgaaagcaattccagcaactacaggacaaggtcaaacttggtacagttggggacacagatgtttgccgtattattctctttgttagaaatcattcacaaggagcaaggaaggagggcaggagtgcagggggcagaagaggccaccccaaaatatgctgcctgggcataaggacagtcctgagctgaagacgatggaggaaaagcaggtgcgagaacagctcgctgccttcccccgccactggtgtgcctcaaagcaagacgtaaatttcagaagttcatcactagagacagctttagacccttgtcagccccgccctggaggaacctacagagctgacttcaccaacagactagccttcagctgctgtttctttcctaaagattggccgccccataatttgccctctagaaactcacagtcctttccctttgtcttgtcgcttctctacaaatgtactgttcctgctctgaggcaccaacccagcccaagctgtaggcactttttcagacactcttcactgacgggtgctctatgtgttcacaaaccatttttctcttgcgactgtcttatgtcagctcaatttcagggccccaggtagagaggagggtagtaggaaaagaaatttctcctctgcagggggagggattagaggaaaggaaggaggggagggaggtggataaatgaatggatggatggatagatggctcactgtgtggatacgcaagagggaggaaggaagggaggaggggagggaaggaggtagatggatggatggatgaatggatggatggctaactgtgcataggtgagagggaggaaagaagggagggaaggagaaaggagggagggagggaaggaaagaaggaaggtgagaaggaaagaaggaaggaaaaaagggaggaaggtaagaagggagggagggagaggaggggaggggaaggagggagaggaggggaggggagagacagagagggagagggagaggaatggagaggaagggagaggaagggagggagggagaggaaaggagggagggagaggaaaggagggagggagaggaaaggagggagggagaggaaggaagggagggagaggaaggaagggagggagggagaagggagggaaggggaaggagggagagggagggagggaaggagagggagggagggagagggagggagggaaggagagggagggaaggagagggagggagggagagggagggagggaaggaaggagggagggaaggagggagggagagggagggagaggaagggagggagggagggagaaggaagagggagggacagggagggacagggagggagagggagggacagggagggagggagggagagggagggacaaggagggagggagagggagggacagggagggacagggagggaggaagggagggaaaggaaggaaatgataagaaggaaagctgagaagacttcctaatgcaggacctaagtctgctgccaattattcacattagtggaatgtcagggtaacaatgacattgataatcccaaatcaatagtttaatcttctatttagtctctagctataaaccaaaatatatttactgtgcaccaattatacatgagggatccccctagggtgtgtgtggcttcatgtccagcgcatgttctttctttgtaagaaaggcgccatgccatggtccacagttttcggagcaccctgtgtccaaccacctaacacaatccctgcatggatatcctggggactctcggctgcgtggagtgggtgggggcaggaacttctcaccctgtgtttagacacttcacaaggcacagatgacagcacgagccaagaaaagggggcacctgtttcttaccctcgagttcctaaaatgagaatgggctttataagaatcctgaacttaggagttttcacacaacatctggatttcagtcatctctagaaaaatcacaggctcccgcctcctgagcccactccacccacctggcagccatgtgggcaccgagccgtgtggccctctcaacagggaaagggcgacatgattcacccagccccacctcactatgtcctctgcaccctggaagccactgcccctcaccatccaggtacactgaggctcaccctgcactcagctcacccgccccatcagccctgggccctggcagcagaattgtggaccctgtgctagtgttttataactggggggccctgtgagtgttcaggaacctcccggggaggccacgggcagttcaccaggaaccaacactatgtccaattaggagaaagctgatacccactgttgactcccagcgctcttccggtgtgggaagagcctgccgggtagcggggtgcactggaaccatgtcctcagcaggcactccggcctcacccctcagctttgctgcccagaaacctgacagcagccactcctcatcagatatcaacctccacctgtagctgcgatgccacccccatttcacccgtttttattcttcgtcctcattctcctgggccctgctgggttggaaagcagtgcaggcatgagggtgaagggaaagagcccttcttaagtggagccaaagctactcagagctcatgtcactcattaatgcagaaagaagcctagtgtggtagcgaggccagcctcagcgtcaacatctgaaaaacggagggcggggggagcccgcagctcagagccctggcacagagcagacacggcccacactggttctgccccagctcaggtcagataacgtctgactggcaagagcaggcagagaccgtccaggctccaagctgcttccaggggtgcatgtgtaggaagccccccctcagtggacagtgggcacccagtgaacacacgctgggtgggaggccagggctcccgatcgcagacgcccacaagagcagtcaggggggcacgaagggggcgatgctggcagaatgtggtccccaaatcagccaggcagcagcattcccactctggccacagctggtaggtaggaacgcaggtctggtgttgccaggcctgcagatatcttttagatatgtcagatttgacaaaaaaaacgtgaaatttataaacattggaaattcactttgtttgttttttattgagacggagtctcactctgtcgcccaggccagagtgcaggggtgcaatctcggctcactgcaacctccgcctcccaggttcaagtcattctcctgcctcagcctcccaattagctgggattacagatacctgccaccatgccttgcgaattttttgtatttttagtagagacgggttttcaccatgttggccaggctggtctcaaactcctgacctcaagtgatccacctgcctccacctcccaaagtgttgggattacaggcgtgagccaccgcgcctggccagaaattcactgtttttaacggattactttgcaggccacatagtacacatctacagctggacctgagtccaggaacaaaaccaacagcccacagcaggaagggcggcaaggaggggctcctgaggccacagcccccgctgctgccggcggacatcttcaccccctaggactcctgtgtccccttggtaccggctctgggggtgatggtcacaaacaggcacatctgctcccaaaccatggtgcagaagggctccagtgctgggtctgaagaggaaccgggatttcgtgcagaagcaggtgagcagagaggaggagaaggctgggtcacacctcccgggctctttccagaactatcctgggagctcatggccagagatctgactgggagggtcttgaccttggtaagggtcttgagtaacctgattagcagcttcctgggaacagcagacacctgatcactgcctgggaaaacatttaattattaactcccggggagagccaccaggcaaggcagaaggcgcaagtcccatctgcatttcagacaaacaacaaagacactttactgcatgtcccaaataattgcgtgggacattcttatactaaaaaactctctgctgttcatctgaaattcaggcagaactggatgcgctgcgttttatctggcaacaccatgggagagccaggggggctgggctgagttctctaaccccgtgaggaccagcacgccgggaggctccgcagagagaatgaaagcaaagccgaagacgcaatctgaaatcctggcttccccaggaaaagccagtgccagatcagaggaggggaaggttactcaccaccccggggcaaccgttttctgtgtaactaatctctcgggcgggtcgggggcgggggagaggccataaaaccccaggtccatgaacttcaatgactcttagtgtgtgtttctctccttggccctcctagagtagctactaacgaggagaaaagaaaatcatcacagtcaaagcaagttcaacaaaaacagcattttgctgctaacttgctccaagaaaacctaaaatcttcaactggctcattcgtcctccagtacctctgatgaaaaggtagacagacttttccactaattatttcagccactgtgaaaatatgaaagctgacctgggagagaagatacataataaaaacaaacaaaaaacctcacggccagcgctgactttgtcaaggttagagttgcaaaacctttgtaaacacctttaaaactgcaagagttcagccgggtgcagtggctcacgcctgtaatccccgcactttcagaggccaaggtgggtggatcacctgaggtcactcaggagtttgagaccagccggtcaacatggtaaaaccccatctctactaaaaatacaaaaattagccaggtgtggtggtgggcgcctgtaatcccagctacttgggaggctaaggcaggagaatcgcttgaacttgggaggcggagtttgtagtgagccgagatcgtaccactgcactccagcctgggcaacagaatgagactctgtctcaaaaaataaacaacaacaacaaaaaaagtgcaagagtttcctcatctgaactctgatttactttttcaccaaaagaaaagaaggtttttattgatatggaatctctgagagacaccctgtatgtgaatcacatggaaaccgagattttgtgactacacatttcatttattttgtgcattcctgtgtgtaaaatgtgctcggcctcaaggcagtgaggaccccgaggctcccctggtgccgtttacagacatttaaactcggggtcaaacggctgcaggactgacagcactccattggaacctgtggaactagaacagaatattcaaggaatccaggttccatcggatgttagaaaattgccgttctaagagctgacatagacatagggctgagagcaagtgcgagggtgtgggctttggggaagggtgggctgccagccagtccagagttggccagatgtgagggaaggggaggccagccgggcagaagagagaaaggcacgctggcttccttctgttcatttaacccactgttctcctccctgcacctgcaaaacacatcagctgagaaggagctagaacacaacacatgggggccctggccaagggggtggactgctctggaagtttctgcaaaagcagaccttctgacacactgccccaaatactggaggggtgaacttaccccacccacgctcccagagggatggacctaccccagcccacgctcccagaggagggatggacctacccccacccacgctcccagaggagggatggacctacccccgcccacgctcccagagggatggacctacccccgcccatgctcccagaagagggatggacctaccccagcccacgctcccagaggagggatggacctacccccgcccacgctcccagaggagggatggacctacccccgcccacactcccagagggatggacctacccccgcccacgctcccagaggagggatggacctacccccgcccacgctcccagaagagggatggacctaccccagcccacgctcccagaggagggatggacctaccccagcccacgctcccagagaggtggacctaccccagcccacgctcccggaggaggggtggacctaccccagcccacgctcccggaggaggggtggacctaccccagcccacgctcccggaggaggagtggacctaccccagcccaagctcccagaggggtggacctaccccagcccaagctcccagaggggtggacctaccccagcccacgctcccggaggaggagtggacctaccccagcccacgctcccagaggggtggacctaccccagcccaagctcccagaggggtggacctaccccagcccacgctcccagagaggtggacctaccccagcccacgctcccagaggggtggacctacccccgcccacgctcccagaagagggatggacctacccccgcccacgctcccagaggaggggtggacctacccctgcccacgctcccagaggagggatggacctgcccctcccatgcccccagccacaccctcaacatggagacaccaccagcccccagtaactgaagcagaacctggcagggaggtctgaggatcccaccacaccaatgccgggattcagtctagcaccacctcttccagcagtcttgcctagaagctgtcccccaaacccgccctgccccatacccctcaaagctccccagagaggtggcccgtcccacccaccccaagtagagtgactatggccgtggccacacaaaaccacgtggcaaccccatgtcagggctgtgccatctgccacgtagcccccaggcaccagcatggcattagacacactgtgagctgaactgtgtcccctgctcaaatccgtatgtggaagtccgaatccccggggcctggaaaagtgacagtattggagacagggcctttaaaaaggtacttaaggttccacaaggtcttacaggtgggccctaatgcaaggctggtgtctttttatcagaagagggactctggacacacaaggggcacctgggggtgcatgcgcacagagggatgatcacaggaagacacagcaagaaggcagccacgtgcacgccagggagcgagacctcaggaggacccagccctgccacaccttgatcttggacaaacagcctccaggactgtgagaccatcaatgtctgtcgtctagactgccagttctgtggtgctctgtgatggcagcctgagctgactcctccagtccccaggaccctcctgataggtttgtgaaacagatgcatggaacaaacagatttctgaaaagaacctccatctatccaggtttcctgggatttccctaatcaccatcaaacaaacactctgttaccagccctgctggcatctctggatgaactcaagaaacgggatcctgcctctgagtttccgccctccactggtgtcaccgtctcctgtcctgagtttctctccccgttcagccaaatccttccctttcagactcgctctaccccaggtcagaaccaactgcctatggtacacaagctccccttcctctcacctcagagggcctggagtccacgcctaattccacatctaattccttcctaagctgtgcctcctgactccagctctgagaactaattccattacacatacaccctccaaccctcctctggacacatacatttgtgaaatgtaactggatagaacaaaaacacacaggtcattttgctgctgaatttttaagagggctttatatggcagtgtctcagagaaaggggtaaacgcagcatttcccaagtgcacttgccccagacattcttttcccctggggctcataaacaatctcccacaacaggaagagaagctatggtctgagttgcccatagtcccttccttgctacactcaagatcttagaagcaaaagccaatcacatacctacaatgcatggcccactgaggccagcaccctgccaagtattatcgcctgaaagagggatagcattaggagatatacctaatgtaaatgacgagttaatgggtgcagcacaccaacatgacacatgtatacatatgtaacaaacctgcacgttgtgcacatgtaccctagaacttaaagtataataaatatatatatatatacacacacatatatataaagacactgacagcaggaactctgcaatggttctctatctaaaagaaatgggctctagggaaataacggctacttcacaccttcctcttaatgccaaaaccaatatccccaaatcagaaaacaagctactaataaatcagatgcctgaattaaaatgatacgtcacttaagagcactcccttagatgaattgcaatgcctcactggtgtgttctattaagacattggggtgtccaggtcttgagaaggactggtgagatggtacattcattaggtaagtctatttctcttccatgcctcagcattcatgtggaagtgtgccgttttcttggtggcaccagtaaccacaccactaatgtggtctgcaccgtctttctttggccagactcaacacagcctccaacagtctctcagcttctgctagaaaagccagagagaagagtctgtctggctttctaattgggcctcagtgggtttctgtccaggctgctgtaaagagcacatgatttataaagaagtcttcattttatgacaggtttccatttcagttttcttagagcagaattcaaggggttctggccagctagcatgaacccactcttagcctgtttgtgatatgctggcctacccatctcacagttctgccgaaaccattcaccgtgaccaggaagggagcgacttgcccaaggtaaaaggcttcctgggagacaacctacagagaaggaaaccaatcaagacaacaggtcaacaagcccctcctgggacactgcccctgtgtgcagctcttaagtgtgggtccaacaaggccctgtgtccagcaggaacaagaggcccagccacggacagcctggggggacacaaaccacccctagtcatgaccaaagtcttggaaaactgggaatagaagagaatttcccaaactcgaacagagcacctactcaaatcctgtagcaaacatcaaaaataagtaagcgaacagataaccgaatgcattgtttatggactaaaagcagggaaatcattattttcagataatatgcttctgtgaatagaaaatccaagaaaatctagggacaaattaaataatgtgtaaccataaaactagttaaaaaaaagtccagcaaaatgccagataagaatatacaaaagttaagtgaattgttacattagcaataaacaattgaaaaacattcaaaaaacactataataccaccaacaataaccaaagtcaactaaaaaaaaatctaacacaatatgtatgagacctttgtggagaaaagtaatactacatagcattatctttttgaaataaagaaagaattgaaggtagacccaaataaatgaagagctatacaatgatcatggacattaggctttaatatcttcaagatgaaaattctccacaaaatataaacttgatgtaacttctaataaaaccctgataggactgttggtagaacttaacactctgatcttaaagctcaaagaagatggagagccacataaaaccaagataactctggagactaagaggagactcattctaccagatgccaaggcttaccagaaaaagttataatatgaaaacagtatggtattagacaaagacaaatagatggatttaaaaagcacagaaccttaggctgggcttgtaaatatcagactcccatatgtgttgggggaaagagaagaattaataaacctatgaggctgacactagcaggtattcacatggagaagatgagaaatagagccccatgccactccagacacacaaacgcattccagatgcactgactactgtcacgtgaaaagcaacacaacaaatctctagaagaaaaagtaagaggcaatgccttcatgtaaggtccctaagacgggattctggcttctcaataaatgctgctttattgctgtgtaagaagatagcacagacttagtgggttagagcaacagaaatgtgcagcaatgtactctcatcacgctgaggtcagaagtcctaaatgagtttatggggctaaagccaaggtgttgtcagagctggctccttctcaagattctggggaacaatccacttccttgcctttctcgcatgttggtggtgacctgtactctgacactcatggccccttcctccaatttcaaagtgggtcactcctatctcagcttccaccttcacatcaccatctcctcttctgcagccaaatctccctcttaaaaataatgacccttgtgatgacattcagggcccacctggataacccaagataattcctcccatctcaagatccttaacttcatcacatctgcaaagctccttttgccatatgaggtcacacattcagaggtaccagagactagaacctgaatatctttgggggccattaattagccagccacaaatatgttcaattgttatttgctcaataaaacaaggcgagaaaaaaagtgtttctttctacaaggcatcgggtacaaggcatgaagggacagacaaattagacaatgtaaaagttaagacttccatcagacacaacagcaagaagacacctcaggccgggcatggtggctcatgcccgtaatcccaacactttgggaggctgaggtgggtggatcacttgaagtcaggagttcgagaccagcctggccaacatggcaaaaccctgtctctactgaaaatacaaaaaaattagctgggcatggtggtggcacacctgtagtcctggctacttgggaggctgaggcaggagaatcacatgaacccaggagatgaaagttgcagtgagcctagatcgtgccactgcactccagcctgggtggcaggaaaaaaaaaaaaaaaaaaagacacctgaaagggacctttacaacataggacagagcgctgtggaaaatctgggaagaattcctacagggcaaaaaagaaacaattccagatgcaaatgggtacagtccatcgcaggggacacctgaagggctagttggcatgggagaacacatcccaaaggtaccaggaaaacaagcaatgccaaggcccacagtgaaaatgcagtcccaggatggggaagggaatgcaaagtgggactgctccggaggctcctggggactctgtcatccccccttaaagcagccctcaaattctcactgctacgaactgaactgtctccctctaaaattcatatgctaaggccctaacccccaatgtgatggtatttggaggtaggacctttaagaggtaattcaggttatgagaatacaagggtggggtcctgatcccataggactagcatccctataaagaaaggaagaaacatcagagagccagcatgcgtgttcacgtgtggtcatgcattcccatctccctgcaaccaaccatgtgtggacacagtcagaaggtaaccctctgcaagccaggaagcagtccctcaatgggagctgaatcagccagcttcttgatctcagatgtccagcctccagaaaggtgagaaaataaatttctgctaagtcatcctatctattctgttatagcctgagctgcccaagacacccaccttctacaacatcatgtgtaaaacataacagagttgatggggaaaaagttgaggaggccactccaacgtatgccattttgtccccagagccctgcagaaaccaggaaaatccctgctgggttatttcagctccagcaatgacaccttaaatgacagtccacgttggcagccttcatccctgggctgctgagcctcctgagacatgtctgtctccaaagaagatggcttccaatagaaaccagttgcctcaaaactgaaaactaagtttgcagacagccttctttaagaagtttacttttgttaaccagaaataaaattctaagtccaccaccaactgaatggatcccccagctgctctttgccaaaggcattccaaagtaaaactgaaaaactagttcaaggtatgatgggaagtggggattgaacatgcctcattatatctgcctccctttggaattcaggcacaactgaccagcattaacattaaaacaagagatctcaagatggacaaaatggactctttgtagcaataagataccaaattccaacctgactctagtatagcatcacatgatagacagcaggtcctgaaagaaaacaacgtatttttttaccaagatatatttctttgacatattttgaaatggccctgaaaagctgtctcttgtggggaaaatttacactctatagagaatccccttccctttccaagtctcttcctgatccaggagagattaactaagagcctggcatctttttagatctgttaagagacatttaccctctattctccctgaagtctgctacctgtaagcttcttccacataataagaaccttggtctccaaccccttatcttaacccagacattcctttctattgattccaggtctttacataataacaactctttcaaccaattgccaatcagaaaatctctgaatctacctatgacctggaaaccctcccctgactccactttgtgttgtcccacctttttggactgaaccaatgtacaccttacatgtactcattgatgtctgcctataacttctaccccctaaaatgtataaaatcaagctgcaacccaactaccttgggcacatgttctcagacctctgggactataaaatgggccttagtcactcacatttggctcagaataaacctctttaaatattttacagagttgactatttttcattggcattttcttagacacaggaggaaatgtcttcacagtctgtccacaggcagggcagcatcctcaaatctggtagacagtgtggaggctccctaagccattgcaacagcctctccttacactgaatgagacacccctgtagcattttctgctttttgttctggagcatcacatgatctcaatggacacttggtgaattaaccaatgaactggaaacagcttaaatgccactgtcttattctactttttgttgctataacaagataccataggctgggttatttataaagaaaagaagtatatttcttacagctctggatgctgagaaactcaagagcatggtgtggcatctggtgaggaccttcttgctgcatcatgatgtggcaaagggcatcacatggtgagagggtgagatcatgcatgtagctctggtctctcttcctcttctattgaagccataagtcccatcatggggaccccatgctgacgaccttatttaatcccaattacctcccaaaggccccacctccaatcaacagatgaatttggggatcaagcttccaacacatgaaatttgaggaacatgttcaaaccatagcagccaccaacaggaaactaagtaaatgattgtatagtaatatcaggtaaaattatagaacagtgaagacaaatcaagtaacatacgttggcatgtgacagtgaaatggggaaatgtcaattgcaaaagaatagatacatttatctaaacactttcatacatgaattaaaaatatagatggcaatggctatcttcacctatctatagcccaacttcaaaacagtgattactgcttcaaaacagggaaaactgatgagaacaagtggcagttatctcaaaataaataaatatatagtctgggcgtggtggctcacgcctgttatcccagcactttgggaggtcaagacgggcagatcacgaggtcaggagatcaagatcatcctgactaacatggtgaaaccccgtctctactaaaaatacaaaaaaattagccaggtgtggtggcggacgcctgtagtcccagccactcgggaggctgaggcaggagaatggcgtgaacctgggaggtggagcttgcagtgagccgagatcgcgccactgcattccagcctgggcaacagagtgagactctgtctaaaaaaaaaaaaaaaaaaaaaaatacatatatatatatatacagaatagaaacaaatatgcaaatagggcaaaatcttaaaatgtttaatactgatggtgggtatagagtcattattgtgtttgtctacttttctgtgtttataatgtttgtttaatactgatggtgggtatagagtcattattgtgtttgtctacttttctgtgtttataatgtttttcactaaaaataaaaactttagaaattagatgaccatggcacagggtctgcctgtaatggtctttccagtgcaagcccttgataaatcaaatctattcattttggaagctggacagatgtgcttgtggggggatctcagtgggtgagaacacggcaggccgtgctgctgcagggaggcagagctgatgcttcttgagggcttcctgcacatcagcctaccagctaggcctacattttagtatctcttgtcagtcccaggagaatgtgataggagggcattgtgacttccccttatctgatagataaggagccttagaagataagctcctggtccatcacagccagaaagagaggcagctcacactcaatccaaattcaagattctccagacgattttcaaaagatagtttgcttgtgcaaaaaggagctcagtggaaactgccccaaaagattgcagtgtgagctcttagaggagtgaaattcggatcaattcactccccatcctttcacgcaaatcacacaccctcttcaacagggaggctggaggaagacagaaggaagaatgcaaaatatctatacatgcgtgctttttattgtgcacttctaaattaataggctttatttttctagagcaggtttaggtgtataggaaactcagctgatagtacagagagttcccactgatctagttcctagtttgtagtctgtctgctctaacaaacctgttgcacttaggatctaaaaggaaatgtaaaatcaaaatacaaccctcccagatgccagtggtctccaaattttcaggtaccctgtgtttgttcctcagcctccccacagttgacttgggtccatctggagagttctggctcctgggttgtgaatgcaagggaggggtgtggcagtcaagactagccactaaaatcatccccaggtacaagccaagttcttaaaatcccagtacctggcagtggagggctgggggattaactggcctttgaagattaaatatcacagcacattgcatctcagcagtgtctgtctaggcagagaggctttggcattaaacagacccagcaacctaggccactgcagagaagacagaagcatgaccgggttctattccagctccagacccaacaccagagcagccacagaataacccagcgggccccagtgtccccagtgaggggctgaccgcagggtgacccacctaagacacctccaattcacaatggggcctcatgacagctgccgcaccttctaaactatgggttaccagaaactaagttaaattactgtgtctaggaactgggaacatcacacaacaaaatcacacagctctgagacctctatggagcgatgaaatgtcactggtaaacggagatgtgcctgttactaaacatatttagtgtatagatgttcttgtacactaaacagatttcaaatcaagggtaagaactctcgacagctttctgtgccatacccaattccatcaaacgccggcctcaggcatctatctgttgggggcctaggagagacgccaagtccttgagtctgaagggcactttccagtcacctgcttggggacggctatgactccaccatgagtggggctgtggctactccatcctgccatcatctgtaatgacagtatttaagctggaggtgggttcctttaattcctattattccaatgtttgtgggaacccagctgtcctttgcaatccttaactttaattttcttgtcttcattttttttttttttgagatggagtctcactgtgttgcccaggctggagtgcagtggcacgatctcggttcattgcaacctccacctcccgggttcaagtgattctcttgtctcagcctcccaagaagctgggattacaggcatgtgccaccacacccagctaattttgtatttttagtagagacgggggtctcaccatgttggtcaggctggacttgaactcctgatctcaagccatccgcccgccttggcctcccaaagtgctgagattacaggcatgagccaccactcccagccttgtcttgttttcttaagaagaaatatttttcccatctggggcattttaaactattgcgctaacctcatggcgagagaatctcttgcagacctccctgggagctgcccccaggtgtgtgtgcgtgtcctcagtgtatcctgctcctaggacgctatgctgtgcagcagccccacagcctcaaggcccctacagcatgaagaatgaagcccgaacaccaagcgggaaggctgttgtcgcttctctctgcgaagcctggtcaaaccctacagcgagatcattcatcccagaaatcttcctcctgggaacttctcagcccttgagatttggatgccaggggttgccgggggacctggtaatcattcaccttgaaatacccccaagtgaaacaggggctcagccaaggttgagaactggcaacatcttttacgtggtgtagtcatgtaaccttttctcaggagcagagacacgtctcatcctcgggcctccctcctggaacgcttcccggctgatctcacagtccagccccaccaactcctcaggacccagtgtagaccatgtccggggagcaccctccatgagcactctgtcaggaagccatctcctccatcctctgctgagcgtgagtggaggacaactctccaacctcccgcgtgctgcacagacagacgaatgtgagtgtccacacgccccccagcctggaccgacaccaacaagcacacactactgctcgcctggtgtcagcccttcccttgaaggaggctcctggcaaaaaggcagggatgacaggacagactgggggttccacagatcaaaactacacaggccaagcaccaaagcaggtgccgtccaggtactgggtcacctcgcttcaccctctcacggatgtcctggaacaaaaggtctgcaacagatagtctgtgggctgtgccacaaagacgccagagacgggcagacaggacctctgagtgggaagagaatttgagcactggaaggatctaggtaaggacaagccaagaaattaaccggacagctacttctttccagacagcaagaatgcagtgaattctcatacagcaatgcagcacaccccggtattacaagacatgacttttcttggtttaccttccaatccacacgtcttttttttcttttcttttttttttgagatggagtttcgctcttgttgcccaggctgcagtgcagtggcatgatctcggctcattgcaacctccacctcccaaggttcaaacgattctcctgcctcagcctcccgagtagctgggattacaggctcctgccaccacacccggctaatttttgtattttttagtagagacaggatttcaccatgttggccaggctggttatgaactcctgacctcaagtgatctgccctcctcagcctcccaaagtgctgggattacaggcgtgagccaccacaccgggcccacacttcttttttttttttttttaattgatcattcttgggtgtttctcgcagagggggatttggcagggtcacaggacaatagtggagggaaggtcaacagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcactgcccttaatccatttaaccctgagtggacacagcacatgtttcagatagcacagggttgggggtaaggtcacagatcaacaggatcccaaggcagaagaatttttcttagtacagaacaaaatgaaaagtctcccacgtctacctctttctacacagacacggcaaccatccgattctcaatcttttccccacctttcccccctttctattctacaaaaccaccattgtcatcatggcccattctcaatgagctgttgggtacacctcccagacggggtggtggccgggcagaggggctcacttcccagtaggggcggccgggcagaggcgcccctcacctcccggacagggcggctggccgggcggggggctgaccccccccacctccctcccagacggggcggctggccgggcagaggggctcctcacttcccagtaggggcggccgggcagaggcgcccctcacctcccagacagggcggctggccgggcggggggctgacccccccacctccctcccggacggggcggctggccgggcagagggactcctcacttcccagtaggggcggccgggaagaggcgcccctcacttcccggacaggacagctggccgggcggggggctgacccctccacctccctcctggacggagcggctggccgggcagaggggctcctcacttcccagtaggggcggccgggcagaggcgtccctcacctcccggacggggcggctggccgggcggggggctgatccccccacctccctcccggacggggcggccggccaggcagaggggctcctcagttcccagtaggggcggccgggcagaggcgcccctcacctcccggacagggcggctgtccgggcggggggctgacccccctacctccctgccggacgaggtggctgccgggcagagaagctcctcacttcccagacggggtggctgctgggcggaggggctcctcacttctcagacggggcggctgccaggcggaggggctcctcacttctcagacggggcggttgccgggcggaggggctcctcacttctcagacggggcggttgccaggcagagggtctcctcacttctcagacggggtggccgggcagagacgctcctcacatcccgcacggggcggcagggcagaggtgctccccacatctcagacgatgggcggctgggcagagacgctcctcacttcccagatgggatggcggctgggaagaggcactcctcacttcctagatgggatggcggccgggcagagacgctcctcactttccagactgggcagccaggcagaggggctcctcacatcccagacgatgggcggccgggcagagacgctcctcacttcccagacggggtggcggccgggcagaggctgcaatctcggcaccttgggaggccaaggcaggctgctgggaggtgaaggttgtagcgagccgagatcacgccactgcactccagcctgggcaccattgagcacggagtgaacgagactccgtctgcaatcccggcacttcaggatgccgaggctggcggatcactcgcagttaggagctggagaccagcccagccaacacagcgaaaccctgtctccaccaaaaaaatacgaaaaccagtcaggcgtggcggcgcgcgcctgcaatcacaggcagtcagcaggctgaggcaggagaatcaggcagcagtaccgtccagcttcagctcggcatcagagggagaccgtggagagagggagagggagaccatggggagagggagagggagagggcccacacttctaaaagtaatcaatattcacaacagtggcaggtagcatctagggaccatttgacaacactgataaaaggtcaactgaggcagaataagatgcataaagagttagtttgagcaaacagtgatttatgaaatcaggaagtaccaaactgaaggtattcggttggtgcaaaagtaattgtgggttttgccatttctttaaatggcaaaaactgcaattacttttgcagcaacctaacagttttgggctccaccacagggatggaaggggaaagctttatggggtgaacacagacgcaaggcaaaggagacacttggttggttacaatgatgtggtcgccgtactggcttatcccattggaaagtccctagttgaagttaattgacagcttctgattgactaagctcgtgtttcatttttctttaatatagacatttatcagaaatagctcaagttagatttcactcaggtgttgcacatccagcaaggctgaggtcacttatgaagtctgactggctttgcttaggattctttaggcctgttttcctttttaatttaacaatataaaacaattcatgtgactccaaaatatgtatgtacataagtctacacagaatgtgtataaaaccaagctgggtgcggtggctcacgcctataatcctagccactttgggaggccgaggcgggtgaatcacccgaggtcaggagttcaagatcagcctggccaacatggtgaaaccccatgtctactaaaaatataaaaattagccaggtgttgggggaggtgcctataatcccagctactcgggaggctaaggcaggaaaaccgcttgaacccagggtgcagaggttgcagtgagctgagatcgtaccactgcagcagctccaccctgggtgaaagaataagactccatctcaaaaaaaaaaaaaaaaaaagagaatgtgtgtaaaactagatactgatttttgcatatctcagcggtagaactgtgatttgttttatattcataacaatatttagtgagagtaaattttcagaaaactaaattaaaatgtttccattttatagaaatcatttagattaaaattttgaggccaggagttcaaggctgcagtgctctgtgaccccacctgtgaatatcctttccagcctggacataatagcaagacctcatctttttttaaaaaaagatacaatattcattaattttaacttgtattttgcctttgagcagttaatttggaatattttagcagatatcatttttggaatcatgaaaaatgtttaatgctaaatttatttcaattaatacttttatcaaaatacatccaaattttttttctgtattagtccattttcatagacatccaaattttgtatacattgaatatattaaatttctaatcatttagaatattactctcaatggaacacagattgtgcaaaatgctagactagaacaacgtagtggtaattttgctgaacagactagcaggacaaatatattttctggcatatataataatgaatgacatttatatttatcacttatccaaatgtcactatgcatcaatgagatgcctaagtgtgtaacagaacaattaaactcagccgtgtctggtgtatcaccagctttcaatctcatgaaatagtcaattcccacatgatttacattttgccatcatgaagggatgtctgtgaaagcagaagaaactatgatctaatgtgctagctgggtgtgtacctaactttcaaataggaaacacgtcatgtgggcttccgctggtgctccttgcccagaccccaaatagtagggaccggctggcaagaggtgggcactgagggatgtgttgcctgttcccgacctccaaggtcacggcagagcccacgctcaaaggggtctccaaagaggcaaggagctgggacgctcccaggtgccaggaggaagcagctatttctcccaggacaagggtcagaccttcatgcatatcaaatcacgagagctttaggaaatgcgatggtcctcgtcctccagggattcctgatgtcgctggcagggggtgcattagtcagctctgccgccatcacagaataccacggctgcggctatgacagcagaaatgtgtgtgtgctcacattctggggactgggcgtccaagatcaaggtgcggtacaatcaggctcccagtgagagttcttcctggctcgtagacggccaacttctagctgctctcagcacggcctcgtctttttgcacacgcggggacagagtgagacttctgttttctcttcttctaggtgcactgtattggtccggattctccaaggagacagcatcaccaggaaatgtatacagacacatgcgggtgggcttgtcagggggctgacagagtccccgcgatgacagaggctgaaaagacctgcgacgggctgtctgcaggctggagtccctcgaggctgagagcgagactcaatccaggtcctaagcctcagaaccagagaaggtgatggcgtaagtcactctgaagccaaaggccagagcacccgaggggaagcggctgcctggggatctggggatcattcagcttaaaatgcccccaagtgaaacagggactcagccaaagttgaaaattggtgacatcttttacatcttactggccgctggtcaagtcctgaagtccaaaggctttggagttgtccaaagacaagagaggatgagtgtgtccagcccagcggctccatgccctcgccccttctcttcattgttctctctggacccccagcatattggatgggcccacccatacccagggcagatccctgcctccagtcccctcagacttatgtgctaatcccctccagaaaccccacacagacacgcccacgataacactttaccgggttcccaggtgttccttagtccagtcgaaaggacaccaaagatcacccctcagggcactaatcccatcggattaatcagattaatccctgtggcctcgtttaaccaggatcactgccttagaggccccattctcaaagacagttgcgatgggggtcacggcttccacggaggaatcttgatgggacacaatctagtccacacgcctgggaaggcccagctctggtcctgagaccctgggcctgggaggcctccttggggcagcagcagtagggtgatgggaatgtccccttgggcagtcccccatggctgcccaagggttgaacaaggtggcagacttcatcactcagccccatccgtggcacactgaccatgtaaccaaaaggagcaaacaattgctaggatttccaacacagtgattcccacctggcacaagggaagccctcaaaacatgccaccgtcctgccagctctcttccctgacctcacacaaggagaaggagcgtccaagaaaggcgtcaacctcaagaatgcaggggccacggtgggccacatgctttctcttgttactttatttacttaaaagaaacagccgccgggcacggtggctcacacctgtaatcccagcacttgcgagcgaatcacaaggtcaggagttcgagaccagcttggccaatatggtgacaccccatctctactaaaaatataaaaattagctgggcatggtggcgggcacctgttttcccacctactctggaggctgaagcaggagaatcgcttgaacccgggaggcagaggttgcagtgagctgagatcgcaccactgcagtccagcctgggtgacagagtgagactctgtctcaaaaaaaaaaaaaaagaaaaaaagaaaaaagaaaagaaaagaaacaccgtgagcagcatcttcccgtgtttccaatggcctcttgggaaatgatcctgagaggggaataactctcagggcacatgtaccccctaaaggcactcccccatgagagaacagtcagactgccacccaggaagcctgcatagttaacgccagggcaatgcctgcctcctgcaggtgcatggtctagcccagcacgccagggcaggcaatggcaggtacacacacagtgactgagtcccatgtgagaacgtgatcaaaaatgcacgagcacagcaaattcgtgctccttcaaagacactctcgtgggctgcatttcaaagtgctctggcctccggggccattgggctgctggaggctgagaagtgggcatcccagccagcactcaaccctgtcactgtgccctgtcgtctcttagcagggaaaggcagaacgccttgtttgatgaagtgtcttataaatcacgccttgtttgatgaagtgtcttataaatctattacatttattttttcaagctactggtcttttgtgactataaaatactggactattggagtcaataaccataaaaggaaaatctgtctcacccctcatggaggacaagatgaaacggaagagggaaattgattccagtataggtttctccttctggctgggatcactgctggaaggcgtctgctgtgaccctgcctgcttttggagcagatgtaaaggatgaagctcctgggtgcctccaggcagggtggctgctggcctggcctcaggattggcaccactgcatgtggtccaggtgtgagttcaccctgctggaaatatcctgactgtccagcacacaaagctaatactgttttgaaccctcttctttgatgaaccaggcgaatgtccccttcggaaacattctttcacatccacaagctaggaggacttccactgcaacaattttaacttctgcccaaagagtcaactattccaaaacatgctgaaacctacccaagtgcactggcgtgaagagtgtcctctcaaaattcgtcttcacccaaatctcagaatgagatcttctttgagaatatttgcagatgtaattagtcaagatgagatcatataaggagtgtgggccctaaatccaatgccaggtgactttataaggaggggaaatgatacagaggcaaagacagggaagtgaccaggtgaagactgaggcagagactggagtgatgtggccacaagccaaggaacatccagggcttcaagaggggaggaaggaccctcctctagagcctttgaagtgagcacggccctgccgatgccttgatttcagacttctgacctccagaactgtgggagtaagtttctgttgctgtgagccactagtttgcttccatctgtttcagcagccatgaaagcccaatacatcgaggcttcacacttatggaagtggcaccattaaaaactgctgtcgatgtatttctctttggatgatatgtacgcttcaagtctcatcctgatatctttgcagaaggaggaaacaatcatggtagtcattgccattaacaaaggtgcttagaagccactgatttaacacagtatctgtgactggaaacagtcattaagaacacaggaccaggcacagtggttcacacctgtaatcccagtacttcgagaggctgaggcgggaggatcatttgagtccaagagtttgagaccagccagacaacagggcaacgttgtgagacctcatttctataaaaaatcaaaaatcaggccgggtgtggtggctcaagcctgtaatcccagcactttgggaggccgaggcaggcggatcacgaggtcaggagtttgagaccagcttggccaacatggtgaaaccccgtctctactaaaaatacaaaaattagctgggtgtggtggctcatgcctgttatcccagctacttgggaggctgaagcacgagaatcacctgaacccaggaggcagaggttgcagtgagccaagattgtgccactggactccagcctggcgacagagcgagactctgtctcaaaaaaaaaaaaaaaaaaatcaaaaattagctgagtgtagtggcacatgcctgtggttccagctattgggaggctgaggcaggagaattgcttgagtctaggaagtcaaggctgcagtgagctgtgactgcaccactgctctcagcttgggcaacagagtgtgatcctgtctcaaaagaaaaaaaagaacacaagctttggtgcggggcacacaggattagattccaatgctggggctccctcagggagtagattggatacagtgaacatacccagctttgtgttcatgatttcttctgcctggaattctctccttgtctccccctcctcctctcccagtttacatgtcatgctctcagataagccttccccggttacctttctgcagctacaaaacacacacacggtcgcatatgtgcatttaccagagcaagggattttgttaaatctgtgccttatctattttgtgtgtcgctcccaggagggcaagagacaaaacccatcgtcttcgccagtgcttcctcggcacctagtccaactcagcacaagtacgaagaaccaataaatgagcagtggcaggttcctggatgggcatgggaacaacacagctgagcatgacaggtcgccccaggaaatgcaaagctgatgaaacctgagccacagaggtggtgtcagtgagaaaccaaggctgctgctgggtggtcctgtggacaccgaagcaggaaagtgagtctgtaaagagagcaggaggaaggaaagaaaaagagggagaggagggggagaaatagaccaaggctggtgaaagagaagtggggacaaaaaaggcagaggggcagaaacagacagacagacagacagagggagagggagagggagagagagagagagagagagagagagagagagagagagagagagagagagacagagacagagacatcgcttccagccaagatggaggaagggaaactggatttagcgtcctacctgaaaccacccaaaatatatccaaaccaccaaaatatgtaaaaagaaaaataacatatattttcaaagtataggacaggatgcacaggagagaggaaataatgaggtgagccctatgatgactcccagctttctgcctcctcagggtttccagaccatgctgcaagcaaggaccacccaggcaaactcccagagtggaggcgatggggctgagaacacaggaaggccaaggtagctccagtttgtgggacaaaaccaggaggagagagaatggaacggagcctagtagagatgtgttcccttattcagaatatgatggatgcaagcatgtaacaaaccaccttaggccggagaaagaaccacccaaaaggactggcaaaaataatacatactaattacataggccaggaacagtgtctgttcccatctcaccattcatggggcagtgaacatacagaagggttttgcctcacttaatgggaaataatcagacataggctgaacactgccatcatcccgcccaacgaatattcaaagcaagacccaaaaggatcaagctgtttctaagtaaattaactaaatcccgcccccaaaaagctcaagaatatgtacagaaatccaaaacacacaggtccaacaagattaaattcatattttataatgtttagcaatagaaaattcaattaataaaacaatgaaaaattatcacacatgcaaagaagaaaatatgacccataatgaggaaaataaccaatcaaaagtaagcaaaaataccaatgttataattagcagacaaagcattcaaatcatattaactgtattctgtatgttcaaaaaggtaagtggcaacatggaaaaaaattaaacttccaaagataaaaactacaatatctgaagtgaaaaataccctgaatagaattaatggcaaattacacatcacacaaaaagatttgtgaacttgaagtcagagcaatagaaactgcctaaaatgaaacacacaaagaaaataataataacaccaacaaatgataataaaagaagagagtatcagtgaaccatgaaacaatgtcaagcagcctaatatgtacatagttggagtttctaaaaaaaaagaggggggaacagaacaaatatttctatttttggccaaaagttattcaaattttatgaaaactataaactcccagcttcatgaagctcaatgtaacctaagcacaagaatcataaagaaaattacaccaaggcacaacataacaaaatggctcaaaaccaaagataaagaaaaaatcttaaaagcagactagggaagggagacatgttacatccagaaaacaaacttaagaatgacagcagatttcttgatggaaatgattcaagtgagcagacagtggactggcatctttaaacgaaaaaagtcaaactagaattctataagcagtgaatatatctttcagaaatgaagtagccgaaagaattcatgaccaggagatctgtcctacaataaatgttaatagaaattcttgaggcagaagaaaatgataccagataaaaatatgaattacacaaaagagtgaagatgatcagaaatggtaaccatgaggctaaatatgcaagtttttcttatttaaacccctttaagacaactgactaagcaggaaaaaaatgtatcatggggtttacaagacatatagaagaaaaatatacaacaatagcacaaaggttggagtgggaaaatggaagcatattattgtaaagttcttatgcttacctgaactggtataatactacttgatgataaaagtgtagtaagataaagatttatgctatgaaccctaagccaaccattgaaagaacaaaacaaagagtaatcgcagataaaccaataaagataaatggaatcataaaattctattaatctaaaagaagacagaaaaagaagaaaagcagaatgatgtaacaaaaagaaaataaatagtaagatgacagatttaaatcaaaccattatcaatttttccattaaatgtgacccaactctaagctttctataagaaatgcactttaaaccaataagccaattcaaaaataggcaaagaatttgaatagacatttctccaaataaaatatgcaaatcgcaaataagcacgtgaaaaaaacatccaacagcattaggcatttggggaatgcagatcaaaacaacaatgagataccactttatatctactaagagggcaataacaataatgataataataagtggaaaatgacacatttggtgagtatgtagagaaactggaaccctcatgcactgctagtagaaatgtaaatggcgtggccactatggaaaataggatagcacttttccagaagtttaaatagagagtaacatctgatccagcaattccactcctagttataaatccaaaagaagagagcgtagggacttaaacagagctttgtacatgaatgttcacagcaacagtattcacaagcaccaaaatgtggaaacaaccctttcacctgtccatcaactgatgaatgaataaatagaatgtggtctattcatacagtggaataaaactcagtcttaaaaaggaaggaaattctgactcatgctacaacatgcacaagctttgaaaacattatgctaaataagccagacacagtaggagacatcttatatgattctacttatatgaggtacctagaatagccaaattcgtaaagccagaaagtagactggtggttaccagaggccagaaagagacgggagaggaactattgtttaatgggcacagagattttgtgaaaaatgacaaaagaaagttttgggtatagacagagtggtggttacacaatgttgtgaatgtatttaataccactgagtcgtacactcctgaatggttaagatgatagatattatgctatgcacattttacaacaatttaaaaagtctttaaaaagaactatgctttaaaaataaagacaaatacaaataaaaagtaactggatacaaaaaagcatacttagtattaatttggccaggcgcggtgactcacacctgtaatcccagcactttgggaggctgaggcaggtggatcacttgagcccaggagttcaagaccagcctggccaacacggtgaaacactgtctctactaaaaatacaaaaattattgggagtggtggtgcacgcctgtaatcccagctactcagcaggctgaggcatgagagtcacttgaatctgggaggcaggggttgcagtgagctgaggttgcaccactgcactccagcctgggtgacagaatgagacttcgtctgaagtgaatgaatgaatgaataaaataaataaaagaataagttaatattaatcaaaagaaaattggaggattatatttttttccagaaagctggataaaaggaaacatctcaatgccttctgtgaggccaatattaccccgatacgaaaaagaaaacacagaccaacattcttcatgaacacagatgcaaaaagtcaaaataaaacaacaaatcaaatccaacaatatgtaaaaaggatatttcataaccaagtgtgattttgatcaggaactgatcaaatttaacatttggttcaacatttgaaattaactgttgatttaacatttgaaaatcaaagcatactaacaaaccatattaacaaacaaaagctaaaaaccctatgagtagctcaatagttgcagaaaaagcatttcataaaatctaacacagattcaggataaaatccctcagcaaagcagaactggaagggagtcttctcagcctgagaaaaggcatctctgaaaaacccacagtgtccaccgtatttacatgggaagactgagaacttcctccctaagatccttgatcttacaaggctgaggcgtccactttcacacttctcctcagcaagacaagaaaaatacataaaatgcatccagagtgagatggaagaaataaaaccatccttgtttgcagaagacatgattgtccccatagaaaatccattggaatccttgaaaaaactactagaacaagtgatttttagcaagactgaagaaggcaacaggaatatacagcaatcaattatatttctatataattgcaatgaatgattggaagttgaaatgtcaaaacaactctatttacaaacgccaacagaaaataagacatgcttaggagaaaatcttggcgaaagatgtgaaagatttacacactgaaaacaacaaaacactgctgcaagaaactacagatgactcgataaccgaggtgccaccttgcaatgtgagtctcaaagtccaccttcatgcaaacctctgctggccaattaaggttacaggacttccaggcacaggacatcccgggagctgacaaccagtgttcacgctgtaacctgcctgccacttgggaatgacaagcatcttgctgaatttcccggggacaaatgtcattatcttcactttgcacttgcagaaaaacatgactcagaagcaaatagctctgggcatccttattccaggtgtactcacaattacatctaactccagatgtgccgaccaacaccttgttatttatcagaacaaaccacggggcacagaatatgtgcttttctttgaatggagtctacctgctggcattctttatcaagaggtacaggatagaaggaaagagaacagaggaagtggtttccaaagaaaaatgtggaggaggtgacaagctttgttaatttatggtctgggcagttaaaacagcttttcctaccagggtaggagcagagggaaagcaagaaaacacgaagttccttaccctgtgcccatctaacagcgctttgtacaagaagtcgacagtgaaagtctaggttgcaaagaaaaaaagaaaaaaaaccccacacacaaagttcagtttctaatgaaaatacatacaggcttctagaaaacatctacagatggcatttttttggcgggggcggcgggaatggcatgtttgaacaaacctgtcaatccacgtaagccacactacactaggccacacaccaatgtggatcaaatgaatttcagctcaggaacttacacttttaggaagtgctgaagctacaacccaagaaggacggaatttttaccagccaccactcttacatataccactggagaggaagcaaaaattcaggggcaaggtcagaccatcggacagtccctcccctccaccaacgcccacgaggcacagccccgtccggctgtctagtgtatttctggccataaagcaaccttccacttccatgtggcaaatcagccttacctctgcttgaaatcacacacaaaaaacagcagcgaagggatttcatttttaatgcatataaacacaaggacaaacaggaaaggagaagctgggaaagaaaccagagatggcggaagatccttgagtgcaactgctgacgaggggaggtctggagaagccgaccagcttgcagcacagaagtgcaagaaggcccaggaacggaattgcaggttcctcccgctgagctgaaggcaggaagcctggttcaaagtttgttaataaggtagcacttggatcccctcaacacagccagctcctctttctccactacatcactctcatgtgcaaagaagccactgggtaacaagtggcacatggcctttaagaatggcaatgacagctgggcacggtgacatgtgcctgcagacccagctgcttgggagggagggctagacaggaggatcgccggagcccaggagttcagggccaatttgggcaacataatgaggctctaaaagcaaacaaacaaacaaaaaaggcaatggtcatatgacaattcaggatctcagaagaatgaagccaaggtcagaatctcatcttgacaaccccagtgtcaaagaaaaccaatcggagtggccaccagcaagaggaaagggcaggtgctgaaaagaagcagcagaagcctccaagcaaggcgcccgctcatggtgaagcactgcaataccctacatccaaggcaaccgtgacaccgcatgcataacggaaccaggacaacaaagagccgcaggtgtggggacgtgcccaggaatcctcaatcctggacgccgtcagagccacctgtggagcaataagatgttcaggttcccagccccccctcccccgccaacccagatctactgaatccgaatctccaggggaacaagtgggaagaagaatttgtattttagcaagaaacctacgattccaaggggccacctggatgaagcatcatgggtgtgaccaaccttgccggaggggcagcgccctgcagtaaccctggcagggggtccctctctatccctgtctccccctcatagaggatggctgtgatgacaagtgttttctctcctgaggaggaacagaaatctgcttcccagcaagttccagaggctagggccttttccttccccaaggcagcatcttctttaggcaaaaaaaaaaaaatctctccaaacatggtcctattccaggttcccatgcctgtaagtagcacggctgtccatctgctgggaggagattgttttcggggctcctgagtttctacacacagagcagaaacagtgcctgtctttgttcagatgatcttttcaaatgtgcttgtagatggaacagccttgaagatggatttgtttcttgggactaccacgacaaagtaccacaaactggaattgaagcaaaaacggcagaaatgtattatctgacagctctggaggccagaagtccaagatcatggtgtgggcagggttggttccttctgaggctgtgaggaggcatctgctccaggcctgtcccccagcttcaggtgcatggcctcaggcgttccttggctggtaggtgaccatcttctccctgtgtcttcacacggtcttccctccatgtctgtgtctgaattcctccttctgataaggatgccagtcattctagatctggacccatctaacatttcatttcaacttgatcatctgcaaagtccctatttccaaagaaggtctcattctcaggtcgaggggttaggacttcaacatattttatggggagcggggatgcaaggtaacccataatggaagatatggtgtttccctctggtacaaacggcagacaggctcactgtctagcataaaatatttcgcttccctaagctcaatgtttctctcccacagcgtgccccaccatgcatgctggcatcatccatgcctctctgcatcacagtgtgggaatcagggctcagtaaaccagcacgaaaaccctgaggctctgtctagtgctactggtgtgagtaataaactccttcatctctgacctgggagtcttgtgtcttcatgaaactctggtgagctcacttgttagccagccaggaggggaaatctcaaagccttcaaggctcttgacagtttcgatgaggaggatgggatactcccacagacaaggctttctggaaggcgaaataaagaggctctgcaggctgggctccaaggatatgagaaccctccctggatcaggtagcaaatgttctcgtccaagtgatggagggacaaggggcaaaggtgctggagtttcgaggctgaggatgagaccctggatggaacaggctgcccgactcatgctgtgggtgaaactcactctcccccgggtgagcagagaggggctcctatcaggacaatgaggtggtactacccgcagtcccagctgtgaggccacagggctgcagctgctgggccaagactctggcatgctttagaacggtgtcagtgaggaggtgcttgcttttcaatgcaaagctctaagcaaacagaaaacagcagcccttcatctggctgtgccctgagcaactgcgacactgctagaaatcactacatcaatgcatgcggctcacaggcacaaggccactctccctctgctcccatggatccctgacacccctctaccctgactgcagctgctgtaaggagagagatgactgggggcaggtggctccatccccaagaaaccccaaagaccacccaggcccacccagcatgctgggaaacttcagggaggggaggagctccagcttttagggctctgttggagacaggtgcccaagtcacaaccccacccggtctcatggtgggagatggtgcctggacccagctgatgaggccaagtttattggggagagggaagctaatgtaaccttgtagggggagaggttggaccacgtcaacaaactggtttcgtggcctccacatccaaaagtaacatgggaaggggtgtgttctacgcttgtacttccccatttcacacgggccaagaaggacgctcctgactggggagcactaactagagcccctgggctacaaccctgacgactccatcaagctgcccatctcttgagattaccgactgggcagagggagacagcccctccccggcggcacctggacttgcctggcacggttcccaggcacccacctgtcactatgctctttttgaaactgagcatctgatccatggagggaggccttgtgattttcaggcttgatattcccatttttgggtgggccagctctgactcaatggcccacaagataggaaaggccccacaagcctcgctggtcaaacaaccatggtctattccacactgaggccaggctgcacacagaggcatcctggcccccacgaaaagcaatggctctcgcgtccatcacttgaaacaatgtcgctggcttcatggggcccttgattcagagtttgcccctgaatgtcggggctgggttcactgatggttcaacaatactgaagcccaatgatacccactgggctgcagcagctgctcaacccgagggctggctctgtagaactgcaggtgcccacggccatgccacttagcgggcaggactcagggcccttctcaaacctgtggccaactctcctcctgatgaacttggttatgtttttactgacccatgggcagctgctggcagcaacctcactgtctggtctgccacttggaacagtcagattaaagacgtccttctttggggccacacattctggcaagtcacggcggctgattgaacattctgggtcagcatgtagatgcctgagctcagagtccatttgttctttgatgagactgaataagaccaagctgttgactgggcctgcactgcccagaggccaccactactacccagatgcaccatcataccagagagcaccccatccaccactgcctgggcacaaagctaaacactctgttcctgacgcagaggccatctctgcataccagacttgtgactcctgcccacagctgtcccgtctgtaccccgtgagggcaggcccattgctcctgcctcctctcagccgatcaaccatctcaaaatgtggtgctctccccaccaggggtaccggtgggggcctcagcaacactgagaccattataggctaccatgatgctgtcccaatacaatcagccagcactgcccacactgttatggttgttgaaactcacctgtggcatgacttcaactttccagaccatctacactcaatgatggtgtaccttgtatcacaaaagccacttgccagcaggcagagcgttgagacactcgagggactgtctaccctccctactctccacccttcctaccttcacctccttctggtccttagtagaaaagtctgatcactatatatggctaatccaggaaggaatcatctcctcttggccacattctgagtaatggccaggaagagaaggatggggattatatagaccaactgtgaaaactcaaggttccaccctgaccattcttgggcatgaagcttctttcttccctctagcagcgagcccaggctggtctggttggtgcagcctccaggtgactacccagccaaacggggacctggagggttcaaatctcattccagttcagccacctggattctcctgttgactgacatggtcctgggttgcaaggacaacacacacttgggagagtacactgctgaccatgtccttccacatgggacaaagcagatacaatgggtcctccagctttataaaaatgcctcttgcacgtgacccttcagaatgaaagtctgggggcaaggaggggacaatcaaggaagaaggtgaagttgcagctattgtgacgagacaccaatttggggggtgggtggggaaagaacagcaaccccagagcctggagagggagggggacattaacagtcttgcctgtctcccatggcgcattcccaacaatggaaaatacaatggtacggtgacacccccaaagggtggtacatttcactggctgctgggtctagcattctctgcctttctgagtcatccatggctcattcaccacgatggaaaatacactggtacagtgacgccccaaaagtgtgataaatttcactggctgctgggtctggcattctctgaacccaatttgatgcccattcaccttactgtcactgagaaacctgtcagaaagcacatgggagaacttcagtcctgcacgtcccaggcaaaacacaagtcaacacctgctgatgtcttccccagccccagcctcacccctactcctggaaccactggccagtcattcggtggagtggacaaatgccgtctggcatggacacattgaacagtttggacccgcagactgaactgaattaatctaactgaaccaggcgccttaaggtctatcagtcatccaggagtccatgttggagacactgacaacctctatcccccaacctatggaggtccctcttgcaggggctccagcaattgtaagcaacccttactttccagggcaccgtgtgcccacagctctctacttcctgtgtggaagccaagtgtcaccttgcttccctcctgagaacacggacactcgtaccttagaggggtcataagagaccttcgggtatgtaagcagaagcactccctgcatgtcacatagccctcgatcactgagaagttccctccaaagtggagctgccctcagtgacttggttaacttttcgggttagtggcacattatttctgtgaatgctgcagacagctatccataggagacatctaactagaaaaggttgtaggaaacgtgtcccaggacttagggaaggtgatcaatgccactacctcggccctcggcattcagcccagcctcacctcaccatccagaagtgtcacagatgacaggattgcctttgacttcttccttgtggttcaaggcgaagtctgtgcaattgccgattcctcctgccgtagctggtttattaacacatgccgccaagcggaaaggtcaacagaaacttacagagaaactagcttggtttctaaggggaccctgaaggcttgtgggatttgctcagctggctggatccaggaccctggaagtcacaattgaggttaatactgcagtcctgttggctgctgtcttaattaaagactgcatgagacaaatggggtggatttggtcccaatctgcctgttaatcagcatggccaacagaatggcacactcaggaaaatttgccaggatgatgtagacatgaggggtagatattgctcaggaacagttcttcatgggtttctcatgttttattcagggacagttcttcacgggtttctcatgttttgtttggggacagtttttcatgggtttctcatgttttgtttggagacagtttttcatgggtttctcacgttttattcagggacagttcttcatgggtttctcgtgttttattcaggacacttcatgggtttctcatgttttattcaggacagttcatgggtttttcatgttttattcaggacagttcatgggtttctcatgttttattcagcacagttcatgggtttctcatgttttattcagcacagttcaagggtttctcatgtttgcccaggaaccgttcttcatgggttttcatgtcaggaatgtacagacccaggcagaagcctcagtgggaggcagtacttggtgggtttctcttgttctgtgtgttgcgtgggcagaggcactgactctgcctttttctggcccatcctctaagatgtttgtactgcgagcagccttggaagttagagacagtgtcttcctctggagcaaagggcaagtgtgcagaagtcatcctttatcaaggattctatttccctaaactcagcgcttccctcccacaacgcaacgtgctgtgcatgtggtgccgggtggccttccctgcactgtccttggaaatgctcttcctactggtgttgctgtgaggaaggaactgaccttcatctctgatccagaggcttcgtgtcttctactggtatcacgaaactgaggtaggctaacctggcgggtcaaaggtcagaccccacacagtccttgccaccacacatctgctcctcccattagaaactgagacatcaccggagacgtttccctctgcctctgccccgttttcccagccactcctgagacctggtgatcttgccacctccatctctctcacatcctgctgagacctccccttagtatcccctgctggtgtcactctggtcatggaccactggagctgcccactcaccatcctacccccatctgcccagccccttccagcatacgcctgagaaggtcagccccaaacgccctcagcagcccatgcccaggcctcagtacacaccatccctcagcaagttgtgcgttcccaaccaggacctgctgaggtctctccagaaacagaatcccctccctctggggagaaggacttcggcgcaagggaacaggaaaacactgcaaatatttacagtggacgtacgaaaaggcacaggaatactgagtaattgaaaggtggaaataaacgaggccccatgaattaccctggcaaccaggtacagccgtgaagacaatgaaattcactgtgcctataacccaaagtcaagatgaaactgaggtgtgggcccaaatgcaccgtgctggtgctagagtgccctgctcactcatctgtcgcccaccacacctctcctcatctgctgagggcctgccacgtccctgcactgtgctgggtgctggcctcactgagataactacgaccacctccaaatggagctaaggcctacgtggtttctcagggaccctgaccttctctctagcaggggtcacccctcacagaggcaagtgatgggtcaaggtgggtggaagcaaaccctggggttctctcaatacagcaggagcgggccccagctccacggccccccactcccacctagatggagtcccaggaagctgccccaccacagggcaacagccaggtcacagcaaccacagacggccagggaagacggagctcccagctcccagtgatgaggctctccgggttgggttgtgaaatagtcacatctgccattctcggctgaaatccccgaccactcattccctctccctccccttgttccaggttctcattcctgaggctcctcctggccaccccggcttcccgccatccaccagcaggtgtgtgattcccccaggggctcccagaccccgttctgttccatttcctggctcagcggtgctgttcagggcttattccagtcgctggtgcctcgctggtgaccaatcagtgcctgtgtaattgacaaactctaccaaacctcagagagtttctcagtagagagagtcaccccaactttattattttttattctttttctttttgagattgagtcccaccctgttgtccaggctggagtgcagtaacacaatcacggctcgctgcagcctcaacctcccaggttcaagcaatcctcccatctcagcttcctgagtagctgggactacaggagcacaacccccacacccagctaagttttttttattttttgtagactcagggtttctccatgttgcccaggctggtctcaaactcctgggctcaagcaattcgcccgcgttggcctcccaaagtgctgggcgtgagccaccgtgcctggccatggtcccaactttaccatgagcccaccaacactcagagaggacaagctctgtatctgaggccagcaggtctcagggacaaactccatgtccagagctcccctcccaaagcctgtgctgctgcccttgggggtgaatgaacacgggaaaggccgcagctgaggcctggggaagctcttctgccagcctggcttcaaagccccagcatctgggggaggcttcaccacgactgttaggacaagacgggcacagtaaggaagctgagcactccgagcacgagggcccagcccaagcgtccagtagcatggtgaagagcacagctgacttgctcccagcagcccagcccttatctgcaaggaagccccaagtcatccacacgtaggtcgaccaacagcagagacgtccacctgcagggccccaaccccacgactgaaaaagaaaccagccaagcacaggcactgctgcccaaactgcccagtggctacagctgccattattcagtcctcgctcttatccaagctggccttggactagaagatggccttgcccctttggagcagaggggaaatgcttctgcagctgcaaaggtgggcgttgttggcagcagcttcagaaggctttcgcttcttgtgttctccttccaagtaatcaataaccaggccctagaggcagcggtgctaagtacttagcaaggggacagcgtgaggctccatccagacccttaagcatctcggtacccgtctgccgcactcctgaactaacccctgcaatgggagaaagggacgtctataccacttctcagaagaagtgtggctcaccattgtctggaaaatgaggccttggaaccaacagatggttgatggggaacaagagaaagtgcgtcaccacccaccaaggcatgaggcctctgcagggaatcggcctcttaaggcctctcccctttctgacaacgtatgtgcagaagtgtgtgacgtcctgcaggccgtgacagaatgccaggacatgggaacaagggctgcacgcaggcgttgagaggaggcttctgcaggtcaggcagagccgagtcccaatcccacggctccaccctgggctgcgtggcctgcacgaacccatcatttctgtctcggcctcactttccccatctggaaggtggacgtccagcccctgcggtgctggagaaggccattgtgaagcttaaatgtgaggtatctctggtgtgtttgtgcatacatatgcatgcatgcatccctttctcccatgcaatgggagaaagggacgtctacgccacttctcagaggaattggggctcaccaagaaatacctcacaccagagataccaggcacagtggctcacgcctgtaatccaggactttaggaggctgaggcaggaggatcacttgagctcaagaggtcaaggctgcagtaagccacgattgctccggtgcactccagcctgggcaacagagcaagaccttgtctaaagaaaaaagaaaaaaaaaatgcaaaaatgaacgcagcacactcagctgtatccccatccatgctatgtctttgttcacaatttaatactgataaactgtgtgttatgagggagacaggacgctgcatatcacctcagatgtcttcgcctgggctaccgtacaaagcccggcagacagggcagcttacacaacagacattcattatctcacatcccagaggctggagtccgcacagggctgggtcctcctgaggcctctctgcttggcttgcagacaccaccttctcactgtgtcctcacagggtcatccctccacgcatccctcatagggtcatccctccacgcatccacagggtcatctgtttcctcatctcctcctctgttttttgttttgttttgtttggagatggggtctcactctgtctgtcacccagactggagtgcaatggcgtgatctcagctcactataacctctgcctcccaggttcaagggattctcctgccttagcctcccagtagctgtgattacagacatgcaccactacgcctggctactttttgtatttgtaatagagacggagtttcaccatgttggccaggctggtctcgaactcctggcctcaggtgcctgcctcagcctcccaaagtgctgggattacaggtgtgagccactgtgcccagcccttaactttattttttattttttttaagatagagtctcgctctgtcgcccaggctggagtgcagtgacgtgatctcagttcactgtaacctccgcctcctgtgttcaagtgattctcctgcctcagcctcctgaatagctgggactacaggcccacaataccatacctggataatttttgtatttttagtagagatggggtttcaccgtgtcgaccaggctggtctcaaactcctggcctcaagtgatccatccacctcaccctcctaaagtgctgggattacaggcgtgagccaccacacccggccttcatctcatcttcttatcaggacaccagtcctttggattagggtccatccatatgaccccaacttaacttgattacttgtctccaaatacagttacattctgtggtagtgggggttacaggttcaacttaggaattcagggaggggacacagtgcagcccatgacaactctccactctgttcttcatgacctgtggtgacggggctccttgaggactgttgggctatgactatgagagcccattgaccaatacgtcaaacaaaactgctactttatgtcagaatccacatttgtgatgcttgtacctcagtcactgcctggaaccctgtttcctgaatggggcaggatgacattggaaggtcccaggctgtccccactgtaattagaaagaccagaacctgagcctttatgaagatattttaaatgaaaagaaacacaaggtccaggtgaaaggaacaacgtgccccaccctgggtggaaaagcctcgcctttcccaggaaaatgacctaatcaatccaatttcatactctctgtcttcagtcattactggaatattcacttacaaatgcaaattgcaaagagatctatattcatcaaggcttcctttttcctagagagcttatcaagctatcagaggctatcagctcataaaggtgataggaaaaggtgacacccagagaatgcaatcatgcctgcttaattgcatcgcaggcagggtgcttgaggaaaagatgaagcgccttgtataaaatactgcatccttaatgggggaaccttccttgtcaaaggcaaacatccaattcaaacaagagttggtacagcttactcttcctcctttaaagaagtctgcaaaaccaaacctggctgtctggaaagtattagaaaaagagagaaataaaatccttcctctctttattgccatgttagatacacagagacaaatggcctccaggcaatgcagagacataactctgctaaagccagattcctccccgaaatcatactaataaatcaactcaaaccaaaggcacgggccccagtgatggtcacactcaccagaaccggctgagagggcttctgtggtgggtctggaatcccagcccatgggttctggggccgtctcatcagagccttgcagcaattccaagaggagtgtgtgagtgtgtgtgggagtgtgtgtgtgcatgcacacatacatgtatatgtgtgcacaaacacaccagagatacctcatttcctgggctccactacgatcagcagagctgttccatatcccagggcttgaccttgcgctggacgtgcaaacatctcatgaccccatccagaggaagggttgaggtctctgtcataacatgagataacaggctggaaagagccacaatttctgaggtcaaagggtactggcgtgactgttaggaccagagtccccatcccatgtgcccctagccactgcctgctccccgtccagagctctccagcctgctccggccctgggcacctgcacgagttggccagggctgctatggcaaagtgcacagaccaggcacctgaaaccacagagacacgctgtcccacgcccccggaggccaggaggcccaggtccagacagggtgggttacctctgcaggcacagattgttccagggccctctccttcgcctgggcactgccattttccctgtgtctctatacagctgtcgtcttctaaggacaccagtcacaatagatcaggccccaccctactggcctcatttaacttgattacctctttaaagaccctcgctccaaataaggtcacgttctgagtacttggggttagagcttcaacctgtgaatttgcggggacacagttcagcccacagcagtgctgctggcgggaagggctgagtcaagagcaagatcgttcccattttccatggaaatcaaggcagagagagatccccaagccttactgacaccaaacacatcaccacccactccaggatggggtggacagcaggtattcgggtaacccagggaaagttttgtgttcaaagtgacctgaggccacatctggggatgctggtctgtaggtggctgttctgatgggaccacagttactcacggggacaactaagcagtgggtgcccgatggagttgatgtcatgaagagaccccagcatcagtgccgcgtgtgacagctgagacctggggacctgggcgtgggggctgcaggaagtcggggcaggctgccactgcctcagcctcactctctctgtggcctcaaaccccaacgccactcacctgcacttctttaaatcacctcacctttgtgtcaactgagaattaagccaccaaacaggatgttaacagctggatccaaagagcaggtgccaatgggaggggggcaggtccagacagacacagagtaccagtgaccaaggaagtggatgctaagtgacatgcgggtgtgaagggactgaggaaatggccacatgtcttcagagccaacctgcaagtaattaaaatgtctaaagaccacaaagaaacgcaaaagagaaccagaccattaaagtgagctccaaacttcctggcaaagtatacttgacagaataattcaggcttccataacttgagcagggactggtggacagcaggacccagccctctgcaaatcacagaagacctgctacagctgcagagagcaaggaccatgaggaagaagcaaatcctgggtcccagcgctacatccaccccagtcaaaggtcaactccagctacttagacagaaggtccagtctgcttccttcgtgggttaatggtttacaatcccaataaggcttaaacctgagaacagacatgaagaaagaaaccaaagccacctgacgcgtgttgtatgtaaaatccagaaatagagctcactttttacgtagggcacctatttatatttagtattaaaaagtgcctaactggccaggtgtggtggctgacgcctgtaatcccagcactttgggaggctgaggcgggaggatcacaaggtcaggagatcgagaccatcctggttaacacagtgaaaccctgtctctactaaaaatacaaaaaattagccaggcgtggtggcgggcgcctgtagtcccagctactcgggaggctaaggcaggagaatggcgtgaacccaggaggcagagcttgcagtgagccgagatggcgccactgcactccagcctgggtgacagagcgagactccgtctcaaaaaaaaaaaaagtgcctaaccaattaatcttgtcatcacagccaaaatatgcaggtgaatgattgatggagacatgaaattttatactgaaagcataattttaagaaaagtgaaaacatttcttagatgtttcagaaaatttaggattcccattttcagtatattgcaattaataaggattatttacatacccgaaacagagttttttcatagaatttcaggaattcaggtttgtaaatgagatcacactgtaatcagaggcccactcttaaaggatcataaaatcaactagacataaacagagaaatccttgcaaaattaaatttacaaacttaaaaaaagtttttgaatgtatcactctaataaattaaaagtttaatgctaaaatcacacataacaaaaatactcttttctgaggggaaatcttcccttgaggaacaagaaaggacctggtgttggtacctgcctgccatagaggagagtcagtcataaaaataaatgtgatgggccgggtgcagtggctcacacctgaaatcccagcactttgggagggtgaggcaggaggatggcttgggcctaggagttcgggaccagcctgagcaacatagcgagaccctgtctctacaaaaatatttaaaaattagccaagcatggtggtgtgtgtctggggtcacagctacttgggagtctgaggcaggaggattccttgagcccaggagtttgagtctgcggctgcagtgagccatgatcacaccactgcactccaacctgggcaatagagcaagaccctgtctcaaaaataaattaatatatatgtgaataaatggatggttcttaaattctagctacatgctttaatctacccaaggctctcaacccacctctggttttttgtttttttctttttcccgagacagtgtcttgctctgttacccaggctggaatgcagtggcatgatcttggctcaccgcaacctctgcctcctgggctcaagcaattctcccgcctcagcctcccaagtagctcggattacaggcgcatgccaccacgtccagctaatttctgtatttttagtagagatggggtttcatcaggttggccagtctggtctcaaattctgggcctcatgatccacccatctcggcctcccaaagtgctggaattgtaggcgtgagccattgcacgtggccctgcctctggttctttctgctaaaaagggagagagactagcaaggtcctagaaatgtcaaaggctctctggcacaacaaaccaggggtctccctgcatgccctcccccgcatggctcacaaagacccatccctgcccgatgcaatggctcacgcctacaattccagcactttgggaggccgaggcaggcagatcacctgaggtcaggagtttgagaccagcctggccaacatggtgaaatcccatctctactaaagatacaaaagttagctgggcatggtggcgggcgcctataatcccagctactcaggaggctgaggcatgagaattgcttgaacctgggaggcagaggttgcagtgagctgagatagcgccaccgcacttcagccttggtgacagagtgagactctgtctcaaaaaaaaaaaaaaaaaaaaaacccatccctgctctcagcatttattggatgaaggccctcacgtgcctcgctctctccctaagggcttgagacctcacatggaacaaaatcaacataaatctctgccctgggagaccatctgttgtcctgggagtcaaagcagaactgaaggtagaagaacttagttccgtgactcagtgtgacccaacgtgtttgtatccacaaaaccatttcttcatttccttccccccagtgtccggcctgagcacatggctgggccctcccgggtggggtggaggagggtgtgggcaggttccaagatgctaccactccaagcatgtgctacagcctgtgccaacctcagctcacaaacctgctcaggcctgttcaaaaacagattaataaataagcaaataagtgtgatggctcttaagttctagctcagttctttcatctagggttaggcctccctggtgccaggcaagctgaggccgccaacaccctgccccatgaggccatcttcttctctgtctctccatctgggcaaatcccatctgctctatcagatggtgaatcctggggagatggaccccatgggtctcagattttagattttgtctgcatcttctgaagagaacctggcaggcattttatttatttatttatttttgagacagagtctcgctctgtcgcccaggctggagtgcagtggcgcaatcttgactcactgcaagctccgcctcccaggttcatgccattctcctgtctcagcctcccaagtagctgggactacactggcaggcattttataaaacactgttgattaaccgaaaggccatttctgagccacatcgcttacccatgctcagccccacggaaagggcatttaaagcaaagagtcttaatcaccaaccccagccagggaagaaggagtcgggcaccctggtcacaaactccagcgtcagagaagtccaagttcaaacacaggggcagtcactgctaaggatggtgaaagcgcagcagttgccgaagcttcactctgtgtgccgtttccggtcagctccacacccagccttcaaggacagcggcttgagtttgcatttttgccttgcttttaattaatttttttttttagagatggggtctcactatgttgcccaggttggtctcgaattcttgtgctcaagagatcctctcgcctcagcattccaaagtgctgggactgcagacatgagccactgtactcaggcacttttgcctttgtatgttatgaatgttgtggctggtgctggggcctcctgcccagcatctgtcccaacaggacagtgaccccagttaggatctccccctgtggggagtttggaggggccggcagctctcgggttaaacaatctcgttctcccagccagagaatggctgaggaaggctcatgccatatgaggagaggtctctagcggggcctccaagaagggtttctgcacccttgagaaacagccccacaggaaacaggccttctcttccccaggaccctgtcaggaacatcccactaccacatcgtgagtccacgagctgtgaggggtgagaccacagctgaccccgcagacgccgtcccctaccaacccccatccatggctgactccacaccacactggggatgggccaagaccagactcccttccacgtcagtcccaccggggtcccctcccgtccagcagatgtactggaggttcaaaatccagaagacagcagtgagcctctgaggcagatgtctcgtgtctgtgggcaagtgaggttgtgaggcggcggggtcttcaaaggcagagttggttctggatcctgcactggtggccgtggctcatggaggcctgagcatcctgtggcagtctccttagactgcagctttgagagttgcctgtgatgctcggcccagcatcgatggtcatgaccaggcccatttcctcgaattccatcccgttctgctcagtcacctgccaccatgccgcaatggacacggggcggaggcgtattcaatgatgtggcccggagcccacaggtgaggcactccaggccagggggcatgagggaccccccaagaaggtccagagaccagagacagtctcagcagttaccagtcacttcccttactcacaggaactgtaggccagcgttctcagctctgccacttgctgtgtcactttgagaaagtcaccagacctctctgaaccttagcccctccaactgtaaaatgggagctttacttcccacctcacaaggcaaatccacagaagtcagcctctgcagatgtgaacaagccgcatattaaaatagaagactcagccacaaactgtgtcactacctgtaggcagccagggtttgctccaggcaaatgggcaggcaggagccagaccgaatgaaatgtgacctgccgtagaggcaatacctgcagctacacgtgaccactcagtcaaaatgaaggttgcagtcacgccccaggaagaggcacttcatggatgggaggaagacacagcagcaaggttgccttggctctcaaagccttcgctaaaacgtgcacactccccaagccgcagcccacgcaaagcagctgcagcctcgaagggagcatgcagggaagatgtgacaagccggccactgcccctaggacctgagcccagtggatgcccttgaagcagctgggtcgtcaggaaccgtggaaggaaagctggccgcacggacaccgcaccctgccatagggaatcctaatcccctgcgctggaaagaccgaggacaaccttggccagacgtgcagaccctgtagccgtgagctgctggggacagagtcgggggtattaaggattcaaggagacagcaaaatgccaggcaggaatcccctctggcaaagagaatgaagcttcatttccaaatagattaatctctcaaaggcggacatggttttgtcttttagggcatttgtttccttagcaattttttagacagataaaattcacataacatagaatttaccactttaaagtatttaatggtttttagccatgttgtgtaaccatcaccactatctaacgtcaggacattctcagcaccccacatggaaaccctaaacccattagcagccacctcccagcctctggcaactgctagtctattttctgcctctgtggatttgaccaatctggacaatgcggataaatggagtcacatcatacgtggcctctgtgtctggctcctttcaccacacgtaatgtcctcaaggtgtatctatgcagtagtcctcatccgtaatccattccttttcaggccaagtcacatcccatcacatgggtacaccacactgtttatttattactcagctgacagacatctgactgattccagttttgggctattataaataacgctgccatgagcatgtatgtaaacattttcactcgtacctatgattccatttctcttggggacacacccaggagtggaactgctggctcatgtgctaactccacgtttaacttcactctacatttgacttcactctacatttgacttcactctacatttgacttcactctacatttaacataactctacatttaacttcactctacatttaactttttttaggacttgccaggccgtcttcctcagcggcagccacatgttaaccaataccatgggtatggctcagacagtaattctcttcccactgctgtcattttgtcttcaagcctttatctgcatgctcagtcaggagcttcacaccatggtcagatgtgtttgtcctcagtcaccagaccacagagaggtatcaagtctcaattaatacacacacacacacacacacacacacacacacacttcagatctttattttagtgactgtcatatggggaaaaccctatgtgtaaataaaggtatgtgctcaaagctttgttcagtggtgcattcaaccaatattgggcacctgcaatgtggcagggcctgccacgggccccgaggatgcatcagtaaacaacataaagcccccacaccgacctcccccgagccatcaaagagacagacacgacagtgatggtttaagacaattagcagtgcccaaaaattcctcccaagatggaaaattaatcttccaattaggccatgaggagctcctgcagatgacatgcattcatttccctcaactgttccttctccacagcaaccacgtgccctcccccatattccaacttgacaaagcggtggaaatctgaggcactgcaaagagagaggtctcggccacgagaagcacctcttgtctcatggatatatgggatccgttgtgatcccgaggacaagcacgtctttccacgcctcaggagagctgtgctgcccaccgctgcccgcccggagattgcgccgagctggcgtgtgccacaaagggtgatcaccacgctgtgtccactgcactccaatgccatgatggtcggagctgctgctgctgctactcacttggccacagacggcggtcactgatggcggtcacctgcacagcaggggctcgtgagtgagggtccctatgagccggttctctttcaagcccagacaccagtgacctcagctttaagataaatccagtgactattcccattttacagataagaaaagcaaggctgagaagtataggtcacaggttcacggccacagagtgggtacaaagcagagacttgtccacgcccagcacacagactccgagggtagtggggctggctttgaagtccagaaggagcacgttgtctcccaccaggagacgggggatgaatctgtgggaaggaggcagggatgaggcacctactccagttcctccagtcgccctgacccgaggaacaaacctgcctcccggaacctgcccagtggcttctgtcattgccaaatttcaaaggcacagccatgagccctccaaatggattagggtcccctgttctacaggataccgaccaattattgttatttggacaagtcctggtttatctgattctctgattcttcacagctgtgtggaggaggggtgtgcccacatggctcacgggtacacagtaggtgcttaatcactgtgtgccaagtgaatgaatggctgcttgatgatgagggtgcaaggtgcacaaacaactccctgcctttaaggcatctgcatgggcctggtggacacacccttctgccgggtggcagcccagatcaggaactcacctcagaggccactggttccccagccccatcccctcctcattcctcccctcagggcctagacaggtcatggaaccacatctcagaatgtgcacagcagcacagagggcacacaaccagccactctctgcagctcaggtccttgtaccttaagaacagcctacctggcgggtgggcaggtgactgaacccatttcagagatccatagactgaggtcagagaggtgagggtactcccagcccctcggcgagacaaggcagagctaggacccaggtcttccaactccacactcaacatcatacccacatctcaggctacccctcctcaggagctggcttccaggtggctctgcccaggtgtcaaaaggggtcgatgttggccagaatgacccaccgggaaagcagccagcacacagagtcactaaaggtgacctttgggaagtctctgagtcataggccagtcagagcacaccatggacaatcctcttgtccatgtgggattcctgaccaggtcccacccaaagggcacagcaaggctgtctccatccacctggccggctccactgcctgctgtgccaaagtcacctgccctggttaagtcaatgagcatgcaaggggcaacaatgagcacggcactgacccagggtcaaagccatgggaaactgccttggaaaaaacggagccagatgccaccaggatagttggcactggggctgggtgactttgaccctttttctctgttttccaaattttctgtggagcagcaaaataagaagtaaattgagatatggaaaacactgtgtgtccgcaggactgtacacacaggcatgctcatggagcaggtggccctgtggggttccagtgatctcaggtaccacctgcaagggtgggtcagcttttggaatcaagggtcacaccagcgtaatgaccatctgtgagggggaggcgcagggtctagggagatgtgccccaattgtctgctggagatggtgaggaggcagcgaacctttgccaagaccttagtggtcagcatttgccaacaagtcaatctcccacatgcctaagagataggtgctatgataacccctatttcaacaagaaaacaatgagatataagaagtatctaaatcagagagctaataaatggtcaaaccaagatttgatcctgtgcagcttggaccagatgccagacattttaatactgtagtgcaataaagggttaactcagcaggcctgggttgtccaaaccccacacactccaaagaaagactgggtccccaggacaattgcttgaactggggaggcagaggttgcagtgagccaagatggcaccactgcactccaggcaacagaccaagactccatctcaaaagaaaaaaaagaaaagaaagaaagacggggtccttacccagctcatgggagatcccctctgagccctgggaatatcctgtgtggtaagagtgcctgagttcacctggggccttgagtgacatcagatggcctgtgctaacaacacgtgttacagtggggaccccaggccacatggtagcagcgtgacctctcaggggcctggggactaaggccagtcatacctgtgtgaagaacccccaggaaaagccctggctccgaggctcaggagcagggtgcaggggtctggactccttgtgtgctgtcacacatctttggggggaaccatctacgtgccgccccgggagagaacacggaaagcgggcgcctggtctctcctggactctgccccacatgccttttgcctttgctgattccacccttcgctgtgatgaaccctgcctgtcgctaaaacagcttcactaaggactctgtgagtccttctcatgaatcagtgaacctggatgggggtggccttggggagccctgaacacagctgtcctgttccgaggaaaactgcaggccaggggtggggaaactgaggtctggctggatttacaagaacataagttacttttataaaagtcaaagatgtaaatccaaaaaaaacccataaactccatggaaatgatctggaaggggcgtgctcacatggtaactgcggcaccaggcccccggctcagggcacgggcagagggcccctgctgggctgatggtgcggcttggtaggagtgtcccacggggaggtaacaggacccagcgcacctcccatctgcgctgcctctgtaaagtgagcctgtgccaggaagggaccccatggacacgttctcgggtgacaggctccgacgggaagaggcaccacagggtgccgcttgctcacctcctctcccctgggtgaaggctgcggcaagggactccccaggcaggtgcacttcaccctgacacctggacgcctgtaccctgccagccacgcccttgcactttaggggaagatagggtttctgagaacagggtcccctcgaggtttcagctggggccactgtctccttccaagacagccccagtctaaccctgaccagagacacagaaaacaagaccaagaatgcactcattctgggactgctaagtgatgagggccaccctggagccacgccagacaagtcctgggaagggggcaggaggcaggggttcggagcactccaccttcccaatggcccatccacaggatgctgaccacggccgggcagggaagggacgcctggtcccaggtaggagggtccctctgcagatggagatgagggaggcaggggacagctagctcgggtgatgtcagccttgggtgatgtcagcctggcctccctcctccctccctcacctgccctctctcctcttccccatgaaggcagccccagcagggtgccccagttaacaccagaggcaggaaggccccaagtgcccagggagtcccagccctggattccgtagcacccttgtgtaatgagctactcagacccaagttcccgtggcctttgcagccagaggcctgaccacagaagtaccccaggccacggactctcagcacgggcccatcctgtggggtagccccttttctcacagtcaccaccccgcatccagcccacattcttcctagctttgggtcatctggaaatctggtggtcatgcctctctctggtcagagggtactgaccagcaccaccctgaccctcaatcagtggcaaatccagcagtgtcctgtggctctgcctcgtgcccctgctgggcgctcctgcgagaacctccaccctccagctcctgcctgtgcccctcttgctgggctccagtagaggctgcacagcccctcaggaggcagtgccaggagacccacgtgccaggacggagagtccccttcagcctccttccccagtccctctagctgtttgttagcattcaactttgggaagtccgagtcggccacccagagatttccaagatgtcagggaagcaccacacttccaaattttaccaggaggaaagttccagagaggggtaggtctgctaatgctccctccccaacacctaccaaggcactcctaatgtgcatctgggcatgttgggtcaggcgtgttatttatccacttgttggtggcaggggggtggcagagtccacagggtcactgtgggaagatggccaaggatggtctcttggggccatgtcaagagtcgtttctggatggctgctgagatctgggagaaaggaaaggcccctcagccctgtgtccccccagggctgcagcaggtgaaacggggctggggacctctggggagaaaagctccaatcagggctgagctctcatcggccccatccccatccagagaggagccaggtccaatttctctccgtgtgccccgcgccagcctgcatggaaccctccacgtttcctaaagtggctactccatgaacacaaggggaaagaatacgcgaactcactctgcaaagtacacatctgcccgtgctgatggaagaagaaggatgctagtgcaaagtcttctgtttctgaattccctcccattgcttccctctccggacaggcacacacacagagcgactccaggaagggctggaacaacgcctgcacgtgatcaacagcatccgcacacccggatctcctctgtgcgtttagttaactattccttagaggttacatcgtgactgttaaacagctgttggaagccaactcttccctctgaaaacatccaggcagaattaacactggaatgcggatctgcaactgccactcagagtgtcaggaagcacaggagcgtaaatatttagagaaagccgggagccagcagcgccgcacccccgccagcctacatccacgcagagagatcgcactattctcatatccacagttacagaaccacagcaaaattacagcgctcatgtccccatacctccaaaaaactagcttgctacctcagtaaacagttgataatttgtaatataataaaaacgtcaaggctgggtgcagtggctcatgtctgtacccccagcattttgcaaggccgaggcaggagggtcactcgaggccaggcatttgagaccacctgggcaacatagcaagacgcggcaactacaaaaaataaaagtaaaaaaactagatggacatggtggcacatacctgtagtcccagctactgaggaggttgaggtgggaggcttgcttgaggccaggagtttgaaaccatcctgggcaacacagcaagaccctggtctctacaaaaagtcaaagtaaaaaaaagattagccaggcatggttgtgcatgcctgtagtcccagctcctcaggaaggcggggagtgaggattgcttgagcccaggaggttgagggtgcagcaagctatgactgggccactttactccagcctgggtgacagagtgaggccctgcctcaaaataaaaaaaagaaaagaaaagaaaaaaaaatcatggaaggaaagaaaaaaaaataggaacatttggattcaaccaacactttaaaattcctttttttttttttttttttgagacagagtcttactctatcaaccaggctggagtgcaatggcgcaatctcggctcactacaacctctgcctccggggttcaagtgattctctggcctcagcctcccgaatagctgggattataggcttccgctaccacacccagctaatttttgtatttttagtagagacagggtttcacgatgttggccaggctgatcttgaactcctgacctcaggtgatccgtgcgccttggcttcccaaagtgctgggattacaggcgtgagacatcgtgcccggcccattttaaattttatttctaacagtctcagataggccaagcctcctacattaggtttgtttgcttgttgtggtgaattacattctctctgatttttcccttcttctttccaagaaaaggggaaattagcaagtttctaatctattttcagtgctttgctgagatgcaggtaaagtttaaccaagaagcaaaaacaaatcgacagagcaggacagcactgacgccagggccagctgccccgtgtgaccccgtctctctcagccaggtcttccagtcctcgcttccagaatccaaacagctctaactagtcctcagtgtgacaccgtcactggaggctgaccctgcaccaggcctctctggaaggtggcacactcagggtcactcttgcctctccaggctggagagcaaaatgccgagaaaagaattcctctgtgttcctgcctgcttcccaggcaggcttacctaaatttcaacaaattccactgcaaaaaaaaaagaaagattggtgtccgagaggtatactgggtttggcagtctgagggctcccaagaaaagcttttaagggccttaagacacctaaaacccacacatgaagaaaaccacagctgccctgaacatccaactagtccagcgtccctgtacttaaacccgaggaggggcacagaaagccatgcagtggtgttcccaggggccccactgtgcacccagtgtggcaggagggtgccctggaggggcatgagctggaagtgggcattgctggttgagtgggatgtgccagggcagggagaagctgtcctgggaaggagggcagccccagcagaagtgtcaggggagatggggaagttggggggagaagggacacgcaccagagcccagtatgtgcagaaggctccaaggatggactgggtgaggctatggaacaaggggagaaagaatctcaaccccataaaccctagcccgatgctgctttccaaatctcggatagctccaggggacattacgttgccaggacagggctgtgcacccaagtgttcctccccaccctcccttcccgagtcctaggcaggtgctgtggacattacaggtgggtataaaacagccctgcctcaagggagctcccaggatagagtggctggcatagcaagggagaccaacgagcagtctctggaatacgaaacactggcttggaatcctgattccaattcccctaggtgtgatccttggtgagttactgaatctccagcctcagtttccttatctgtccaaggcaggttggaggcttaacaagagagtctaggaagactggactttttattgagacagaagtgctcaataaatcgcatctaaggcacgcacacacacacactctctgacttagagcagaggttgctaaactctgggagatcacaggccaggaaacagaagaaaaagaaatttcatgatcctgttgagatgaccaacgttacatgtctccaggaaaaggcatctgcagaagtaagatgcaccgtcagccactgttcctcaccagagaggacactcggccccaatgtcaggggaaaggtcagagcagaataaagcccagtcctctgagtctaagccactgtgcttcaaaagcagaacgtccctctcaggccctggctctgctcatttcaccacagatggaaggagctggtcaggaaccagccaggctgaatcacgaagcaggaggctcctccagccccatccccaggccaggataaatgtcgctctgggtgaggacttgaggaaaaccacagggccttgcaaggactgtcatgattgttctcatcaagaaatccccttcacaatttgtagtgagtgggccactcccgacacaggccaatcagacacaccctcccacgccctgcctcaagaaaacccacgtgcagggctgacccaggagggagcttcggttcgcaggagcccagccaagcaggtgtggagggggtcaggcttccctgtccagggacacacctgggtgctcccctttgcataggtcgtgcctcctctcagaatcaggaacagccatggtgccccctcccaccagcacacacatggtcatacccagacccagctcctcactcttgactcagtgaacttctgggagagctgcaaagccaggcagcagccatcccttgtggcagaacacacagcagacaggaaccctgtgttggtgtcaatgtgctgggtgctcctgcaggagaccctccatactgcgtgtccctggactaccaaacagcacatctgctctggaggtgagggtctttgtcccatcccatcaacagagcacctgccgtgagctgcctagagagatatactggggggtctctgccagactacatcccaggggcctgcctggcaccccgtgggggctctctgggacagcaggacgtgtccattcttcacaagactcatcagatgcctggcgcccagtggggtatctctgggagtggcaataaaccaccgaggattcgacacaggacgtgggttgtgtgctgaggcatccattcttcacaagactcatcagatgctcaaacgagtccgtgaccccaaaatgtgaagaacagaagctttcgatcatctgcaagggaacttctgaaggcagcctcagtcccaaggggtctccaggggctgcaaaaccatccccagtatttagtggtgcatacctggtctcagcccttgccacctggtcctcttcattggaaatccacaggtatatatatatatatatatatatatatatatatatatatatatttatttattttttgaaacagagtctctctctgtcgcccaggctggagtgcaatagtgtgatcttggctcactgcaagctctgcctcccaggttcatgccattctcctgcctcagcctcccgagtagctgggactacagaagcccaccaccacgcccggctaatttttttgtatttttagtagagacggggtttcactgtgttagccaggatggtctcaaatctcctgaccttgcgatccacccacctcggcctcccaaagtgctgggattacaggtgtgagccaccatgcccagcccagatacatatttatattcatgtaatgtgcttttgtttctgttcacactcatctcacttcttccctactggcagactgttccacaagtgtcaggaaatccactgcagctggagaccagatcactccatccacccacttccccccacttgacctggggctcagtggataccaagagacccaggcgtctgctgaaggaactggggacagagagcaccattgtcctaaataaaacacactccacacctggacagcactctccctgctccaagaatgagcccggaagcctcaggactgaagagaaaaacatcttgggggcagtgaagagagtgtgatgcagcgccggcactcccctcatcctcacggatttggggaaacataacaggtccaagacagacgcatgaggagagggcaggggtgtattccagttcagtccatctgcaccgctgacaggatcctgccatttgacccctcagggtcctgtttcaggggggtcccccagggctgctgcagccctaattgctccccttaccaagttcacgatgacagctccctgagacacccacaggccccgtggctactccatattccctggcacccaaccctggactcagtccagcacactgtgtcctattggtcaatttcctttttttttttttttttttttggaaaaaaacattgagattttaaaatttacacatcatcgaattcactcatttaaagcatgtaactcagtgctcccagccttttgggaggccgaggaggtcagatcgcttgagctcaggtgttcaagaccagcccaggcaacatggagaaaccccatctctacaaaaacataaaaattagccaggcatggtagtgtgtgcctgtaatcccagctacctggggggctgaggcgagagaatcacttcagctagggaggtcaaagctgcagtgagccacggttgtgccactgccctccagcctgggcaacaaagcaagatcctgtctcaaaaaaaaataaataaatacaataaataaaatgtataattcagtgggttttagtgagttcacagagtagggtatctatcaccacaatccatttttgagcatttgcaaaaaaaaaaaaaaaaaattaacctgtatcccttagccatcactcctcaagctcccccatcctctccctcagtctctccccaaccactaattattttctctatatataacttggccactttgaggcatttcatataaatggaatcacatgatgtatggtgagtcaattctctttcattctttttttcacttcttttgagaaaagctttgcagttgtccagatctcctctgtgcatggttctttaagttgcatgcctgaatcacttcaaaatatgagatgggaacacactggaacgactctggcttaacgtccacctcaaagcctattcactgtgttttcagctttcactgaggtcaaagatatttgaaaccattttgttttttgcaaaaccccacctgcaaacaccgtgtcgcatgaaaaaattcttcctagatgagagcaccaagaaaagtctgctttccaaatgaactgatattagacaaaagaattctgttattccatctttctcttcttgccctggctgccaggaagctcagagattaaaaaccggatgttaactgtacaaatgctctcttatgctacagttgggtcttagagactcctcatggttcaagcagagttttaccagcgtggcatgcagaagactcatttgggaaaacagctaaaaagacagattcctactgaatctgatatcctatagataaggtcttaaaatctgcaatttaaataacatgcctaaaaatgttctcagacctggctttaaagccaaagcaaaatgtcacagcccttttcctaggacttaaaagacattctggggaaaacaagcctcgttcctcctcttgtatcatcttcgtcctcacccagtgagcatccatgtgcatcatgtggctgtttccaggggctgcagtgaacagagcaaacgtgcccattccacgagaaagggctgtcattgctctaagatgatgagaccatctttggccgagatggaaggatttatagaaatgagcatgctgaacacaatcctgttccctggatgaataaactcaatccaagtcctcaaagggttccagcagtttccatgaatccacttcctcaacgtcaaacaccagagctttgcaaagctttaggacgttcttgccaccaggaatccctgctctggtaggagaggtttctttccccatttccctcactgggtaaccaggtcggaacagcaggtggaggcacaggaagaggagcagggaccccaggcggaggcacagggagaggagcagggaccccaggcggaggcacagggagaggagcagggaccccaggcggaggcacagggagaggagcagggaccccagggggaggcacagggagaggagcagggaccccaggtggaggcaaaggaagaggagcaggaaccgaaagacactgtgcccatttctacagcgttgcagggtgcaggactgctgctgccacccaggtaagtccagggggcttaagggctgaggttctttacagagaacaagcaaaggtggaaaaggagaatcttcccgggacagcagggactcctagcagctgaggggccaggcacagggaggctctcacaacagaggcagatatttcccacacggccagcagcctgcacagctgtgcctgccaacaactgtctggtattttgtgaggacgccaagattaccatactctttcgtccctctattctggaaaacacagtttgctccaacctttcactatcctaaatagtgccaagttggacatctttatgatcacagtttcactttactcttccctctggataaatccccaggggcaaggtttttaactcaaagtccattttcctgtaaaacagaggttcaaacaccacacagaggagagcgcagactctgtcctctgtgctctggaattgtttttaatcactgcacgagccatgtggggcattagacctaaatagcattgttgaactctgagggtctccttctgatgttccccacactcggaaactgactccctgtgggaaaaggtggtggccacacctgagcaccgggctgatcttccttctacaaacatgtcatctccctctctggctcttgccagcctgccgcctccatccacacagaggaacggcctttctgataagcaaactggactaatcatgtcttctattttctgtcttaggacgttttgacatctaggggagcctcgcagacactgggagagaccgccccttccagagctggctagttcccaaagacagtaagtggcttccttgggccatttaccatgcactcgcatgcacaagccaaccacccctttttcaactcctgttcacccagccaatatgaaccacccctgccctaacgcgccccaggaccaggtgccaggcaagcaaagacctcccctacagccccaggcctgctgcagtgactcacctggcctggccctgcctctctcacagaaacccccagaaagggtctggcctcagtttcctcccacctcctgcctcctgaccaaaccctggggcttcccctgtggccccagggctcatgccccctgctcttgggaaatgtaagccataaaaccttcttttgggaaatctttttgtcctcactcagccacctccatcagttaaaatcccgcagcacaaatgagacagacgcagcaaggaagacagtttccacgcaggtgaggaaccgcgtgctggctcccctctggacctcccagcaacaaaccagggctccccaggccctagagggacaccctcccttcttttccacccacagccgaaacacacacagctgggacttctttcttctgtagccaaaagacatcgtgatttagcgccatcagctttgcttgagaaaacgaccttccctaaccacacgtttccgaagaagtgtcatctctgctcagcctgctaggttgggagactaaaatgtgaagatgggtctggctcagggtcccactgctgtctcagcaagtctggccagaagctaactggagtcaggccaagggggcatcactgtcagacccttggcccacccaagtgcccacccacacatctgtcgcgtgccaccccgggctgccctgtcctctggggtggggtatcgcgcagttctgactgggacccatgcagctgtcctctcgtgcaattgctaagaaggtgaagtggggtcacaaaaggccattctagaccagcaggtgctcgatgggaggcctgggggtggccacagcctttcgttctggtctccaggtattgaaggccaccaagcatcccgccttccacacatcctcctctcggcagggagggagaacagaatagggctgcgtggcggtttcctcctggatcccacatacacagaggagctggctgtgctgcaggtacatggggctttcccttcagcggacagctccctccaccagccattctcccacagcccacacgctcacaccatcaggcaggcatgccccgatgtgcgatgtccttcatcaaaacccctcgtgatagtgcagcttaatgccatccgagtgctggaaagaaccacaggccccagctctcaccctggagccgcagcagggcccacgctctctctgagcctcggtgtccaccacagtctcagcaggggcagcaccaagtaacatctggtccccctgccccctgcgtctgtacttttgaggcctccctggctcccctcaccctgtctgaacacgccactctgtcatctcaaggctttgtgtctcccatgaagccttcagcaggttctgccctggtcacccctggctgcccatcagcagggctcaggtcccagaggcaccgagggagcttcagatggtgcctcctgccaagacaggccccctgagcgaacgtgaggtcaggcctgaaaagaaagcaaggaaggcctgctgaggatgtacctcctttcccaggcaggcacctgcagaaggccacagccccaactgttccccgaggaggtgtccccacatagccatccgtggcacagtggctcccactcagggccctgctaatgtcctcggacatccatctacacctctctccctgcacacactgcaggcgtgccagctcaggagctcaaacctctgcaaacacgattatttagcaaaacccagacatgacaccccagaagcggcacccccactctgtagtcagaccacaacctttttagggacaaggagtggagtcaggctcccgcagcacctaccaccaccttgggcacattgctgatgctcaaatcaaatctttcgaaccacaatgagacagcgcctcccccaccctccaggatgaagataaccaagaagagagatgggaacagaagcaggcaagggagtggagcaagtggagccctcatccgacgctggagaggaggtccaacggcgcagccactctctggaacatggtttgtccctcctccactgagggacacacgactccacacggcccagcagctccactcctaggaatctacccgagagaaacgaaatcgcgtccacacaaaagcctgtacaagaatgtccaagtgtgtaaaagccaaaaagtgggaacaacccaaatgtccagcatgtgataaacataatattggattaaaaagatgctgtatcatatggtgcagtatcactcagcctttaaaaggaaggaatcactgaatcatgctaaacgtggtcaagccttgaaaacatgatgctgagtgagaagatggacacaaaggtcatgtattatacgattccatttatatgaactgtcccagatgggcaaatccgtagagatgaaatggagatttgtggtcgccagggccggaggtgattggttagagggattcaggaggagggagtgacttctaatggtacaggttttgggggggaatataaaaaaagattactcttcacaaatgttaatattgatttgggtgatgactgcgccactctgaaaatacagccacgtgctgctgtcaacatttcagtcaaggagggactgtgtatgcaatggcggtcccataagattgcaatggagctgaaaactttttatcaccaagtgaggtcacagccccagggacgtcgtagctcaatgcattcctcacgcgtctgtgatgctgctggcctaaacagacctcctgcactgccaatctaattaaagtctagcacatacaattttgtaggtacatagtactcaataataagaaaaaactatgttactggtttatgcatttactatattttttagagtatatgccttctacttattaaaaaataaagaggctgggtgcagtggctcacgcctgcaatcccagcactttgggaggctgaggtgggaggattagctgaggtcaggagtttgagaccagtctggccaacatggtgaaaccccgtctctaccaaaaatacaaaattagccaggcatggtggtgcatgcctctaagtcccagctacttgggaggctgaggcagaagaatcgcttgaacccggggggtagaagatgaagtgagtcaagatcgtgccattgcactccagcctgggtgacaagagcaaaactccgtctcaaaataaaataagagagtaaactaggggccaggtgcagtggctcatgcctgtaatcccagcacttcgggatgccaaggcaggtggatcacttgaggtgaggagtttgagaccagcctggccaacatggagaaaccccacctctactaataaatacaaaaattaattgggcacggtggcgcgcctgtaatcccagctacctgggaggctgaggctgagaatcacatgatccctggaagtggaggctgcagtgagccgagatcatgccactgcactccagcctgggcaacagagcaagactccgtctcaaaaaaaaaaaagtaaactgtaaaacagcctcaggcaggtcttccagatgttctagaggaaggcactgtaatcacaggagatgccagctccacgcatgttactgcccctgaagaccttccagtgggacgagatgcagaggtgaaagacaatggtattgaatatcctgaccccgcgtaggccaaggctaacgtgtggatttgtgtcttagtttttaacaaaaaaattaaaaagtaaaaaagtctttgaatagaaaaaggcttatggaataaggatatatggaaacaaaatgtttgtatagctgacaatgtgtgttttaagctaagtattactgcaaaagagtcaagaggttttttgtttgttttttgagacagagtctcgctctgtcgcccaggctggagtgcagtggcgcgttcttggctcactgccaactctgcctcctgggttcacaccattatcctgcctcagcctcctgagtagctgggactacaggcacccgccaccacgcccggctaattttttgtatttttagaagaaagagggtttcaccgtgttagccaggatggtctcgatctccttaccttgtgattcgcctccttaccttgtgattagccttccaaagtgctggcattacaggcatgagccaccatgcccggccaagaggtatttttttaaaaaaattaaaagtttataaaataaaaaagttacagtaagctaaagtcaatttattattgaagaaattcttctaattttctttttcttttttttttttttttttttgagatggagttttgctcttcttgcccacgctggagtgcaatggtgcaaccttgcctcaccgcaacctgcgcctcccaggttcaagcgattctcctgcctcagcctccaagtagctgggactacaggtatgtgccaccacgcccagctaattttgtatgtttcgtagagacggggtttctccttgttggtcaggctggtctcaaactcccgacatcaggtgatccacccgcctcagcctcccaaagtgctggaattacaggtgtgagcccccgggaccgggctgttctatttttaaattgaatctgtggtgcccagggatgagcagcgtgagggcagggtatggaaccttcatcgctaccttctcaccacccagctgtccacatcagcacagaacacctacacacccaatctccatcaactccaaggtctctcgatgggaaagactcacgtgaaaatccaatgacccctgaaccagacacaagttgcagtggcagcataaacagcactgggcgtaactaactgggaaggaagccccagacttgctgtcctgccactcaacccagcctcgttcttccagcactgctggagactgtgcctgaatgcctccctcttctgcagcccccagcaggaaggagtcccaagcagccttctctgtagggcacccagagagagtggcatctgtgcaccccacaggtggtcagcatcctacacagacatcgcagaagaatgtaacggagcttacccaaggctctgtgggcaagcttcagaccacgaggacaccatcacgtgcaatgtcccacataccagcatttagagaagccagatgaggagagagcatttctcagaatcacatcagagaaaagtggcatggttctaggcaatgcgctgagatcatttagaacaaggcccacaaaattttctgtaaaagtccagctggtaactactctcaactttgcagagcatgcagtctgtcacaacgattcaactctgccacacacaacgtggaaagagatgagcacggctgggtgccaataaaactttattcacaaaagagaacccagattgtcaggaaatatcacaaattacacatctgaccagggattagcatctagcatatatcaagaactcatacaatccaacaactcaaaaataggcaaagaacttgaatagacatttttctgaagatattcaaataaccaataagctcataaaaacatgctccacatcactaatcaataggaaaatgcaaaccaaaaccacaatgaaataccacatcaacaccccctagaatggctattttaaaaaacaaaaacaaaaaaaacaaacaggccaggtgtgatggctcacacctgtaatcccagccctttgggaggctgaggtgggcagatcagctgaggtcaccagttcaatattagcctgggcaacatggtaaaatcccgtctctactaaacaaataaaataaaataattagccaggcatggtggtgggtgcctgtaatctcagctactcgggaggctgaggtaggagaatcacttgagcccaggaggcagaggttacagtgagctgagatcacaccattgcactccagcctgggcaacagagcgagactccatctcaaaaaataattaaattaaattaaaaatttacaaaaacaaaaacaggccaggtgtggtggctcacacctgtaattctagcacttggggaagctgaggtgggtcaattgcttgagctcaggagttcaagaccagcctggacaacatagtgagacccccccacccatctctacaaaaaaatttaaaaattagccaggcatgatggcacatgcctgtggtcccaactactcaggaggccgagatggaaaggaggattgcttgggcctgggaggccgacgctgcagtaagccttactgtgccactgcaatccagcctgggtgacagagtgagacccagtctcaaaacagaaacaaacaaacaaacaaacaaacaaaacaaaatacgagtgttggcaaggatgtgggaaattggaacctttgagccttgctggtgggaatgtaaaatagtataaccgctgtggaaaacagtacggcagtttctccaaaaactaaacataaaaaaccatatgaacctgccattccatttctgggggtaggtatatgcctgaaagaacgggtggatatcttgaggagatatatccgcacacctatgttcacagaacactattcacaacagccaaaaggttggagcaacccagtgtccaccactggatgaacgcataaacaaggtgtggtccattcacagaaggagtatttcttaggcttaaaaagaaatgaagttccaatacatgctacaatgtggatgaccctggaggacattacgttaagtgaaagaagtcaggcacaaaatctcacatgaccccactcccatgaggttcctagagtggggaaatccatggagacagaaagttgaataggggttgtcaggggctggggaagaggaatggggagggagggttcaatgcggacagagtttcagtttggaaagacgaaaaagttctggagacggttggtggcgatggttgcacagccacataaatgtgcttaatgccactgaatggcacactttaaaaatcgtgaagatgggccaggcacggtggctcacgcctataatcccagcactttgggaggctgaggcaggtggatcacttgaggtcaggagttcaagaccagcctggccaacatggtgaaaccctgtctctactaaaaatacaaaaattagccgggcttggtggcaggcgcctgtagtcccagctacacaggaggctgaggcaggagaatcgcttgagcccgggaggcggaggttgcagtgagccgagatcatgccactgcactccagcctgggcaacacagtgagtgagactccatctcaaaaaaaaaaaaaaaagatgaagatggtaaattctgtattatgtgtatcttgctaagactttaaaaataaaaacaaaatttcatttacaaaaacaaggaatgagcaggattggaccctcacaccacagtctgccagcttctggttgggcacaaggcagtgggtgcccagcaggagacggtggccggagcgcaggtgcagaggacagggtcctcaccccagtccttccctggcaaatgccgcttgatcccctgtttccccacccaggagggtgctctggagcatatcctcttgggtcatgtcattaatcattagggggtgcctgattacacccacaagtggaaaatataatttgagacaatagcaaagaacacctcaggaaaaaccacatcttcaaattcatctaatctagtgtcttcaacagtcaatgagaattgcaacattgtcaattaattccgttactcctaagtggaacccttctgccactaattatgcgataccctggctgctcactaaattacccctcgagggcaattttccagtttttttctgagcagcaaggggaggtgatcggtagacaaggttagaaacccaggatgtctgcaggtgcctaggcgctgggagtctccactgtaaaatgacgctgcagccatggcacgggggcgtgaggtgcccacaagacaatgttcatgatcaatgaatgggggtctgaggacattgggagagccactgaggagtagggtcccttggtggctcctgttagggcggaactgggacacctgaggaagcaggagaagccgctggagggtgaagcgcccaggtgagcatggccgggttggtgattctggctcacccttccctgcaccaggaccagcaccgcctgggcttcccagatcatcgacatccccaagaggaaaaccccacccaccccaccccatccagcaccaccatcctgcctccagccgaggggactgatcttcccagaaagcagcacagctcccctgtcccaaggtcaccaactgtgtgggctgaaagtgccctggccagaaaaacaaaactaaaacaaattcactcccagccttcgtgagttgcccagacaagtttttccttctctccttcccattaatcgcagccgccagggttgcagggttgcagggctgctgctctggaagcaagcgctccccatcacttgtgagccaacggcagctcccgagtgacaagcaaaggctcaacccaacagcctgagtgttcctttcttacgaagctcccagaggagctaagaagggagtttcagggagacaggtcccagctgtgaaccgaggcccagctggccggacgcaggcgccttccaaaggcagaagcgcatgcacgccatggttgttagctctgccccagccccgggagagagaatgaataaatagcaagccccaagtccaagctccgaggaagccaaaggcagctgactgctgacaacatcttatggctcaaccccgagcctgcagggacacgtgctccttcctgggtggacagggactaatgtccttccctctctcagtctgctcctgctctaggataaaggggtggaccaccttctccagcagggtcacacgttctcatatgcatccttgtgacacctttcgaggaggaactgtgtactgggccagtgcttctgcacaagggacaagtatgcagcatcggccacagacgagggggactgtggaggatacagacccagccctcagccaagacagccagggaaggcaggagcaccctccacggagccgtgtcaccatccctccatctgggaggacacttgtccacatctgggaggtgagtgacagcagaggctagagagggagctcagagatttggagggacatgcaggtgcagagaagggcttgaacatggggagggagagagtccgactgcatttcagacgggattggtgagctgtagagctggagacaggaaaaccaggcaggtgaggccgcccaactgcgatggtggccaggaccagggtagtcctgcatggggccgtgactccgacattctgctcctgcctgccgcgtttaggaccccagggtgtgcattctcatggggtggtggaaggtgaagcagagataaacgatcagcacagcaacagccttccatatgcgtggcttcagttaccctgaactcaaccaaccatgcgcacattggaaatattttttagttgcatctgtaccgaacatgtacagacatttttcttgtcattattccctaaacaatacagtatagcaaacatttacatatcatttacattgtttaggtatcatacacaatctggagatgttttaaagtatatgagagaaagtacttaggttatatgaaaatactgcaccatattaaatcagggacttgagcatccatggacttttgtattcatgggaggtccaggaaccaatcccctttggatgccgagggatgactgtacggcccttccacagtattaagatctcatggtgcacacaattaggaaagtatatctgacgcagcttcttgggcaggcccgtgcagctgagaggcccttccctgcacggggcaccaccaggtacacccccatccacgtgaaaatgacggagaggaactggaagcgcctgcaccactcatctgtctgcagccacactgtctgggtctggcatgggcacgttggtgaggatagctcagaaggattgagaaattgcccacagggctctggaccacacagatctgtctttatggtccctggtatacaaggccatgccaggaggcaagggtcctataccagcaggagcccagtgtgtggtcaagccaagctggattcagccactcaatacccacgtgaccgtgaccaagtatctaactgctgagagcctgtgtcctcactgaaaatggtggtaattccactttctgcatggagctggtggtagtcagcgtcaacgttgataagatacttggcagacggggcctttaagcacattacaggtgaggtgataccagcaaggcacagaggaggcgctcaagaatagagccactgagcaccagcccacgatctgccctcttcagagcacacagacctgggcttcactgcacccttccctgcacgtgggcatcacgaggcgcacccccgttcatgtgaaaatgacggagaggagctggaagcacctgcaccactcatctgtctgcagccaccctgactgggtctagcctgggcacactggtgaggacagctcagagcacggtccagtagccagaggcatagtccctttcatatctcgcaaggtcacacaagcgggccaccaaggacaatgccatccaccctcttcccacccaaacacaagcacagggcacacagggcctgacaacaagaaacttaaagtccctggccacagtgcaaaggtggggaggtggaccaaacccagacagtggccactggcttgcaggtaacaaggacaggggaaaatgttataactcaccagaggtgttgggagactgagcctcacagatggcctcttagagcaggaactgtctgtattctagag

SEQ ID NO: 2397 - DNA, 193964 bp, Homo sapiens
ttcaatttactttttatttttaacttaaacgactgtgtattttccacagtcttatgatgagaaaggctccagaatcacgtgtaggtgtcctcaacatttcatagctcgaaccgtcctttctttacgttgtgcattgatatgggcttctcagttcagaaaacaaggcactataactattttatcagctacattaatacattgaagatatatttatcctttcatgaaagatacagcatttgaatacaatatggttttatgcagatcaggttcaaaacacccaaggcacacactttattttttttcctttttttttttcttttctgtgtttatttgaaggctcgtattaaaatttcaaaattggcatgaacaaagagttccagagtggaatcaatggacagggattgttgtaattttgaacataaaacggtaaagactgtggaatgtagaacaagttacaggaacgataaacaaaatcaccaatacagcatggattagaaatcaaagtgatgagatctgcggaagtctgagaaacaagtttggaaattctctgattccccacaaagcacgggcagtcctgtctgcatgcagctgctgtggtcacccagccactgtggaatgttcacctacttgcatgggttcatggttgtctacaaatacagaaacacattccagttcgccagttattaaaatgcctccaatttcaagtaaaagaaaaaatcttccaataattttcctagtaaggtaaacgaatatattcatctaggaaaagtggtctggaagaaaccattggaagcaaagtctaggggggtgccaaggtttgggagaaactattggatggtgaagcgggagagcttgagggtgaactacaaaagatatgaggactggaatttttcctgaacgtggaagcatagaggctgctgctcaactggggaatgtgccaaagtagaagaaactttaggaactaaagacaacaagttttcactggtgaggccaaagaagaagttcaacgtttaggtttaaaatatgcttccctaaagcggagggatggcccatgtcttcctggcttagttctttgccaatagacacaaattctctcttgctccaagccttagcatgtggtttgcttgtcaaccagagaggcggcccagttctgccactcccttggccttatggctagaagacaccctgctggggtgtggggagactggaccctaagggaagggtccggatctggctggccctccgcggcaccgctgcttccacccagaacaaaaggaaaagccgagcctcagctccacgcctatagcagcggtcacagaagcagattttgacgttttgcataattctgaaataacatgcacgtatccattgataaattgagaataaggaaatggaaccaaggcagattagctcagtgacaggagcctgtttactcgatgagagagatttttctggtcagttttagagaggcagagctggccacaatgcctgagataatctacattagattgcaagtcgggcagctttttgtttaattcagacagtgttcactgtttgtttgcaatcagaaccacaaccttagtgcaatagtatatttatttttttacagtaattttggttgccatacaagagatttaaggattgggagaaagtgcaaattacaggagcttttttttttttttataaagtctaaaaagaataaaagcacaaaagtaacagcaacatagataatgcgaacacgtgttgttacacaaactatagtgtgaaacatattagtatttaaaaaacaaaaaaaaattgttaatgggaaaatcaatattgtggcccacacacaaaaagtcattgccagatcaactggataatgcttgcttgttcaataactgagaaaaaaatttaccattttattaactaaagtatcacaaataattcactttgtgatatgtaaagttcagcaaatcaacagtcacattgagtaatttttatattatgtgaattaacttaaaatgtgcgcagacaccctggaaaaggtatcttggcaggtatacataatttacattttgagagatttgggttttgtatacacaatattacagaaactaggcatgtaaatgcagtttatttaaattacagtatgtaacaaaagttgatcttaaaacctggaataatatcaacatgatctttagatgagcagtttaacatttgttccaccattaaagaggggcatggaatagggcctcgtcctaacatgtcccaaagggggagaacagtgggtggtgatttgaatgaggaactattgctttcagtaccaaaataagcagatagagatagagaccgattcatcttggcaacatgtgtttatttgttggtcagtgcaggttctgataggtctattacttctctataataagacagtgtaaaaataaactatgttatcagctctttagtcttgcagccagcttgcttgtggttagtggcatgtggcttggagtatctttaagaaagggaataacatctggccctcaccaactggctgccaaagttcaacaaaccgaagtcacgagtttcgactggttatcgtctgccagcggtttccttgactctcctttgagctagtgttttgcctggcactgagcacagaggtaataccaactgtaggcccagggaaagtgccatgccaaaggaatggactcacggaattttgcggtatcatcaaatggaagacaaattaatggccaaaccaccatttttacattttctaaaatatggggcagcctcagcaggccacctgtagtatcctgtcttgaaatttatctagagtaatgctcattcatctcatgatggaaaaactgaaagcacacggaagtaaagcgccttaatattcaattgacttcaagttggattggatcatttcaaatacaaagattgacctgcaaaaggttttggaacagaaggtccaaaaacttggttccaacatcaggggtgtgtgactggaaaagcgcgtgtgtgtggtgtgtgttttgtttttgtttttggagaaactgctgcattatgaattgtaaccactttgaagaaattgtccttcaatgacgaagttctagcaaagatagaaaatataacacagctctgctggttcagatgcatccaaataaggttgatttaaaaaggtcatacttttataattattccacagaaatagtattattaaatcacaaaagtttttttttctttaactttctagcactgaagtggcacaaaggctgcctagtagaccagccacttttttttcttaaaatattgtgcttataaactatctgtacaactatttaaacttgcagtaaagaaagattttaaattgctaaattttatgtgttcattctagagctgttccagacctaatcaagaaaaaaaggaaaaaaaaaaaacaaaaccatgttttataattagagatgggctgagctagttctgaaataataataaaaccaaaaacctgacattcgagtatcctccaaatgggggagaatgtgctggaagcctgactgtgtgttttgcggcccatgtgcatctggtgacctcttttggaaattcgaggtattgttatggggtggagggactccggggaaagaaaggggcggggctcaagaaagccttgccagagaggctgacctggcagcccaggagacctccctgctttcctctcctcacgcctctgctttcactctgatcctgccgcccaccttctgttctcaaccctgggttctgtctatactccatacccactgggtcctcaaagaagctgttgtactgttaagacaagctggtgggattcctagacacccagagcgataggggaaaagcctctaagtaccatcttccctggcctccgagagcaaaaggactgtctcagcagagatgctcacccttggctgggcacagaactgaggatgctgtgcccgcccagctcccagaggagacgctgtctcactggcagccgcatgtgcccgccatgagccatgcgtcttcttgtccttcatgtcaaagtggatgctcacctgctctgatctttgcagagctcaagacatcttcaattaaaaagaattctgagaggcagagaagcccttattctccatcctggatgggtgctcatggcagacaactgctcttgtcctggagacctggagcttgggcagttgcacgctggctggctcccttggccaggtctcccctccattgtggaatcgtgactttgtgctttgactaactccatgtgacatctgcttggccaccttggaattatgctaacagatttgcagaaataaagaaagctaagcaaagctgggcacgatcccatccaaactcccagcactgccaggaacctcatggccaaagagccatggatgcaaaccacaggaggagatggggaaaagaatctgtgtaggaaaaagtttctctgcctttcaggcccatgatggggcactggacaaatgcatctgggagcatctcactgcaagccaagtgcaggagaaagaggggcaggtgagcatcaggtgtcctctgagaggccacaggactgaggaaaggcctcatgccggggcctggggtggtgagagctgcccggaaagcagaggacggaggtctcaggaggtatctagagtgcactggtgtctgcctacaagagctaggatcccgtgcaaaattgacggggagcctctcggacccggcaaagcgaggccacctgcatgctgggcggcaggctgagaatctttttccatgttagaaaaactccctccccttgtcccatgtgtgatagaaactgcccaagacacccacatggtgagccaggggtctgaagacccagccatgttgtggacacaactcagtatttctttgggtaccaggagacaaacccatggagtggggttgatgctcacagacttcgcttggcattcagatgtttcagcacgagcccatctctacttataacaagagcagtctgcgaggtggagagcagccgtccttatctgtccagcagctgtttcaaagccctttctatgttcattctgtgcccgactcgagttaccccaagatcgatgaggtcctccttctgcaggtttggtaagtgactgccatcgatctcattgtccatgaaggcctctttatgttcacccaagtttagactttccagccaatcggccacatctggtttagtccacaggtggacaggtttagttgtaaaaggcttatttgagattggctgttgcagtatcgagggggatggcgacctactgcgtcccgctgggttcaagccaaatagatccccagaagggggctggcttggaaggctaaagacatctgagagagcgggagaaggagaggcggtggcagcagacaggggggcgggcagggtctctttgttcatctctgttggcgagaccacagggcttggggcacgtcttgttcctgaggtcctgctttcatagtcggggggccggctctgcagggtgatgggctgggaggtgccggggcgaacagtgaaggtgaccgtcgtgctccgtgtacctgagatggtgctcatgatctccgggcttctgaaacagcaacacagagaaaaccatcacaaggcaggtcaccgagtcagggcagctggctgcagatcacccaggaaggcgagggagacgcccaaaccatgccagagtgtctagtggcagatccactggcagtgaacgaatgatttgccatgccagggtgggggagggggagaaaggggccagagcaaagttggagacaccagagcacaccacgtcagcccactcacctgaactgggacagaggggctgggggacctgcctgtgctggggggagcacaccacgtcagcccactcacctgaactgggacagaggggctgggggacctgcctgtgctggggggcagggccgggggaccctcgggagggtggccactgaggcatttggaaggggtcccttgaagagggcacggagacagggacagagtggggtcctgtcacctgggtagaacgtgccaggcaacatctccagcgcctcagcttcagcaggtgggaaggagcacacctggaggacaggcccctcagccgcctggcagccttaggctttttgggtaaatggacaagagcagggcaggatccttcccaggtggcccctttcagtaactggaacccctgtagctacgcagggcactcaggggttgagatcacccggaaacccagacagcagggcgtggcttgtgtggccagtgtgggctgcgctcaccttcctgaggcagcactgtccagcgcccacccagtggacagttttgttgcagaaggagctggggtaccctgtgttatttttagcccctttcatgtgagaggctcactggtaggacacacgggccttactgaaaagcagaacgcgtgaggagccctgtcttccccagggtggccatgggcgtccccgagggtcccctgtgccttgccgctctggctgggcaggcaaagccctcagagctcaagtcagggaggacgacccttctagctccaacctttactggccccagggtggtggccagatgactcccacaggcaggaggtcccatctcagtgccagagaagtccaagtcctcacgcttacccacgtggaggtggcctttcacacaccactccctcacgggctctggccaaggcctgtggcaggcactctccacaccaagagaactgccactctgggccctagtgcatgttttgctgtccccacactgaaagcccattcatcctattgtccctaggaaagccacagccactggggaggggaggagaggtgtgggtctcttgccttttgggcccattcacgtggatatgaacggcccacccaccgcttctgaaaagatccatcctaccacggctctctcttcaagacctggacttgagagatgtctgctggagccctggctctgtcagatgccagcttgggtgcacttttctcctgtctccacatcttcccacatgaagtgggctcctctccctcctatgtggtgggttaccctgggtggaggggctctggagagcatgaggagtgcactggtgtgacatcgtgaccgtgaatggtggtgggctgcagtgtctcagtgaaagggtcatgggcaagagggggagagctgcaaacagtagagatgctgccgtgtggggagactccctggagggcaagactgaagcccctgcccgtctgctgggggccagttcatcgacttgcactggggctgtctttggagctcaatggctgaccagttagagcagcacttcccaaagaggagcccacagacccttcatagaaaccacctgggacactggtgggccgtgaggactcctgagctcgtctcaaacctgtggaagcaggagtgctgtgcatggggaccaggtgtctgcaattaacaaactccccagacactgagagaccctgaaccttagaggccatttggttgggccttggttttcattccagggtatgcacaaagctaatggcccagaaccctccaggagctaaaagcaaagggagtgacctggagacgggccccgctgctggtctagtctgtctctctccgtttttttcttttctctttctttaccatggatgtatatttgggtgaaaccacccatcagttacctaggttcccctaagctgtgggtcagtttcctacttgatgttagtcactgttgcttaaagtgtggactagtccatagtgagaaaggaggggcaaatctgaaaggggcctgtgctgtggactgaggcttcaatcctactgtgagaagtgtttgcaggggctggtgggtgcactgctgggccagggaccccatccacccatagggtgttcacgtgctattttccagagggctgggtgcccctgagtgggagatgttacaaaccaggcatccccatctagaacctgcccccaccctcaatggtggcttgctggtcattggttatactgctcacaccaacaggcacaaggcaggtgagactctgaggattcctccactgtttctgggcccagttactcacaatcaagaaatcagaggctgcacacggtggctcacgcctgtaatcccagcactttgggaggcctaggtgggtgaatcatttgaggtcaggggttcgagaccagcctggtcaatatggtgaaaccccatctctactaaaaattaaaaaaaaaaaaattagctgagtgtggtggtgggcgcctgtaatcccagctactgggaggctgaggcaggagaattgcttgaacccaggaggcggaggttgcagtgagctgagatcgtgccactgcactccagcctgggcgactgagctagacttcttctcaaaaacaacaacaacaacaataaaaaaacccccaaaaaacccgaaatcaaatcagagcccagtggggcttcacagcaggggagaggggccagcaccctctagtatctcagtttatactctcaagagagaggtggcctatggacataggatacacgaaaaaacctgcaacccccccttctctggtactcaaagaaggtcgaaagaccagctccagttccaacttaaaactgggggtgctgtggcctgttcttctgtgtttattccagagtcacaagagcacagttttggggaaggcttatttgtccacgttgataaaacaattaagccaagatgattgaaatcaaataatgggtaagttgaaagccactgcattcagaggtgatttggggtgttaattagggccaaggaccttggggcacagggaatgtttcctataaaatgggaaaacatcttacaagaagacatatgcccacagaggactagaggaggaggggtagctggggtaaagttctggtctccatgtgcttttgctaaagctgactacatggtgactgtgcctgcagccctgactctgggcagctccaccgtggcagcatgactggtgcctggccttggtgctcaccaggcctgtgaagcagaggcaagtaaagccccagagtgagagcacctacctcacgcctgggcagtattcaccacgggtatctctggcccagagggttgccccagtgctgccctcactgggaaaatacccagctgttcccaggtagttgggattgattttggtttttgtaaggaaaggctctgcaggcagctgtgtgtgtggttaggaagcgaagaggaggctctgcaaacacctcggtgggcagcgggagcgcgagagtggcacacacggggtcacgcagcagcacagcaggtggcacttacttctgttcagcacgaccctcttctgttaacaccggtcatgggagcaaatgaaaatgacaaatggaatgacttgagacaacactgcaaaaattaatgaacaagaaaggaagaaacagaaaaaagctgcttttcgacagatgaaatgaaggcagtggggcagaccctggctgaaagcccatccgtggtggtcccttcggcctgccacagcctgcccagagctgaaacatcaatatggcatcactttcatagggagcgtgggaaactcacaagcttgtcttctccttctttggcttgggataatgtaaccacttgtaaagaagaaaaataaccaggaaaaaagaaagaaaatagtagcattggagtgaagttcgcctctgcctgaagcccactgagaagcagcttattgccaatttcctacctcaggtgcctgaactgtctttcctgtggcttagggaggataaacgaacattcctggtgggggagggcaccccaacaggacaagtgctttgcttcaagtctacatcatgagatgacagcccagccgttaatcacatgggcgtcaagtgcttggggcctgccagtgtcctgccccacattgctatagaaagtaaccgcctgtgagtgtgagacgcagggtgaaggccaccctgggctgcccgccctgccctcctcagcagcttgactctcttggttaatcacattgatgatattcactggatcttcccggttgcacagatggttacgttgctaagcaaccgctgggttcccagtcggaacacacaggaatctgctgccctgatttagaacacagacacatatacacactcacacccaactccccaccaggtcaccactgtctaccctgccttttaaatcacattcatgtagaaatgtgagaattaaaaaaaatcaaggtaattgagacactcagagaggtgctcttatttcatcagtcagtacaagttaattggggtgaggtaagtaaagaagcaagtggcttttttactgtttacaaattcaatttggcttttttttttttggagacggggtcatgcagcaatcatagctcactgcagcctcaacctcctcaagtgatcctcctgcatcagcctctggcatagctagagtaatctgctctttaactgtagctgaacatgggccaggggctggtcagtgatgctgattaggcatgctggttctgtccctcccatgagccgcctgtcaagggcctgctgggcctggccagcactgaggctggacttggagcctgtcaacatatgttctctccagcacaccgcacgcctctgcattttagtgatgagcccccatcttgcatgaaaatagcacttatttccaaactgctttcttattttttccatctttacagcctcctgataagcagggcattgaaaagatagaaccggaggcagcaagtccttacctagcttccccgaggcctggatgtggggactggagcccatattgcccagctgtgccatgtgttatgttgtgtctcagcagctgccaggcctccgcctcacccccagctctgagtgccatgagggggtcctggtctagttttagtccttgaggtctggcccagaacaggggtgcgataaataattgttgactgaagtgttgatggataatatatccttttcccagatcagaaagttaagtgacttgaccgagttacagagccagacctgggagtggggcaggcagcctgaggctccgcggcagttccaccaggaatccaggtcttcaggccaggaggttcgcagctaagatcaagaaggtgcccacctcttgggaagagagattaaccctgtgatatgcttttgccaaaagggcctcatgtccaaaatggggaggaagattctgacttgagatttgcctgttgatgggcaaggacgaggcactcccattcatccttgcccaacgcccgcaagtaccagccccgatggacgcacatcctgactagtgctcccagccacccacagtcgcattcactgatgtcacattcacttttccatcagggcctggaaaccctcaaaccacctagtggtcctgagatgctgaaaacaccgtgaggcagcttctagtaccaagtcagttttgaagcagtctgtgctctgggaccagctgggcagagataactttttaacaacccaaagttatttgaaaatcaagaggctgtcaggataatactgcagagagcccagtagggactggaggccttgggaaggggaggcaggtaccgtgaggcagcaggcgcaggggcctcgggaggaaaactcgcctgagctcacatcccaggtagcctgaactccctcaggggcctctgggacctggagtttcacaggacaaatctccctgaagcccatccatcccatggggaagcgaaggccaatctcgaggtcccttctggaccccacccactgcaaagggctggcgacctagaggggactctggggaactcttataggccatgcaccctaacagaagccatgggggacccccacaagcacacactcactgctctgttgcccccacatacagagcaaatgtgaagctgacctctgccatggaagcgatggtaaagaacatcagatttatctggctttactatcggcgcctggtatgtgtcagtatctctcaataaagctggagggcacatgacacctggggctcctgggtcatagcaagtttgttttgggtcaaagcatataagtcaggcaagctgctgtgttctcctgggttccttaggcacttagcccttgagtctccctgcttgtctccagaatgcaggccctacactcccacagcagcctccctgtgccaccagtgcattcacctgatcacacagctgcctgggccatcttcaggaaacaaagtctggtcatgccaagactttgctgaagccctctgaaggcagccatatctggaactccattcagctcatgcccattacctgcaagcctcttgtgacctggccctgcccagccctcctcatctggccatggtttcatgagcacagaaggcactttctggcctcagggccttgtactctctgtcccgtgcctgggatgctccactcctggttttctgcaaggttggctcctttttaaatttctggtcattcaaatgtcatttccttgcagagtgtcagtccctttctgcacatgctcactgtaacctgctagggcatcctagtccgccctttctgcatgtggtcagggttaacctgctggtgtcccgtggctctcttctgcacgtggttatttttacctgctggtgcatcacagcccctttctgcactggtcactaacctattagcatgttgtggctcctttgtggcatttgtcacagtttgggtttgtcttattatttgttgtccatttctcccctcgagaatttgagctccccaaagggaggggcatctggaatgttttcttgttcagtgataaatcctgggcacagcatggcacctggcacataaaggcaatccctaactttgttgagtgaatgattagtgacggaattgctgccccattctgagggtccaggcatccttgttggtgtattcctcgttactctctagcctcagcctggcactaggcttatagaaagtagctcagtgaactcctgactggtgaattcaggagacagtggggctgggccatgattccaagtctgagtgtccagtcagtctcctaggcctgcacctgaggagcttccggctctgagcttttgcagccccaggctcctgtgctgggacccccagcgtgcagcactgtcaggcctctgggctggcagctgttgtcttggcattctgctgaggagggaccactgactcttcacagagacacactcactcttccttccccaaaccagtttccttcactttgatccagtttgagatcaaagatgagactacctcctggaataatcaggccaggtggtcctggaacacttttcttagaactgacgcctccattcttggcagggtgttttcagatcaccctgggagatgcctctaatatgatgtacttttttctcttttaacattatgtactaaagagaactacttcatcatcttcctttcgtcggcgtatttgtaattaagacgcctgcaaattccatgtcatccttgatttcagggaagagctttgagcatcagagactcattcacggctaaagttaaatcaaacatacccaaggaaaacaaggatctagttgtttaatcttcagctgcttcctttgatcccatcctggattcttgcaagaagtgaaaagaaaggaagaatccaaggatgagaggaactttaaaagggtcaagttcagctgaggtttctgcccatttcatgaatgaacatttgaggaacagctctaaaaattgtccctttcttgggcagtcaaaacttgtttctatggaaatgggatttttacaccactgcttatctgtcatttcaaaaagcatggctggttttcaattttccctagaaaaactcatttctttttcctcggtaggaattcccttcatccaatttcgtgcctcattttgcccagggccattcacagctcttaatttttagatgcatttaaaggtggtggtgagtcgcccaggcggtgaactcaggtgagagttcttaaggctccctctgatcctcagatgatcaaatgcccagggcccatcagtgaagaccacgcccagcaaaggagacatgctgagagataggtctgtggctgagaggagacagccctcacggcaagggggacagctctggtgccctggcaactccgtcctggacccccccccagtggtggttctgactgccccccacttgtccttgtcagtgtgtcccgtggccgtggcgcacctccatgggggctttgtcccaagtgctcagcctggtgaggttattagatccgagaagcaagggcgagggagaggattgagcctagtttagtgcctacagtgaatgctcttcatctttgtcctctggcctcaggccatcctgtttctagtccaactctgagtgtaaagtgtaacccttggccgggagcaagaagggaacagacatggcctctgggagcttggcagtgccagtgaacccctagtgactaagcctgctgttatcggccgcagggtgacctcctagtgactaagcctgctattagcctcttgctgaccaaagagcttggcctaaggacagtcagaggcctgagagcagccccgcccgcggcagtctcagccttgcaggtgttcggtttgccagttggtcattccttccaaggcagtccctggctcccacaaggtgaggagtcaaaccctgagccagctccatgggttggaggtctagttccgcgtcttcctgtgaagtagcctcggctcagtagcttcaccgccctgccttctgcttccttgttcacacagtgggaaaaattacaggccctggctcaggggtgccgtggaatgtagtgcctggcgtttggtgaatgctttgtgtcataggtgtgggctcctgttcttactgtaagagagccgggctataaataacaggacagctgggaggcggccgttcttggcactcacgcgtgggtcggcggtggtatgcagctgctctccttcagagtacagcaggattctgccctatgaagtctgctttgagccagccccctctcagggtccccctggagaaatgcagggcagagaaaccctagagacgctgcaagttggggtcccactcccctgtgggcaccccaggagctggcccagcctgaagacgagtagaggggatgagctgtccagctgccactcagggagaggtctccatggacggggtccctggactccccgagtggagtgctcaggggagcacagcttggtgcaggatgccctgctgacctgaacagtggattccttcctccagccctagagccattcccttccagctccttccttactgcagacattgcttacaaggggaagtgagagtcaggaaaccccagcctgtgtcccagctctgcctcctgctggctgtgtatgtggacaagccacttatcctctgaaaaatgggtgtgactcatacctgctccccagttgtcataaaaattacccacccatgagaaagtgttttgtaaaaatgtgaaacactaagataaggcctctttaattattgcttccacatagagtaatgacggaagagccacattagtatgtaatggggaagggttaaactagtcagtttttcagatttttggcccagtgcagtgactcatgcctgcaatcccagcactttgggaggctgaggtgagtggttcgtttgagcccaggagttcgagaccagcctgggacacatggtgagacctcatctctaccaaaaaaaaaaaaaaaaaaaaaaaaaatagctgggtgtggtggcatgcgtctattgtcctagctactcaggaggctaggtgaggtgtgaggattgcttaagcccaggaggtctaggctgcaaggctgcaatgagccgtgatcacgtcacagcactccagcctgagcggcaaagcaacaccctttctcaaaattcctggaggctgttgagtgtacttgtaggtgtatacgtacataattcttagactttctccttgactggaggcactgtctgaatgtctgcagtgtaactgtgcttctctataccaatgccagcctatcgatactcctttagagtaatagatgacatccaagtcatttatttacatccacactgaaaaataactgggaaaattggggctctcagtctgcatcttgagccccagctgtatgtgatgtcactgattaatgcactgagtggcttaaatcaaatgcctgcccagcaggggtatggagagaggcttcattagtcaaaatgatgaaacccaagatcaaatatcagtgggagagactgaagatgctgccacctggggaacagcaaaatggtgcacaccacagggaaggagaaccaagaaccataagccatcacgggagccaatggggctccccaaagccacagactgctgagccctgatacggtttggatctgtgttcccacccaaatctcatatgtgaaattgtagtctccagtgttggaggaggtgcctggtgggaggtgatcagatcatggtgggggagttctcatgaacggtttagcaccatcttccctggctactgtacatagtgagctctcatgagatcaggttgtttaaatagactgtggtacctcccccgactccctcttgctccccctttggtgatcactgaaagtttcttgaggcttctccagaagccaagcagaagccaacatcatgcttcccatatagcctgcagaactcgagccaattaaacctcatttttttataaattacccagtctcagctatttctttatagcagtgcaagaatgatcaaatataggctccttccagacagcctcagatagagccctctggttgcgtctagaaatgactcctgacttattctacgttcagttccaatggaaataatgtaaaccctgcacaatactgtgaagggctgacatggacacagctagaggcttctgcccctgggacaggatgggctggcagggaagaatgtactgcacttagagttcaccagtacagccatgaccctgtgcctcccaagcccgcaaacctggtagtgatgggaggggaagaagaacccacacgtgtattcagacacctgcacccaccgcccacccactcgctgccctcttggggcagctagtctcctgcaaccaactcgaagcttggtttgggctttggcgaggctctaaacggccttctaggtggtcctggcagagatctggagggcacagaagagagagtagagcttctctttggaagccaaggtgaggagggcttccagcaacctcatttcattacaagtctttatgaaggagtgctgtgtcccaccaggatggctgtgatcattactcggctatcccggagtccaggagcatgagaaaaagaagtgttactgcattaacagacgtggcccacacaggctttacgaattcccctcttcgtgtccgctggggctgctacccgagggcctttcctggtcagcagggacagtgcacgcagagcggtgtgcatgtgcaccaaccgcggacttaccttggagcgaggctggcggacttggctcccattggtgaatccagtccttcccccggctttgccaatttctctcggttcatttgctgtaggatagagttcaattcactaataacgtttgcctttgggcctgagagaatcgggcttttgatctctgtgacgtcgccccacaacttggaggtccttggctggagaaccttggccatcccaggctgggcactgcccggcgggggcgggggagcgggcggggggataacaaagctatctacatcttcttccacgagcgcgtcttgataaagtgcattgcttttgtgaatgatgggcttcatttttggcttaggaggtactgggggtttgtcaaccataaatgcttgcccatctgcatagactgtgcaggtgtccacattctctccaccttcggaagacagggtggagatgctagacacggtggagatagtgctggtcgtctcgaggtggtggtcgctgctactccggctgtccacctcctcgatcccagagtcggcgacggcgtcaaagctttcagggggtggcaggaatgaggcaggcagacagtttgaaagactggctggcttcttgctgtctgcagagttggttggttggctggagttcaacgaaggggactgaggggtgtcgcttttcttctgcttcactaagtctgagagagccgggacagaagctgcccggtcatcggggatatcaaaactatttgcaaattccaggggaggaggcaatggctctgtaaaaataaaatcctcatccaagtccacggatgccagagggggaggagggatgcggaatggcaaaatcaccgcctcttccatggagcccaccgcgacgatggttctgccgggcacggtggtgggctcgggggcagcggagatctgtaaagcaccttcggtttcggaaacaccttctggcacctcggacggcgagctgtctggcttcatctccacctctgccttctcgtcctcttcctgcagggcgttgtccagcttagtggcgtccacggtgtgcaccatcagcaggccagccgacttctgctgggacgtgtccatgatgtcgatcagcatgttcttcttgtcatcgcctttccggtctcggcccaggtcggtctcgtacttgttctccgtctcctgccgcctcaggggtccccgggtgttctgcctggtgaccgtagggaagccggcatccaggctgggccgcattttggtatcaatgtaaagaggtttgttgaggtcggccttgggggcctcccctttgggtccctgttgagactccttcatggctcggtcccttgcggagagtgccagggccagcggggagctgggatcaagcagccgccctgtgagtgggtggacataattcccggggccggctgtgccgctgctcgcggagggcactgctgggctgctctcgggcccctgggctttggacgtggaattcagcggcctcccagcctcacccggagcactggcctcggcgccacccacgaaatggttttcgggctccctgggcgtggcactcggcatgggggatgacagctgctcagcgctgtcctcgtcagcaaaatccccctcctcggggaacatggagggccgcgtcctgggggcgggtggccccaggcccacatcctcatcccccaggtctgtggagaggaaggccggggagttcctcctggcttccagccgcttctcacggtcgcggacggctccggcgatggcggcggcaaaggggctgctgacggtcaggctttcgtcaggccgcagctggctcggtggctccggggcctgggggtcgatctccatgctgctgccctggctgctcttgccgctgctgctggtggacggctccttcacgatgatggtcgggatagggatggagcacgtcttctcggggctgtcctccacgttggactgcttcaccagcatccccttccgcctggcgggcttggcggggacgtagacggctttgctggcgatcttccccacctctgagtatgggttttctggcatctggcctctcttgttgcggaagttggcttgcgggccggcattccgactgtagaggtcttcagagtccaaggagtagcggtccagctctctcctgaagtacatccccttctccctcatcatggtggccacggtgtcggacctggtggcgggggacaccttggcggcagaattctgattgaacgcaggcttaatcgtcccgtagactcttggagttggggacttggggcagttgtaagtggttggggaaggtggtggtggggacgggggcacagactgcggtggaggggggatgtcctcagaggtgtccggcatggacaggcttctggtgaacttcagcattggaggagccagaaactgccgctcttcctctgttattcctacaagcagaaaacaggtttagctttaagtcacaatagcaacaaagcctaagttcctaggaacgtgcgatacgctacatctccacaaactcacaaattcagatgatgaaccggatgttcaggaaacacagcacaagccacgatgccgagtggttagtcacatggcccgtcgtgagccaaaggacaagaaagggaagaacagaaaggcactggggatgctgtgagtacgctgctgctgtggggcctccaggcacaggctgcagcaggggagctgtgtgaggccagggcaggagggcccctgacgctgagccgtgtgccagtctgcaggccaagtgggcagctcgccttggggctgcttgtgcgtgtgtgtgtgcgcttacgtgtgcttgtgctggcattgtggcattgtgcttggggcggggttggctagaccaggaggtatccttccaccatgccccttcaggcatggtaagggctcctgggggtgtttttagggcaggggtctaaggctgtcacctgtgcatctgaaatgagagcaaagggttgcaggtattgctgtgtttatgtggcaaggatggtgtgcagtccaccgtccagatggcacttgagccccacggctgcccagatgtacagggaggcctctgccaccctgagcgaagccatctgcccacggttggctctgtgcgtgctgggaggaggtgcttttcttccagggtcatgtgaatcctttcattgcctgacttcactgggccccactaagggttctatgtgtcctcgagctctctggaccttcagagagatggatggctggggaattgcagctcagaggaggggccatgtgggctctagagcctgcccctgaggggagggagcccaggttcctttaaagtcctggactgagccaggaataggatcctgagccaggcctcagtgagccccttctgggtcccagcggcagccctgaaagtggtcctgccaagaccctttggagcaggggctgagagcccagtggaccaccataatcgcaactaaccagggtccaagtgtggctgacctggcacaaagtatgagttgacctaatgaaaatatgtggatgttgaatgtgtggggatgcagctgaggtcctacgacagccagcagggtggcctgagggttctctgggtgtgttgcctaggtgtgactttacagactgttcaacagctgaagacacagacacgtcaacaggagcacttggagaagggaagcgagacacgcacacacaccgacagacgcgtggcacagggatttcatgttgggagcatgcaggttttcaaagaggtagcaaaataaattacttgaaatgaaaaaaagtcctaggacaaactacaataatttattccaatgaaaacttccattcgataagggtattccaaatttaacatactccttgtgggaggacattttggcattgcaaagatggctcgttcaaagtgttctccattgaccagtcactctgagttggctgtctggcaattctgttcccaaggagtactaatttaagaatacaccttataaagtaaactgggttacattcagattacagattccaaaccgtaaggttcactaacctgatagaaagattctgctgtctgacaggaggaaatcagttgttattaaccagtaaccgcaagacaaatacgcagctttccctgagtttgctggtgcagggggagctttaagcacagcagacaccacctccacggccacttactgcctagtgactgcctacagttatccacctgagactcacaagcacgctgcgcttttgcacagcagcccagaggcatttccagaacacacaggacagtgcccctggggtgggctgggcagaccagagtcccagggttgcctccacaactctcacagggcaagggccttagcttctaccagaattgacacagtaaaggcaatgctgaattatctcacaaagggactgtctcaaagggtcaagtgtgaccttgtctcaaggtcaagtgtacctttgcctgcaacagggtcaataggaataattgtgacattaagaagaaaggaaggcagttttctgcaacacacagtacattatttcatttcgagacctgacccaaccacccttggaagtacatctgctgagctcatactccaggcctggtggtggctggggaatgcagggaacccacttacccttcccaccctgagcagggcagggtgggggaggggggttggctcgcaccaccccgcccaccctcccgctttaccctgctggaattatcacagataactgggcttcaagatgacagaagccaccctagattttgtgtccttcaggggggatgagtttcatgccactcagatgttccaatggctccctagtgggcaaggccaggttcccaccctctggtgggtgggctggcagggccttgctggggtgggacgccaaggcaactgtgagaggcccagggctcagaattcctgaggggcctaaggctgtgtttgaaagcccaggggcaacttctgtgggggagtgccacacttcttacctattgatttctgccttcgcatcgtacctcgagggatgcccagaaacggggcttttgggctcccaggaacagtgggcgtcatcacggcgattccttggcgttcgtacacagactgcaaaccagagagcctagggtgagacgcagccctggccagcccccacccacggtcacagggcccagagaccacaagggaacttccgtcactgtggcttccccaagctgcttctggagccacctaaagtctccagtggggctgatgagaaccacagcattgaggacccaggaaggtccctctctaggtgcctttcctattcgctgcagctgctattggcctttggccctgttaggatggcagcatgccctgttccatggagatgtggtctgctgcaacaccatttgccagagcagctggacagatacgtctctctgagaggggggccaggctggatgtcctgtgggaaagggcacagcgtggtgggcagtggggtctggcctgggtccataccccactccccatgtgccatgtgaccatcaagtccttacataggagccaccatctcctctttcataaaatgggctcctgacaccagccccacagtgtgtgcaaaggccaaccaggtattgtggtggtgtgtgggtgagcatgatgtgccagctagcttaagcaagccctggagctgctcaggggcacagcctggagtctgcagcagtgagctgtccccagcttcctccctcttcagcctgtcccaggaggagcctagagctcccctcctcccctccaccttggaagcagagtcctggtgctgccaactctttcgcttccccaggctgttgttttgtctgcaaaactgagatggctcagggccccaaacctgtagtgttgaaggccaacccgggaaaatatcagatgcggacgctcaatggaaatattcgtgtgcaagcttttattgctccagctttgagatgcagtttccatgtgtccacagcctctgtttgtctcactctatggccctgaggctgaggagcaaagtgggaccctttgggagatcaagggcaccttgtctcagacacccccccaacttggtggggcatgtgggtgccacgaaggactgggaacaaagtgggaggcaaggaccggcaggcagggcctggaggggaagtccccttgtggagttcagaggtgatgggaggaggtgtgagggcagatattgtaactgtaattattaacagttgtttaatgcacattacagaaaagccttgtggtaaatttataatatttataggtgttattgttcaagaaaaagctagacataggcagtttgatactggttcaaagagaatactaaggtaagcaatcaggacaggtaggcagtgctagaatctgacatcaggttcagatggctgcctctgcacaatggagaagcaatccaagggtccaggaggccacgccttgttcaggacgtgcctgggggaatcagcagcctctgccccaggcccttttccagctgtgtgccctcctgactgcctagggaaggtgaccatggcacgggcagcctgctctgagccaggcacccactgcgcccagcagccactgaagcccttcatggcacttctggctccgaggacaagtgttgcccaggatctcggagagtgtgggggactgccacatgggatgtgggacagacggcctcttccacaccggagcatttctgtgctctgggtggaccaggaggcaagagcccctctgtctgaagagtgtgtcaaggccccttacttccatgtgctcacgggtcctcagccaagtatgacaggacaccttcgaggctcagggcactgagtgagcggtaagggcagggcttggatgcagcctgctctgtcccaccactgtgagtctgcacagacccggctctttgtcctgtggccacttagatttgggccccacctctggacagcacgaaccagacatgaaagcgtgtgcacctcagctactgagacagcccacccacttcctgggcaccgtcggcccccgccctcgtggtcccaaggtacggccactcacgttcatgtctgagcccgccgggaagcaccggctgctgggccgctgcttgatggtcgccaccctcggttccacagccatgttctcagcagcgcgggagggcttggaggccgggactatctcctcgggtttatctgcaatagaaccgtgaggattggagcagcaacaccagtgggggaagctgggtgtagataggaaagcgcacaggtgcagcagccactccaacatccaaaactgtgcagggggcatttgttgctgctgtgaggagcatgcgtgtgcctctgccacatgcattcccactggggcatgggctccttcccaggaccttgccctcggaggcatgcacgaggcatggacatagaagaccctccacagctcggccaccttcttaagtgcccagcccccaagggctctgaagctttttgggacatttctgttttttgggacatttctgtgttttttttttttttttttttttttttgagacagtctcttgctctgttgcccaggctggagtgcagtggtgcaatcttggctcactgcaacctccgcctcccaggtttaagcaattctcttgcgtcagcctcaagagtagctgggattacaggcacctgccactacgcccagctaatttttgtatttttagtagagacggagtttcaccatgttggccaggctgatcttgaactcctggcctcaagtgatccaccggccttggcctcccaaagtgctgggattacagccatttgggccatttctttagtggaatcacttgattctttctaatgggatttattcttgtgagggttaactaaactgactttttgaagtttttttttttgtttgtttttgtttttttttttgaagagactcagacatatggttcctttgtaactgtgattgccaagacatgaggatctgccacccaaggcagcgtgggtgtttcagaggccagggtgctcgtggccccaggcgttagtaagtgttgcagagggaaggtctctgtttattttccccaatgcagaaccttcccatttcctttaaaaaaaaaaaaaaaaaagaaaaccaaagtttagttataagggatccttagcaattaacaaaagttttttaaagaggacatttgcagcacatttttttttttttttttacttgaaaactgaagcacatcccagagctctcctgacgccttagcttcatctcagggtgtttgggatcaggcataagggtgtgtctaaggctgtttaaatgcaagggccctgtgccactgagacctggagagctggtcttccagtcgcgatgtgcattctggaaaaggtgaccccagctgtacttctaagatgtcactgggttgggacaaagccagtgtggtatctggtgggtgtaccccattctgagcctttgagacagcactggccttactccctggggagaagcaggccatctggaacattctgccttctggccaccctaagcccactcttggggtctggtggctcccatgaagtgtatgctagggccttgcccagactttgagccatgaggctattgtgcaagttagagctgagcagagtgcagggaggaaggcccccatctccaaattgttcttcaagctgaggcggaagttacctgtcatggcagcttctcacggggagctgacccacgggcaaagctcccagagccacggcacggatcagggttgtccaacacaaaggcatcaggctcctgacaaaggcagcccagaccagaggtccccacaagaggaagtttggggagaggaaatgggggtgtgctggggacactgagccaggcgccctgtgatggcccctcaaccttgcagagcagctgagacgtacacaactctgacacctatggacactctcacagtagagtctgcatgaggggcctggttccaggcctgtgttccagacccttgggccagtcctgcccccaccgggccagaacctcagggcagtctatacttttttttcttttctttaagatggactctcactgtcacctgggctgcttggctcactgcaacctccacctcctgggttcaagcaattctcgtgcctcagcctcctgagtagctgggattacaggcgagcaccaccatgcccggctaatttttgtatttttagtagagacggggtttcaccatgttggccaggctggtctcagactcctgacctcaagtgatgtgcccgccttggcctcccaaagtgctgggattacaggtgtgagccaccacacccagccatacacttttagtcttcaaacaaggatggggaagaaaaggcaggagaatgtgcagcagaggccatatggctgtcacgcccagcacacttaccatggggcccttcagggaggtgtttgccgacccctggcctggaccacgtttccagttgtcagcaaaatgccaagtgttcacgcaaagcaagaaagcccttgccccatagtgtccgggcagccaaatctccccccacagcactctctcccttcatgaccaagtccagctgaccaggcctgcaggctcactgggccccaattctgcgtccctgctcatgcattctctcctgttattcctggacccacaagccctgctggctcttcgatgagcctgatgcctccttggggaccttgtcattcccccagtggatgctaagcatctgcttctcagggaactggtcaggcacggtaggaaacacccgattctcatctcacttggcagtggggacatcctggctgtgacctgtgaccccagtccagagccgtgctgtcctcacctgcgttcaaggccctcatcccagctcctccggctgcagcaggtgctgcatggctgcctcatctcacattccctttgctggggtccctgtcaacctccctgggctgcacgggctgggtccacctgccatggtcccagcaatttgcttcctccaaggagcctttcccctcccagggctgggctgggactccttggatggctggggtcgaattggtttctgtgccggcctctgttccctggcctcgccgatcagctgggcttctcccccttgacttgggaccaggtgatgcttgggtgatctcctctggccggctgtgatgtgcaactccagcttggtctatccctggaaatgggggcgctaggcagtggctgttctttgcctcaagtgagatgtggccgctggtggcccccagagtatttttctccaatgaaacgggggttgagatgtgtctcctgcaccagggagttatgtcccatagctgtggtgagccagggcactgcggggtggggataccctgggacctgcttcctgacagtgctggcccgggcccctcctctgaccccagtggagcgtgaggcctgagcggggtgcagcagcatgtacctccatgaacatgacccagaagggatgccaccaagttaggggaagagcagctggagcccaacaaaacatcccacgggggcattccaggtggcgagctctgggggcagccgcagaatccagcccacctgatactgtacacaggtgcagacagggaagggtgccttcctggctgccacctgcctgtgctcagacctgcacctgtggagatgcaggaaggcccatccgagccagaaacgcctgggcatccctccaggcctgacttccaggctatggtaagctcagaggctaaggtggcagctggggctgaatagcggaggtgagggaaagtcatcggcgttgaacattgacaggtgtcagacccagaagatgcaggacggccgaggccctgcaggggaaggcctgggcgcaggtgggtgtgggaaggctgtggccaggctctgctgtgctgttggccatgtctgggcacatcaaggaaggtgggactctagggcataacagctttcctgggattacaatttaaatgagccaaatcttcaagaagctcccgtttccaactgggcccttccagaagccatgtgtctgttttttatgtattaacaaaccccacagctgatgaggctgattcatttccatccactgcacactgagggtctgctgcccggcctccctggggcaccgcctcgacttctcacattcccaaaatgaacaggctgcaggctgcgattttaggacctcagggcctgcggcaggcatcttgttaaatacacctcatgtaactgtgtgcccagggtgaaggaaaggtgtcctggtcaataatgacagccgtccctgaatctggtggaagttctgggccgatcatcctgtttctcatcctaatgagaagctggctgtagtaaagggattgttcccatgtcgaagggaaaacatttcaggtctgagatgcgtaaggccatatgggggcaaaccatgggaccaggcgggagctggggctggcgctggggtcccccaagccttgtgcctgccatgtgatgggctgcccagccctgggccctggtgggcaacggctgcagaaagtttgtttggaaatggttggggtcaccattggcatggtttgcctcgtccaggagaaccacgaggcgggggtgggggcaccctacccatcatcacagtcgccacatcagagggtggggctggtcatgtcattgaaggtgcatccctgaaactgtggccaccttgcctgtggacatctggtctctgttttaaacctttcccttcctaataaccccaaaacaaatgttcttttgaactagagcatgtgagagcagccgggcgtgttggggtggtagggtcaggggctagcattcgtttttaagttagagttagtgtaattcaaatgaaaaaggaaaaccctgcattggctccccacaggggtgtgggtccctcctggcccttgtctcttggggacgtggccagtgggatcatgctggcctgacttgctcagtccttatcttggagatcttgtttaccgggatatggagacttttcagaaaagccacaggactgagattcctgcttctcattctaggctcctaaggattatgcttaatttataaaagctcagaactaggtctttattcagggactctggatgaaggggattagtgaatctggcccctggcagtcttagaatgaattgttcggtgacagaaaacaaacaagcctcagacagatttgaaactgtcaaatcccaaaacactccagtgaggagctgatgaagatgccccagcagtcacccgcatttcagccctctgagcaaacgtgtgttctctctactagatacgtgatgctgaccaggcacagggaaaagggaggggaggtaggtttgtcacctgcctgttaccagagccccccagcccatgagctgactctggaccacgggctgacttcagtgcaggttcccctgatagggggcaggaagcagtgtgccctgtgctagagaaatcttgccactgctctgcatcctcagcaaatcacaagggagtcaccaaatcgaggagtgacacgaccccagcgtccatgccgaggctgggaggcccaggaccacccaggcacctggtggctgagtctcctggaaaataggctctgcactgaagtgacactaggtccactgtccagcgagttcctttgcctgtggccacacaataggcccagagcctgggagccagccccattgaggggcagagtgcccagctgtttgcctgttgactcttcagaaccttctgggggaaagcagcagaccagacctgtggagggctgcatggggctgctccacctcttcagctttcctgggacctgattcatggtctgcttcacatcctctggcatggtccagggaccctgtcagttctcaaccactgctctctccccttatgtgggcttgaagtggtctgtctacttctctggagttgcagtgctactacatcctgtctctgggtgagagagtacaaatgtcactccatttccaaaaggaaaacacacacatctgcagcgccagatgttagaggacagaagccgcgtgtgttagaagcagcggctgttgccagttggccggcctcttggtttaatcttccaaagcggcagtgcagggtgggaagggtgtgcttggaccctggtggactggtcctggcctgcaggctctgagtcacacaccttccaagggctagagtctgaaggtacagccataggtgcctggtagggtgaaggccacagtccccttcatgtgcccaggggcagaggccccaccccaaatcctgcctgacagccggcttcttcctgagcccagcacagggtctgggcactagggcaggtgctcagagaacacttaaagactaaacaaggattttacagatggagaactgaaaacctgggatcactaagcagggtaaagccagcggggacagacccgggatttgaggtgctttgccagggatgttatgataaatgaccatgcacggggggcttaaaacaatggaaacgtatccctgcacagttctggaggctggaagtccaaggtcaggctccttcaggggtctggagaggatcaaatccatggtgtttcttggcttgttccttccttctttacaaggacacaccactggatttagggcccacccgagtccagcatgacctcatcttgattagatctacaaggatcctatttccaaataaggtcccattcacagaactttgggggtcacttttcaacccaatacaactgtaaaggcctgacttttgttccacatggcctttctggagtgtgacgagtgctttttccgaggcgaggccagtcctcccagagacaggtggaggcagcacgaggggcctggagcatttgccgtgcatccactatgtgccccgcacttcgcatgtgcgccatgggatgccctcatggccctagaggcaggggctgtcagcaacgctcggtgtcttcagtccccagctggatcccccagtgtgaccaggctgggccacggctgctggtccctttggggtcttcctgcccacacccttgccccctgttatatctggggttgaggctctggaagctcaaatttgtagccagtttctcttgctcagacgggaggtggatcttctgatgccaccctgggggaggagggtggtgtggatggggccaggtcccagcaggccacaggcgcccacggtggctcagccacctgagtcccgaactgttctccctgacaagggacttctgttgtcccacgctgttctggcaactgggtccctggcagccatggtggggcatcttcctcagttaggtgatgaatagagggccattcccgtgagctggggtttggccttggattgaaggggtgttcacacacaaacgtaattgcacgacatagaaagaagggtattctgtaccccgggtgtccaccacatcctcggcgcagcagtggggcctagaaagcccgctgggagttttctgggcagctgtaggatgctggtgcaagcccggggctgctgcagagaggccgctgggatgacacaggtcgggacagtggtggttctgtgcccacctcacccaatctcatctaacatgattgggacagagttaagatgtgccttagggccaggtgctaggctcctcccaactccaagggattaattaaaagctgggagtgctgcttttaattgttgggggagctgtgtccagcagcaggcgagcaataccccccgatgtgcttgctgctgtgaaagggggaacctgagtctatctggggcctgcggtccggctgcccacagccacagtgactgccagtctcccactccacaccagccctgggtggggaggtgtagccaaagggctcacactgctcccttctccttctagtgccccacagggcacagggcagcctcttggggaatgggtgatttccgggccttaaagggaggcagttcctgcccaccacaaaggggtcctgagggtcaggaatgcagccagaggctctgctcatctgcaaccccccatccaggcagccccagctgagaccaaacaggggtccggccagcttcacggtcatgacgatgtgaacacaggtcagggaagaaacacaggacacgctggggaatcacagacagaagccaagcagaaagaacagacagatgaatgtgctccagggcggcagggctcctcgggcaggacccagcaggagaagccaacaaggctttgcgacacatttgagacttcacggcatcacaaaggatgtttctgttccacaggggggtgatgggcagggggctgagacagacactgggcctcccttacccttcttcttccggaccgaggcttgcaaacagaaaggggaccgccatgagccaccaggatgcagcgcccgcccgcagcctacactcgggccttgtcagctcagggcgcctcaggagcaggctgggccggcaatggggcggcaggcaggggctgtctggaacgctgcgaacgcaggctgcgctatccatggagtggctttccccaaaccttggctgcccgcacaactctgtcctgtctgccctgctcgttaacctactgcctggcagtggaaaggggctttccttcttcctcagcaccccttgtcccaccagcaccctgccaaagtagggaggagttctcagagcagacatgagcagaggtggcggggccagcctttagagtgcacctgtggcctttcctgcctcattctgttgtttcttgactgagctgagctctcaggagcaccccttgcaaagatgagagctgctaggcttgtccctctggggagccccaggacaggcctctgtggagagggcctggaggctggtcacctcctccgtcgcctgtgaggctggggcacgcggggcactactggttctgggtgggtggggcagcgccactgcagggctgctgttttggactgaggcctcatgcccatcctcagactctagccccagaacctcgtgagaagcggcctggccggcctcagcgccctgggccgaggaaggatgacatcactgctgtggcagcacttagcacttgctagactcctctcgggaaagctgcctgtgccagagtgcagggaggacggggcctgtgagtgagagcaccagccagggcttggctctcaaccccccaggccagctggactggaccgtgggccttgggcgggggctcgtttctgcgcccatgtaagctgccttcaccagctccaatttgtgctccagtggagcaagcgtttccacctacatgccatctctgtgtgtttcagagccaccctctttccaaaggtgtccctggctccatggtgactccccggaacaaacaggatcctgcatggccagcatggcccacgtggctgctagtcgcccttcccctgcctacaagatggagtcagagggccagagcctctctctgttgcttgcagaccttacacaaaggtgccgggcgttccctaagcctgctgtgcagaccagactgctctgccaagcccacgctatctacacacagatccccggaggatggagccttctggtctgagccacgtggggagcagctcacacaggcctccgaggcctgggctgaggtggatgtcagtgggggtgccctagacagcagggggagctgctttggggacccagtggggctgcttacctttatccactagtgagaggcccaaaaattcaaaacaaaacaatgttagataaacagaaaagaggaaaggcaggactagcaacaacgccccgcgaggctccgagggaggtgcacacatggggctgcggggcatgcaggggcatttcctgatgcacgtctgggtacaggggcaggaggggggtagcgagcaagcgtggggtcatgcacagcctggtgctttgcaaagggcagctcagggaccggcatggtgactgtacagggctgggccgggtgtgcgacttaccgagctcctccagctccgaggtcatggacttggagcgcagggtgagggctgtggtcggtgcccgctttggaggcgggggagctggagggcagaggagagatgggtgtgagaccccagcccatgtttccagatatgggaataaggctagcagtggccctgtggctggcaggtgggtctcaggctgtttggctgcggtggtcagggattgtgcaggtgtgcttatgatgggaaaggacaggtgctcaggaggatcttgccatatccctgaactgcagtgcaggccctcatgggtgggcctgggcagggggagggaggggacagggcactgagtgggaagcctgcggaagggacgcctgctagtgactaaaagggcactcctggtgggacatggatgattccggcagcgtgtgagccccaagtcattgtcgtgggctctggcggtaaattccagcctcacccctgtgcctgggctctcagaagtgtgggatcagctggagagagggcccactgccccccagctgtcctgcccgcccccaccccccccccccagtagggccccaggctggagctgggcgatgtggggcatgtacctttcttcctggcggtgtcgtcggggtccagattcctggtcaccgtgaccaccttaaggaccaggtgattccctccctgccggatcatgttcaccacctgcctgtggccgactttgacaacattctcattgttaacctgtgggaaggcggagaggatggcatcagtgagagccagcggagaggaagacagttggcacccacccaaggcagagacatgtgggctcctaaaaagggggcaaatgcagggaagcaaagggagtgagaccgtcatctttttggaagcaaaggtgcttttggggaaaccagaatgaatgctgctgtgactgtggaggtcacttaactgtggctcaggaggttgggggaggccttcctctgacactgcagctctctgctgagtcctccacagctgctgcagaggaagggctgatttctatttaacctgagcatccttaggtgcttacttttacaggcctggggcaattttcagggccaccaagagactgcatgtgaagagcctgacaggcgagttccagggctgggctgcagtgccaggctttgcatcctcacaggaggaggaaacgtggcgcttaattgcttctcatgtattctgggaatgcacatcacactgaagcagcccctttcctcccactccctccctccctgctctcccgctccagaggcctgggaaggcagaaaagcctggcccagcagggtgcttacaagagtgggggccctgtccctgtgctggtctgtacaactagctgccccagtgctcctgggacggtgagtggcaggctggggacccccaaggctgccatgctatggccactgccctgcagttgaggaactcttaggagccggttacctcctgccctatttgtcctcaccatggcaaatgcacctgacacggaagtaggaacggactcagggtgccatccccctggcccctctgctattctcacctccctgagcaatgctcagcagcagatggccttggcctctgcctcccagccccacgctactcccagaggaaaacccgagtgatggagactggaactgggtgggcgtctgggctgacactgcccaccctggctactgcaggagtaacacttagtggttttcaaatgttgctgtgaaaaggccccggcctcacccctgcccatggaactgagctccacagggggcctctggcaccttcatcccagcagctcctgaatgggagcgcagcccagaggcagctgtctctaggtggcagcagggagggggaagccccagaaggtgaagtttacagctgcttcacacgccaccttcgaacaaagaaaagcaccctgatcgtaaacaacagccaagacgtcatgcccctcaccagccacactgtgctgtacgcatatcctcctgctatagattcttcaaaaactaaacatctggtatacccacaaacagaaaacttaaagcctgtgtgctgcttggtggattttcacaaatccaacatccctgtaagagctggatagaagcaggtactgcctggctcaccatactgttgacaggcccagtgcctggctccccatactgttgacaggcccaggatgtgccagttttggtcacctacgagacggctgcagaggtcctccaggcagggctgcgaggagcccagggaggactcagtggggccagggcagtccccgtgccagctgctctgcagtctctgctgtgggaccggctcattcccatgtactcagacccacccggtttcagcagtgagtatccagtgtcctgggtccactggacagctggtcaccctgcactgccctgaagatagagtcttgggagcaggactatcctaatggggccttgggagagaggcccacctacagcggcagcggtctttgcaaggtgactcctgggggctgttcctttcactgaggttctcagaatgtaattaggaaagcagatggatttaggaagtaaaggagccggatcgaggaagacagcaccgggagttctcggagggcagacctcagcttgcaggaccctcgctgctctggtacagacaggcaaccgaacaccagccacgcgttatcgggttctctcccctcccatgagcacacccgggtagtggctgttgctcattcattcattcattcactcattccagtgtttctgttccccgtaccactaaaagccatgaggcacaggcagttcagctgtctctgcctccatctgtgggaagtttgcgtcctcatcagggagttttggccgacacacaaagaagtgaacacataacttcaggtggctgagtaccacctaagaaggcagaaccaagtaaaaggagactgaacagaggcctggacccaccaggaaagagcagtgtgggcggagtcatggagtgggaatgggcaaggaagcggtaggcaggggggcgcagaaaaggccaaggcctgagagcagggccttggatgccagggtgaagttatgggccagggagtgctgaggcccgatgcagagatgaggcatctgacccgagcagctgtgagtatgaggtgccaaacacacgtgggggggcaccgagacactggggtctcaagctgagatggaggaggcaggctgcccaggctcaggagccgcgaggccaatgtgtgaggccttggtgagaagacctggcagtagggagcccccagctgcctggccactagatccccaggggtcatcccttgcaaggctgtggggagcgaggggaggactcggccccaccttgagatgggctgggaccagctttcctgctctgggcgggcccccagtgccgggccttgagggggctccaaccaagaaagtgcatattactgcctgcttgctcctgccacccgctgtggggcattctctggatctgatgcttggggagagtacgagactggcacggggatgggctgccagtcactggagaagccaagctcaagttgcggcctcctgagggctcgtcgggctgatggggactttaacagcctggccacttaggcagggaggggctggggatgtggcctctgactgcagcctgctaaccatcacggccttgggctcactccctagaatcctcatcctccagaatctcccgtggttcatttgtggtggctggatgctgtccttctgtgatcttggccagagctggcccttggccgctttgggagaagcagtttgttcctgtgccttggaagggtcaaggggctggagggcccttttcctcagaagtgtcagagacagacattactcttttctgggcaggggaggcaaaggaccaaagaaaggcctctcggggaatgagccactcatgggggattctcaggaagcttggctgcggggccaaggaccttggcggccccagcaccttccttgtctgtagccgacagcctgggtgcacgttctggtggcacctccacacactcatgctgccccagccagagctgctcctgcacagggccaggctggctgcccagatttgatgtctcatatctgagtctgcagaagctgctgttcccacccaactcctaatcagggctccccagttcctgattccatcccctgtacccctcgtagacctgctgccctcagcagactgcagcaaatggcaggacctgctcaggagagctcagaggaaatgaggctcccatgggccctggaaacatcacttggccttctctgaaagctgatgacaaagaggcatacagggcttgcaggggtggagctaggtttggaatcagttgttgggcatctgatgcccctctgacgtccagaatctgtctcgcccaggtctttcggggtcatgagccacttccaaacaaagttgctttggacgagcttccctgcagtcccagctccacttggagggccctccctcctgcttcatggagggatggtatccggtgagccctggtcctggtgggcctgcacccctccagaatcagcatattattgggtccggagcctgtgggggccctgctgcttgctgggtgcccgtgggcaggacacctgcctctctagcggggtgtcctcagtaaacagcatggcttcctgccctggcaagcacttgggggcagggaggtggtgccaacagggcctcaaaccatccacacacatcctaggatgttccctttggtccccatccagcgattaccaagggtcaaatcccacccacacagtgcctcagtcagttttaacttagctgtcacaatttaaagagtataagacctttgcatagaaagtctagaatttcagttttcattgaaaaattagaaccctcgcacttggggagttgggcctcccacttgcatgcggcatcctcccctgctgttagctgaggctgtgactgctgctgtgcccgcccgccccagcctcctgggccctgacgtcaccttctcagcttgagggggcattggatttgtggctcttgccagccaccagtgaaacagaaaactgctatcactgcctttgatgccatctgcgtttagaattttgggaagggacagattgaactctgcacattgctggtctcaaaatcagcctgggtgacattcatgaaactgatttctatttcctacgggagccacaggtgactggtgagccctgtatcaatataagcttcccaggccagtctcctgtgtcagagctcagatctcaaaacacattgaccttctgcccagaatctttcccctgcagagggagagggatgtctgtgaggggcctgcaacagcctttctgagcatgaggaggaggcagaatgggggaatgtcatgtgggcgctggggcagaggcaggtggccatcccgtctgtcaccactccgcattaccctgaaccctagatgcaggcccagtggacagacacggacatgaggtctggaggggcctgtgggggaccccaactcaaacttgggcttgcaaaagccaggaaagtggccccgaatcttgcacttaatatagaaaccacatcgtttccatcaatgaagagccagttccagcaccaagcatgtggtcccagtgacgcgcgtttgtaattagaccctaaataccatcaagacactaaaaatgccgacttccccaaagcagctggggctgggaggaacccgcaagagcggggcttgtgattttttggagtgtttagaggctctgcaaatgaactcagaccggtagtaactcctgcaacgcacatttgctttgcacccctccagggtatggtttagattctgccgagagggcacaggccgtgacagtgtgccacaggaacctctatcatacaggcccaggacaggaagaccccttggtgagaacctggccgcactgacagcctgtgcccggctctgacctcaggcaatgagagcctgcctactgggaacgccacagggcaccagggctcatgggggtggatggtgcccacgtgctgctgggcacacacctgccctgtccccctcagctgagcacagagaacccatcccaaccttccgcccacactgacctttcccgacagaatgctcagcacccctccccacatcccatccctccagcttcccctaaggccaccatcagggctaagtcctggggcggggcagagtctgccccctgccctactttgcctactggtgcatcatctctgtgtccccagacacttgttctggactgaactgtgtcctgcccaaatttatatgctggagtcctaatccctagtatctcaaaatatgaccttactttgcagatacagtcaagttaaaaaggggccattagggtgagcctaacccaggtgactagtgttcttatgaaaaggggaaatttgggccaggtgtggcagctcacacttgtaatcccagcactccgggaggttgaggtgggtgggttgctcaagcacaagtttcagaccagcctgggcaacatagtgagaccccatttctacaaaaaatacaagttagccaggtgtactggtgtgtgcctgtggtcccagctacttgggaggctgaggcaggaggatcacctgagctctggaggtcgagactgcaatgagccatgattgtgctactgcactccagtctgggcaacagagtgagaccctgtctcaaaagaaagagagtcgggggagtctggatatagagatatgcacacagggagaaggcgccatgaagggtgagatcagggtgatgctttgagatgctaaaggttgccaggaaaccgtcagctcctatgggagaggcctggaagattttccctcacagccttagagggaacccatgctactgccaccttgatctcaaacttcttgtctccagagctgtgggacagtccctgtctggttgaagctgcccacctgcagtgcttggtcaccaggcctgtgccttgcccggccttcttggttaccaccctgaggactgttctattgcagccctcagccacagtgcatctctgtctgctgcccactgaggctcacctgcccctgcagcaccagctgttgcccatgcagtggcacaggtctccagcgctgcccaatgtgagcagacactgattgggccacagtcttggctcttggtcccacgacctcccccaggggcccagtgtggggacactggctattggtctcagagcaaaaatggcctcaagtcccatttatcccattgagggggggctcccagcatggagctctgcactcttccttgcaggagctcagagcacggccagctggcatgtagctctgagtcttcagcattggtgtagccttcgggtcagctttcctcagctcccctgccccctcaccctgtctttcagctctgactcagcccaccctgctggccacgacttgaagctggggacttgcagtggctgcatgtctatgtccccccagtctatgtgttgaaaccctcaccgccagtgtgatggggttgggaggcggggactctgggaagtgattacatcatgaggcggagccttcgtgaatgggattagtgcccttataaaagggaccctggagcaaccctttgccctttctgtcctgtgaagagaagatggctttctgcaaaccagtttgccggccagtgccatgatcttggacttctggtctcccgagctgggagaaataagtgctgtttaagccacctgatctgtgtattctgtcgcggcagcccaaacggactaagaactcaagtgacaaaccatagctgtgcttacttacccaggagcctggccacagctgtttccgtctcccatcccctgcaattacatatattgtaccaggcttgagatggggagggaggaggtgtcttggccagcaggtgacccaggagtgactggtcttaaagggaagctgggaggcagggactggaggagcagaccctggggccgcagttcacccagacctgcagagatggcagaggcagctctggcatgcaaaggccacagcccccagatgctgctgctgttagcaaacctggggccaaggttggtggctggggcatcttaaaggtcctgggggaaggggtgttgtgagtgggaactcagaggcactgtcattggaaaatgactgccgcagccctgggagggagtgggcagtgcaggctggaggccacagccctcccgcgctcatgcttgtagcagagcttttgcccttccccaccccacagaggtcctattgaaactgtcccctttagcagggctaactggggcatgtaatgtgggtccctgagaagagattgtctttcctgcctctgccagcgccaccacccccaagtttctgccactggacccagctgtctgtgaggcctctggatacagatcctgtccctcctttccctgctcctcctctgtccaggagctgggggaacctgtctgcaggaagagggtgtcctccaggatgggcccatgtcactgtcttctacctttagaggaagtgtctctgccttgtgcgagtcatagcacagtgagtcctaggggttcctggagtcctccctaggctgggcacacaaagggtggagcccatgctcccagctgccttcccctttcctggtgaagaggaagtgtgactccattttccggacagaagctgcgcagccacatgaagtggcagcacctactccttgctgcctcagagccagccccaaccaaagaggctgcgccaacctcccgtcgaccatgctggtcttaagttctcatcctattctgcaaaataaacaagctttggatgaagtccttccccaaaagtaagaaacataccaaggacaaagctgtgcgtcgtgtggctttgggtttttgtgcacctgctccccgtgtgaaggtgagcactttgacaacaaggctcaaggatgccaacggagtgtgccccagcgcccatcaacacttctatgggaagagtggggcaaaggcacatggctggcaactcaactcaacgtgaaattaattgacaagaccagcacgcaacaaggcaggactggatacttcagttacatttccctacccagttcagcagggacagaggaaaaaaagctttaggatctttagaatttcccagcctttaaacaaacctaaaatcagtttaacctgcaatgagactttggaaccagctacagtccttaaaacagatgccagaaattgctcatgtggtgacagaaactgcagaataggtgaaatgcttgctgtttcctcatatgctcaggttggcatcttgagcttccatggggtttcggtgcccctcaaaaaacctggacctgcaattctggaatgctgccaccaggggaaggtatggcttgatcacttgccagatttatagaaggctcaggtaagtactgcagctcctggggataactgccttggagtagagagaaactgttgagaaatcatggatccagataactccaaaaaaagagtaatgtgcctgtccatgcatcacccttacatacagacatggagacatttacagagtgagtgaatcacagccacatccaggtagatggcaagaacccaagcctatcatcagccacagtccagggaatttctgtgaagaatgggcatacctgccttcctttgtaaataattctcttcttccacttaaatcgttatttaaaatatcaaaagttgtacatacacatacacagagtttacagaaacaaagagttccacaaggattgtcatgatgaaaccccaccaacccagccttacttctcactctgagccttcagctatttaattttatatctatcactcaatctctgaacacctatttttgctacttgatatttacattttcgatattatccgctgacacactgtgatggaaaaggatgacttggctcagagtttgtgaaatgtggcactatggtgattttggaccaattaattctttgttgtgggtgtgcactgtaggatgtttagcagtgtccctgaattctacctgccagctgccagcaataatctccacccccaagcgtgaaaatcaagaatgtttccagatactgccaaatgtcctatggaaggtcaagacaccatcagttgagaaccactaatttggctctttttaaaaaatcctccctccccactgttttcccagtaccaccatcctctagatgtattgatatcaaaattttaactagatcaccattcaggatttacatcatgactatgtaaaatctattcatagcttaaactctatagtatactatggttacttcatcttttcctgtacattttgttctccctagagcaaaataattttgtttgttggtcggtttttctatgtacttaacagtaattcaaatccaaatgcttccctaattatgtaaatctcttttcagagtcttcaaatacattatccattttaagtttgtcttcctgaagaaatatttcctgaagacttttgatctgcactgaacaaccaggattaagtgttttctagcagctgtccccattactctaatcctcaggattcctttgactgattctttcctgtgttggatctcctgaatccctgtatttgtttatttggttcaaaaacctcattttttgtaaaggacatcctccagtatcttctccccaaatagagttaggacataatttttttgagacattgactatttgaaaatggctttatctgtacacttaattggtagtttggctgggtataaaatttgaggttggggaataaggtaaagtaaattcctaagactaactaactcttctgcaggtaatagctataaaatctagacagagtacaatccccacccccaaaccaacaaataaattctctgaaggttctgaagagtgaacaaagacaggcagattttagatgagagttgaaaattagaagctttgtgcaatggatgcattatggtatgagtcacctgcagttttttgttttttttttttaaatccagatcctgcacaaacctgcagttctgatagaaatcagaggatacagcccacagtggccatagcagccaaagtgaggggagaactccagaaaagagagagccagagaagggtagtttcatattctgtgtgtaaacttctcataggtctttggttgatgtctgagctgagctgtgtgtgtaaggaagactcaaataggcttgctatgataaggctgaaatttgagctgctgccactgcagggcagacaaaggttgcaatttgagtttaaccaaactcattatcagctaaaacaaaaacattaacacccatcaaaggaatgtaatataatccagagttgccaaagcataacattcacgaaatttgggatacaactcaaacttatttagcaaacccagagatgacccagatgttggaattatcagagaaggactttaaaaaacagctactgtaacaatacccaactaggtaaaggaaaataggcttataatgaataaaagacaggaaatcccaaggaaattttaaaaagaattatatggaattgttagaaatgcatcagctgggcttaacatcagcatggatatgacagagctaattattagtgaatttgaagacatgccaagagaacatatccaatccaaagaagagagaaaaaaagattttaaaaagtagaacagagagtattaaggatcaaaaggtctaacataacgtgaacgagagtctcagaaggggggaaaattagagtcaaagaagacagagaaaatgagtcataaaaaatacttgaaaaaatggtacccaaggaattccccaattaggtgaaggacataaatttatagattcaagaagcctgtgaatccccaaaaagataagtatttaaaaaattatatagggacattatagtcaattctgctcaaagccaaagacaaggtgagaatcttaaagcagccagagaaattatttacattattcacactctaaataaaaatgactgaatgattgcagactttgcatcagaaaccatggagaagaacctcttgtagaagacggcggaacaacatctttaacaggtgaaagtaaaaaaaacacaactagaattccatttctggtgaaaattctttaaagaatacaggcaaaataaagacctttataaaaaaatgaaaaccaggttatttgttgccagaaagcctgcactaaagaacgttcttcaagctgaagtgaagcgggactggatctatggatggcacaaagggtgccacaaatggtgaacacctggatacaaaataaaagatgattctccctcttaattttaaaagcagatatcactgttttaggcaaaaataatactgattttggggtttacaagtgtgtagatgtaacacacatgacaattatagaataaagtgaggcaggagtgaagaagatgcatctatatggttgctgggtttttatattttacatggagtgtacaatttgaactctaagtagactatggaaagctaagaatgtatactgtaatccttgatccactgctaaaagaatgtgaagagctacagtgtaacgccaatggaaaaattaaaataaggttctaagaatagttaaataatctaaaataaggcagaaaaagggaaaaataaaaactgaggagataaacagaagacaaacttgtaaacctagatggaaccacatgaacaattctattaaatgttaaatagaataaaactccaactaaacatcaggccttataaaatggtttaaaaagaagacctaattatgctgtccgtacactttcaatacaaagacactgagaggctgagagttaataaatgagaaaagacagttcctgggcagaatggctgttaatatcagacaaaataaatttttgacacagggtcttgctctgtcgcccaggctggagtgcagtggtgtgatcgtgactcactgcagctttgacttcccaggctcaggtgattctcccacctcagcctcccaagtagctgagaccacagatgcatgtcactatgcctaatgattttgtattctgtgtagaaatgtggtttcaccatgttgcccaggctggtcttgaactcctgggttcaagtgatctgcccaccttggcctcccaaagtgctgggactacaggcatgaaccactgcgcctggccattcaatgactttttaaatatttcttttattttctctttgaggtatccttattttatacacagtagaccgtctggactgaccttctaattttattatcttcttcgaaggccatatctttttcttttctgagaaattcttttcaagtttatctttcaatctatctttcaaatttttaatgccagcccggagcggtggctcatgtctataatcccagcactctgggaagctggggtgggacgattgcttgaagccaggagtttgagacctgctgggcagcatagtgagacctcgttccttgaaaaaaaaaaaaaaaaaaaaaaacatttaaaagttagccaagtatggcagcacgtggctgtggttccagctattcaggaggctgaggtgggaggatcccttgaggctgaggctgcagcaagtcctgatcacaccactgcactccagcctgggcaacagagcgagacctgtctcaaaaaaattttttttatacctgctatataatatttttaattttcaggaactcttattttgttctctgatcatttcagaaagaacattttactttttttttctttgatctcactgagcatattaataatacatttcttaatcttactcttcctgcatactggtttcttcagttgttttcagtgtgtttgttttgggccgtatttcatattagttcatcaaatgtctgatgttccttggaaggcagctcatatttcagagtagctcctaaaagactaagttcgatcacagccaattattttgtgaatactgacaaatggatcctaaagtttatatggaaagctaagaggcccaaaatagccaacacaatatcgaaggaggacaaagtcacagggctgacactccccaacttcaagagttactatacagctacagtaatcaaggcagcggggtactggtgaaagaacagacaaatagaccaatgatcagaatagaaagcccagaaatagacccacacaaatagagtcaactgatctttgacaaaggagcaaaggcagttccatggagaaaggacagtcttttcaacaagccatgctggacatccacatgcaaaaatgaatgtagagacagacctgaaatctttcacaaaaattaacccccagtggatcacggacttaaatgtaaaaagcaaaactatgacacttctagaagataagagaagatctagatgaccttgagtttggtgatgatttcttagatacaacaccaaaagcataatctataaaagtcaaaattgatgttggacttccttaaattaactctgcaaaatgcactctgaagagaataaaaagataaaccacagactgggggaaaatctttgcaaaacaaacacttatcagataaaggactggtatttgaaatacaaaaagaaagaactcttacatctcaacagtaagaaaacaactgaatataaaaatggggctgggcatggtggctcatgcttgtaatcccagcactttggggggccgagtcgggtggatcacctgagtgaggtcaggagttcaagaccagcctggccaacatggtgaaaccccgtctcttataaaagtacaaaaatcagccgggcatggtggcacacatctgtaatcccagctacttgggaggctgaggcaggagaatcgcttgaacctgggaggtggaggttgctgtgagtccagatggtgccactgcactccagcctgggcaacagagtgaaaaaaagggcaaaatatctgaatagacaactcaccaaagaagatacacagatggcaaataaatgctccacatcatgtggaattagcaaatcaagccaacagtgagacaccactacacacctatggaatggccagaatctcaaacaccgacaacagcaaatgccggcgaggatgtgcagcaaccggaatgcttatcgttgctggtgggaacccaaaataacacaggcactttggaagacagtttggcagtttcttacaaaacaacacacttttaccctatgatccagcaattgtgctcctttgtatttacccaaatgagttgagaacaggttcatacaaaaacctgtatgccgaggtttagagcagctttattaataattgccaaacttggaagcaacccagatgtcttttgagaggtgagtggacaaacacactggtccatctagaaaacggaatattagttagcactaaaaagaaatgagctaccaagccatgggaaggcctgcaggaagcttacaagcatgttgctaagtgaaagaagccaatctgaaaaggctgcacactgtatgattccaactacatgacattctagaaaaggcaaactatggagaaggtaaaaagatcagtggttgccaagggctcagggggagggaaggaaggtggaacagaagcacagagaatttttgaggcagtgaggctgttctgtttgatactataatggtaggtacaggatattatacatttggcaaaacccacagaatgtacaccaagagtgaaccctcatgtagactacgggctttagttaataatggtgtatcaatattggcttctcaactgtgtgggacatttgctacaattgacaagccaattgaaaaatagggaaaacagggagagatataagggggtatgtggcaagtcggtacttttcactcatttttccccataaactcctcaaaatataaagtctactaattaaaaagaggctcatttctacaagtttttattatggaagaagcccaatgttacatgacagtagagagatgagtaccctgagccagtgctgtccctttagccagcgtcagccactgctggctccgagagcacccacccagcccctggggcgatcatatccctctgcgttccctggaaatggctcagcatgctttctatgaaaagacagagactcttattaagaagaaacacaactgaagtgggaggattgctcgagcctgggagattagctgcagttagctgggatcacaccactgtactccagcctgagcaacagagaacctgtctcaaacaaaacaaaaaccaaaaaccacaatgccattctcatgcctaaaaagcgactgcattcctggtatcatgaggcaccgcgtcatggctcaggctccctgagtgtacagctggtttacttgactcatgagcaagatgcacacgtcacatctggctggcacgtctctgaagcctttttacatctctaggctttccccattcctcttttatccctttgcagttcatttgctgaagaaaccgagtcaattgcatcctgcggcattgcttctattagtggtggtcagaggcgggattgcatccaggagccctttgcaggcggtgccgggcatacccacgccaggagccccggcacagctgcttgggtctttctgcgacgagacagcaccggtgggtcaagcaccctcagcctgtcccactccccgtcagcttgccacttagtgtttttagcagccactggtaaatgccatgcccagatccttcacctcctgggagctgcagaacgctgatgttcaacttctgttgctccttctccacttactagttggaataatttttattttaacttcttgagacagggtcttgctctgtcacccaggctggagtgcagcggcatgatcttagctcactgcagccttgacctcctgggctcaagcgatcctcccacctcagcctcttgagcagctgaaaccacaggtgtgtgccaccacactgggctaatttttgtatttttttgtagagatggggtcttcctgtgttggccaggctggtcttgaactcctgggctcaagtgatacacctgggcctcccaaagtgctaggatcataggcatgagcactgcacccagccacactaatttttaagaagaaactttcccttttcaacacttggatgactctgaggcacagtgtatgtgagaaggcccagatacgggccggatactcgcctttcatcagttttcatgtgaatgagtcacttctttcaagtgaccagttctttaaaaagtgtcattatgggcggggcatggtggctcacgcctgtaatcccagcactttgggaagcaggtggaccatctgaggtcaggagttcgagaccagcctgaccaacatggagaaaccctatctctactaaaaatataaaattagctcgacgtggtagtgcatgcctgtaaacccagctactcgggaggctgaggcaggagaatcgcttgaacccaggaggcggaggttgccataagccgagatcgcaccattgcactccagcctgggcaacaagagtgaaactccgtctcaaaaaaaaacaaaaagtgccattatgaactcaagaatgtttataagaacatagctgataaaagtttgaatccactacaattactattgtttttattttattttattgaaacggggtcttattctgttacctgggctggagtgcagtggcatgatctcagctcactgcagccttgatctcctgggctcgagtgattctctcatctcggcctcccaagtagctgggacccaggaccacaggcatgcaccaccatgcctaatttttttttttttttttttttttttaaaggcaaggtctcaccatgttgcccaggctggtctcaaactcctgggctcaagcaatctgcctgcctcagcctcccaaagtgttgggatgacaggcgtaagccaccacgcctggtctagtctttgtttttaaacaaatcttttattttagaatagttttagatttacaaaaaacattgtgaactcagtatctggagttcccatacactccacactgtttcccctattattagcatctcacactggtatgggacatttgtcacaattaataaaccagtattgatatatttcattaactaaagcccacattttattcggatttctctaatttttacctgacgtcccttgtctgtcccaggatctgtccagagcaccacattacgtttagttgctgctctaggctctgcctgctgggatggtttcttagactttgttttgttgaccttgacagttttggctgctggtcaggtcttttgttctacccctgaattaagattttttttcctcattattagactgaggtatatatgggtgttcaggaggtaaagagccattcctgtcacatagtatcgagggcacacactgtcaccaagacttttcgctgttggtgctggccctgctcgcctggccaagggagggctcactgggctcccccgctgtgaagttactctcctttccctactttccacacagtgctctcgaaagcaagtcactgcatactgcccacacctaaggggtggggagttacacaccacctccttgaggacagagtatctttgcacatgttagggaagatttgtctattcctccctttatctttcagttgtttatttatcagtgtggacccatgaatactcatgttgtactttgaatgataaccaaatgtgactttattttctagctcaaattgtcccggccgtggtctttgggagctccttggcctctgggagctccctgggatttgctccagccttttgttttttgaccacttccttcctttccggttctacaggatgctctaggctgctaccttttgccgtgctttcgaatcctccactgtgctgtatgagcagcccttcctcacactggctcctgagcccatcacatgtgactttgtgtcttcaataccttccttgcttttggatgtgacaaaatattctaccctcttcatgattatactgatagcttcaacagaaatttaggatgatgctgtttttacttattttcttttatattggtgtctctttctctttgctgaaaatctaggttcctaatgactgccattaaggtcatgatctatttgctctatcatttattaatcatctatccatctatcattactttcagactaacaccaccaatgtcattactcataacaggattaccgaaaagaggttatgatttctttccagtttgcaatgacatgcaaattgccacttgacataatttgttaatgccattaatttaattagcagttatgttcatttctattattttgttttggattttgagatttttgaaattttgactgttttacaattacgtgaaatatttactcaattccaaaattgaacctgctactctctctcttctacttcctcttcttgtattctcccccttgaggcaatgctaaattaaaacaagttattttggtggattatccttccattaaaaaggagaaatgagcagatacctgtgtgtttctgtatgtgtatgtgtgtgtgcacgtgagcatgtgtgtgggtgagtgtgagcatgtgtgtgggtgagtgtgcacgtgtgtgtgcacattccctccccaccttccttgggtaaacagcagcacgctggtcacattcttctcgccttgcctttcccacgtaacaacaccccctggagacggtgccacggcagctcccagagacgctccctgcacctgactgcagccacatgtcctcgctgcaaggctgttacgcggcacacactgcaggctcctactggtgggtctggtgcttagtgttctgctctccaaacagagctgaaaacagccacgtgagtccttgttctaattttccgagtgcacctttgggctatgttcacatctgtggggttgctggctctaacggtttcttatccaaactacccatcagcccttagcccaggctacctccacctcctaggcagaggccacagcctcttgcagttccgccacgtgattctgactgtaccagctttccccaccacagccccgctccagctttctgaggcctttgagtccacttgctgtgcagccgccatcgccgtttctgctctgtccttgttggtctctgcctctttaaggatggcttatcctgctgcgtgcatggctgaatgcacggcttaacctctatctagatttgattgattggcagtgtccctcttttgctggacgttgccaatcaaacctctaaaaattcatttattcttgaaaaagatacaagaaagtaccaaaggggtggccacagcatggctgtccaggcacgggcgccctcccagggcagccacacttctgcacgtgcagggttctcattaattcttagcttgtctccagccatggcttattcaaaccccgatcttatttcctcctttgactagaaagctctctggtggtaccccctctatcgtctctcatcctacccagggcctccgagtccctgctggctcaggctttgaaagcccaggccccttacccggctccagctccgcgggctggccggccacctgctcacactgtctaagctttttcaaggctgtccttggcatccattcggaccgtgtcccagtccctcagttattgcagccatcagagggggagaggaaagaaggaagagaagggcactgcccccacctccaaccaggcggcatcatttgagactcgtgcagaagggaagccgccccaagccagccaggcatttgggcccctaaatgccacagctcctctcttagcggccacagttgccccggcaacgtgcggccgcgggcaggctaccttcactgaggcctccctccagacccgcagctccaatccacaccctctttgaaaaatgtttacacacagtgccacgaggtctccggcagagggcttgcgggtgcaaggaaacccacaggcccacacctgcaatgctggtgtgggtgtggaggggcagctgcttgtctcctgctcctccccgagcatcaaagcacgcgggtggcacagcagggtgtgcttctgcatctgcccgggccagctggctgctgtgtgcacaccgggaggcctctctgtccagagcaccaggaggaggctggcctcacacctcaatgcgactggttacaaatacagattcccagccctcacagcagcaggtgctctataaatactattgagcagttctctttgggactgtggtaaaacacagcagggtaggaatgcctgggttcaagtctcagctgccccactgtcaggtgagtttgtgacctcagagcagggctctggccctcatcagctctatctgcagcaggggagcagcagttctggcagtctatccatgagaatgcctgaggacgggtgtgtgactggaaggggggatgcagaggccctgctctgctggggaggatccccggtgctgccccgaagccctgtactgcagcccggctttcccacctaagcaggctttgtctatggtcctgccccctccctggctgtccttcccatgtaccctgtgcagcagccggtcctggagggcagtgttcaccgcttcctgtgtcaggaggcgctcgctgctggggctgggctgtgcacgaatcaggggctgtacgggattctcagtccactatcttgttctcaacaagaatatccataatttcagttcaaagcagtggaagagcatcatatggaggcagagtcggagagctggggtagcttcctctgacagcacccttcatcctgctgtgtccttcagctgtcctccctcccctgtgctgctccgcacggccactgcatgctggcttcaaggcccctgtcaggggtcagggcccaggctgaatacctggcacatgagggggcctggccatatttgcagcgtgactagcaagggaatattaacagccagtgtcaactgagcactgacgacatggctgcccctgggctaaggacttcacatagttacaccattcagtcctcactagcaccctatggaccaggtggcgacgggatcccattttacagatgagggacagaagctacagcggagccctgggtcctcccctctctaccaggagagtaaccaagagcagtcccaccccctggggggcagtgcagctgtgaatgccaccatcggagatgggaaagcaccaggggcagctgtgtcgctcacatccacgctcgccttaccagcgtggatgcacagagtcccagggagcctggagaaaggtatggactatcttcaacttaatctggtggtgacacccactgaggttgctgttcccaatgtgctatctttaccggagcaaatcggtacaaccccagacactcggatgcagctaagaccttgtgaattcctttgctccacattgatctgcaaggagtactagtaggagtctgctttcacctgacaacaccagtggtccacatgcacagcccgtcctcaggctaccccgagcctcctgctctctgccatgccggggccctcagagatcccatcagctcagctttccagaaaacatcatgctgtccacgatactgatgacattacggtaactagatcatgagcaggaagtagcaaatgcttcggatgccttctatgcaaagaagggtgggggaagcccacagagatgcaggggcctgccagttcagtgagggttctgcgtcctcagtgctctggaacatgttgagatagcccctccaaggggggaacattccgctgcctctcaccatctcatgcacacatggacacatacatgctcacacgcacacaggcacgaggcttggcaggtctttgtggagtgtggaggcaacacaggccacatttgaacattttctccagcccatctacaaagtcctctgcaagcctgcccgcttctagtggggaccagagtaagataaggctctgtgcaggtcccagctgcagcagcacaggccttgctgccaatcggcttgacagcccggcagctgcagcgacacttacagtacccatggcaaacagggacgcgtgtggaggctctggccagcaccagcaacagaatcccagtgcaggcctcgaggacttgggagcgcatccaggcccttctccgcaggtaactcttcttctgggaaacacctctctggcttgctcctgggccacggtgtataccttgcccaggcttgcccagctaggtcacttctgttagctttgtgtaccagtccccaggctcacccaaggaacagactctgtgggtggcagcccctctccaagagttaaggacagcagcccctaacacccaggacagctcatcccgggtctgtgaaccccagccagcaggcccagggatgggcaggggatggtggatttttttttttctgccttctgctaggagcatgagacagactaagagagaggtgagagaaaagggcatttggaaacgagcttcgaggtaggggagaaaacaggctctttcttttgaaatgccagggttggcagcatcagaacaggagcgaacagggtcctggtactgtgcagccccacctcccaacgccaggggaacggagccctggcacccccgtaaacacacacaccaggtcctggatgggaccaagccaccactttgccccctgaacagcacactcagaaggggatctctgctctccagctaacccccctcctagcccccagggatgtggctcctttagttttgtggaggtgatggcgggaaagtcctgttctcagaagcttccttccccctccctgctctgtgactcctgtctcctctgctggacttctccaccttagtcttggtggcctggggggcaactgcccatcattctcagccagcaggcctctctcaggaggacaggccctggcatactctgcccccaccccccacccaccttttcaattcagacacaactggccagcactcacattaaaacagagatccggagagtaatggaatgaactcctggtagcaataagacaccaaactataaacaagacctgaggccatgccaggcaaggtgatcctgcaccctaaacctaagaataaggtggattctggccgccacaaggcttttctgattctctagcagctaagcaagcgctggccttgggataagcaacattaatataattgtagctcatccacctccagacactgacagctggcctgtgttccaccagccataaccacagctgtgactggacaagagactgatttcagtgactttctcctgacaagagaccactggccgtgggctggctctcgctgggtcacagaggctgcactgagcccctttgagtccctgcttcacctttccacatgcagggcctgattgccatgcctttcaatgttaagtctctaccccgaggtgaacatgggaggcgtgtaccatgcatgtgtgctcagcgcacacgcgtcagggcccctgtgtgaatactcatggcttctataacctgctgagtgtgcttagccagcgtatcctcattccagccccactcccctgaagtgcctgcttccggctttggccagaggctatgcttcccagctggtcacaatgccacctcgcaggcgtaaccctttacaaaataaagtctcctttcgaaattttatgattttgtgatttcttttcagttgacaccactcctccccctcccctactctcaggcaaggaccccctccctccctcctgaacaccccctatcatgtgctgccgacctctgcaggcctggccccctcggaatcacatcccgggggagcccctctgagcccactctcctccctgtaccggccccatctggccaccaccctgggagcatccctgtcctcgtctcagaggtatgccaaccgccccgcccaggtcaccttggctgctgaccagacgctcccagtcctcaacgcttcctacacgaccacatcccagaccctcctcacaccgtccccttccctgatcctggcctccaggcctcctccacatcgtgctggtgttctgacccacaaacggctctgattccacagctgtggtctgggcgggccctgtgtggggagggagagcccagagacctggtcctttattgaccagatgctcctgaacattctgcctgggtcctgtccctgtccccacccccaggactcctgtagttaaagcctcctggggagggtgtggtgccggcctggctgtggacttgtgctgaccccttctggggccgggctggactcaccctgaccttgttcctcttgagcagagcttgcagtcacctgcagctcattctagaacgacccccatggtccccgcttcccagtgggccctggggaatggtgtgggctcaggtggggcctgattcaagttggggaatcctaaagtggcatggcttcctggtgtgtttaaaatactcatttgctcctcactcagaagggcagttgctataaatggcctccagcagcctggagatggcactgatggtgtcatcagccagctcgggtctgagaggcgcctcctccctggagcccccgtggtggtgaaaggagcaggggccctgaggccgggcccccaaatctctctggccattcatgtggcctctcaggggatgtggtggtgactcagactccgaggtcatggagaaggcccctctgataagctgagctacgaatgtgcctgactctccttcaggaggctaggacagaggacagaggacacccagggacaatggcagaccagggcaaagggcagagaggaggctgcggaggcagccaggcagccagactcccgcccatgctccttcaccgggcgacccagaccttgccagggactcaggtgtctcagccacaaaatgggatggtggtgagagggaggggcctgagtgcatgttaaggacctggagagctgccaggagcatctgcagcaaatgggcaggccacactctcatgaccgtcctcccatccctgcagatgatccggacccagacgacaaggcagaaggtaggaaccaggatggcggcgcagaaaccaaccgagcatcaggtgcacctcggcgtgatgctgccagccccagctgaggatctggcaggccgagaggccgagaccccgtccccaggcgtccctgaggtctgagggtcaggttgtccatgtgtgggacgaacgtggctctcgggctgctgtggtgccctagtatccggtggaagcaggaaggtttggcaggtcctcagcagggatgcagcctcctgggctgacgcgaggctccttgccagtgcctcgacgcgcaatgcaggtgccacctggtggccatgggaccctggaaaggggctccaggtcccacaagaacaccccagttcatggccctttatggcacccatgggaggggctggatggggctctttcccgtttactgcgcagtgttcaagttgcccagagctccattagcctgccccggtcagccagcgtgggggcagcagagctccatggggaggggggctcctgcatcctgatgaaggcccaggcagaagcaggcccggcagagcctgaggctgagggcagaagggggtctctcctgggcgattctttactatgccctgacaagcgggtcagctcgccggctccccaggggcatggaaggaaggaagcgtcctcggcatccgtgggggagatcacctacgccaagtgggggagggtgaaaggtgaaggggggtccgtggcagccggcgagctgggagaagcacagcacccagaggaacccaggtggcgactcctgctccagggtccccacacccgcctctcaggaggggctcccctgtttgaagaaataaaaggtcctggggaggcccccgtgacgatttccccccactggtggccttgtgggagccttaggggaggagacgggatctcctcaatgtgatgatgggggcagatcatggggcatcctggagcctggcttggggcggaactcagtggggttcagacaccctggtcacttactcccctttgggaccagggagtaagaaacgggtgcctggggagccagtggcacaccaggccaggaccagtgtctcatgtggcaccagctcaggacccatgtcatgctaggaaaccatcatggcacccactacttgcaacagcagggtctgtacccactgcagaatctcacccagtcctcccagcagccctgtcagcagccactactgcatccccatcttccagatgggaggctgggcccagagaaggcgggtgacttggccaaggccacacagctggtaatggtggctggtgcagtggaaccgggcagttggggttcaacacacgggttccccattaccacccaaaaccccccacaaggtgccgtgggatgcaggctgcagtgcggcggatgcagattctgggttattttagaatagcctagaaggtcctcctctcctgacagggattccaagatctatacaccttcgcattgtggtaaaatacacgtggcctaacactgaccattgataacatttagtacagtcatagcactttgcaaccaccacctctatctagttccagaatgtttttgtcaccccagaaggaaaccctgcactcataagcagtcactcccctccccctcccactggtaaccgctcacctcctccctgtctctgtggatttgcctattctgggcatttcatgtgaaaggaatcagacactatctggcctttcatgcctggcgtctttcacctggcctcatgttttcagggttcacaacgttggaccaggcatcagtcttctgttcctctttatggctgaataatattccattgcacagacagaccacagttggtttttttgcttaccagttacgaccatttatggtttgggttgtggggatgtaggatggtgcggctgctatgaagacagtatggcattcctcaacactcaacagagttaccacataatccagcaattccactcctgggtacagaagaagagaaaggaatgcagggactcaagcagatatttgctcaccatgttcacagcagcgtcatcgcaataaccaagaggtgggagcaacccaaatgtcccctgatggatgagtggataaacaaaatgtggtctatccatgcaatggaatattactcagccgtgaaaaggaggaggccgggcaccgtggctcatgcctgtaatctctgcactatgttgcccaggctggtctcaaacttccgggctgaaacaatcctcgcacccaggagttcgagatcagcctgggcaacacagtgagacaccatttctacaaaaaaattaaaaactagccgggtgtggtgacacgtgcctgtaatcccagttaatcgggaggctgaagtgggaggattgcttgagcccgggaatttgaggctgcactgagctatgatcataccactgcactcctgcctgggtgacagagcaagaccctgtctcaaaaaaatttaaaaacacaaaaggaaggaagtgctgacacatactacaacgtggatgagccttgaggacatcatgctcagcgaaataagccagacacagaaggactaatactgtgtgattccatttatctgcagtccctagagtagccaaatccacagagacagaaagtagaacagtgggtgcccggggctgggagaagagagaatgaagagctagtgtttactggggacggagtttactggggacagtgtttattgggaagatggaaagttctgagatggatagtggtgacgattgcacaacaatgtaagtatactgaagtgtatgcttaaaaatggctgagattttgtccgggcttggtggctcatgcttgtaatcccagcaccttgggaggccgaggcgggtggatcgtttgaggccaggcctttgagaccagtctggacaacatagtgaaaccccatctctactaaaaatacaaaaataaataaataaataaaacattcgtcgggcttggtggcgcacatctgtaatcccagctacttggtggctgaggtggaggttgcaatgagccaagatggcaccactgtaccccagcctgggcaacagagcacgactgtctcaaaaaaaaaaaaaaaaaaaaaaaaaacaaaaaggctaagattatagagtttacatgtattttactatgatttaaaataataactttttaaaagggagaggcatggcccaggcccaggcgcctcacctgccagccccatgagtgcctctctgggcctttgcatccatctgtgctgggggctggtggtggggccactctttggggtcttggaggatcaaatgcaaatgcacccacgcgcccgggggcctgagcctggggtgcatgcttggcagaggtgagctggggttttctttgtcccacactagactgactgcctcgcgggtggacgactgttcccaggtcacggttgagggtgaggccccagggaggcctgggatcatgccagggcaggcagggtgactgtggcatgcagcagggctgtgaggacaagtctagggctaaggtcccatctcagtgtccccaggccttgctgtgtggccacaggcattttgctgcgcctctgcgtcctaggagtggggataagcagcacctcggggctggcatggggactgggtaggagcgcagagacactgagcgccttgggaagtcctgggcctgcatgtcactcggggctggaagtggcttctccacacctggtcacttgctggctggccccccactgatgagacggggtccttgcagctccacttctccccatacatttctttcctgcctcgcagctctgggtgctggggcttgtctctgccaaaccttcccggagctgacagtagggaccagatctctccttgtctgcctggaccgtggtgtgtagtgacagttctgggatatatgcccctctctaggacagaggctgggtacggagctctgagcattttcctccaacctgggcttcttccctctggatcactgcacctgggcagagaggcccaaggaaacaaatctccttgattcttttgcttgtcattgagaaactcaatgctgagcatgagttgaaatttcaggcatgctgagctgaaattcctgtggcagcagctgttctcaggaacatgtcagttccataaggcaggtgcccccatactgtgcaagataaatgtgtttccgggtgtcagcaggcaggactgccctggacaactgtgtaggttgttcactccacaagggggtctgctgggggtggtgttcaagtccactctgtgctctgccccccatgctgtgcacagctgctggcatgcctgcctagagtggggggccttctcacatttgcacaaaggtattgtgggctcacagaggtggcccatcagcaaacgcctcaagtctatgggcagaattgtgggtctgtgtgcgtgcattttcctagagggagggcccctggtcctcgccagactctaaaatggagtcacaacccagaaagaggcccagagcccctcttccagggaagcaggcacagcacagtgaagccagctcccaatacagtccattgtccatggaaaaaaaaaaaaaagcatttagtgggaatgcagaatggtgcagctgcagtgaaagagtttgaaggttcctcaaagagttaaacacagaattacccaatgacccagcaattccatgcctacttataaccccagaataattcagagcagggtcttagaccgacacgtgcgcatgagtgtccacagcagcaccattcagtagccaaaagatggacgcaacccagtgtctacggacagagggatgaataacactctgtggtcgagccatacagtgcgacactcacagaaaggaatgaaatgctgacacgtgttccaacaaggagagcctcagagacatgatgctgaatgaaagaagccacgaagcaccccactttgcatgattgcatttctatgtaatgtccagagtagccaaattcacagcggcggaaagcagacgttgccggaggctggggggaggggcaatgggagggacggcccttggggacggggtttccttctggggtgatggaaatgtccaggaaccggaagaaggtgatggttgcacaccctgtgattgtgtcgaatatcactgtacacttttgaatggtgaattttatgtgtatttttacattttacatttttagacttttatttttgtagagatggggtcttgctgtgttgtctaggctggtctcaaactcccgggctaaaccgatcctcctgccttggcctcccaaagtgttgggattacaggtgtgagccactgtgcctggacttctttttaaaaagacaatcgattcaaggtctcaaatacagagactcctaggtgcaaattctacatccttattccagtgtcagaactgctgagaatgtccaacctagctccaatcacaacccgggggcccatgtcatctggcccctccccctgcttgcctggcgttccctctgccgcagccatgctgggtgcccctctgttccccaatgactggctcccatcagctttttgggggacatgcatatttctttaattgagatgagcttatataatgtaaaattcacacttttaaagtgtgcgactccatggcatttagtacattcacagtgttgtgcaagcaccacctctagttcatccccctacaaggaaaccccctacccattagcagtcagtcctcactctccccttccccagccataggcaagcaccaatcggcctgtcctggacatttcatgaaaatggaactgtgcaccatgtctccttttgtgtctgcttcttttactcagtgtcaccccttccatgctcacccacaaggtggcacgtctcatcactttcttcctctttatggccaagtagtgttccactgcatgggtgcccattctccaagagctgtggtacatggctggtctgagctcatcccagcccagtgtctcttggtgaaggaggagtaaaggccagtatctgctaggcgctgccctagaggggcagtgtattagtctgttttcctgctgctattaaggacatacccaagactgggtaatttataaaggaaagaggtttaattgactcacagttctgcatggctggggaggcctcaggaaacttacaatcatggcagaaggggaagcaaacacgtccttcctcacatggcggcaggagagagaaatgctgagtaaaagggggaaaagccccttataaaaccatcagatcttgtgaaaattcactcactatcatgagaacagcatgaaggtaaccgcccccatgattcaattacttcccactcgttccctcccacaacacatggggattatgggaactacaattcaagatgagatttgggtggagatgcagccaaaccatatcaggcagtaactcactaagtccttgctcagccctgggaggcaggtgctgtccccattcacagacagaagccaccatggagggcccagggcaggacacagggctgggacaaggccccaggtgtcctggtctgcagtctgtggtcttgcccctgagccaggctggcttcaacaaatgccagctggatgaaagaatgacagtgtcctaagactgctggggagtccaaactggtggcttcactctagcatgtcacttcttcccataaatgacagtgacacagttcatcagttcaggtgacgcttcagacactactgcacagaccgagggatgtagaggacaatggcgaggtggggactcacgatctgcatgacggtctttcccttgactgtctgcctcaccgagagtgcagtcaggccatgaagctgcttcggcccaacagagatgaggatagtcaagttcgttagctatgcaggggcaggagatgtggatagtgcctctggctggggaaacactgacaaaggagccatggctccaggaccctggtcagggtggtcctcagctctcacactctgcttcccacccatgttgaacagggcagagctgacctggagggaagactggctttggggcaggtgaggcaggcacatgaagtagtgctcatgaccagggatggttcccacgaacaccttcctccctcccaccctctattatccattttccatccatctgctcacctaatccatcttcccacatgagtcagtccatccatcgctctatccatccattactccatccatccatctgtccttccatccatcctctatcctccatcattcagtccatccatcactctatccctctgttcttccattcatccattcattatctaccatcatccatctgccatcatccatcagtctaaccagtccatccatttatccatcatccatccatccatccatctgccatcatccatcagtccaaccatcagtccgtccgtccatccatccatccatccatccatccgtccgtccgtccatctattcatccattcaccatcatccatcagtctattcatctgtctgttcgtccatctccccgtccttctgtctgctggtgcatctcatgtctgtcaggttgcctctgtgaggtcaagtgttgtgctagacgctggggaatgaataactcctggccccgcctttaagggctgcacagttgggcaggaggatggccacccagggggaccgaggccagccctgcagcagggccacccagcagcactgtgggaagtccctgtgctccacggggcaggagaggttcgggtgggccatccgctggcagggagctgggcccaggcacttgggaagcttgggagcctgagaagaaggtgtcagggcctggtaagctgtgggggaagcagtgactggccggagaccccaggaaaggcacatagcccagaatggacatgtggctcacccgaggctggttgactgagggggctgcgtgggggctgggcctgaagccagaccagccctacagggcccaactctctgcaggtgcacacactgtcgccaaggcacgtggacacacctgcacccccaggccccagccaccgacagcaccatgcctgccccctgggggccctcaccctgggctgaagcccacccaggtctgctggaggcaccgacccaggagacctccttaccctggcctcactgcccggctctgtgctgagcctgccctgtgtggtctgagcggagctcacagtgccaggggctgggccagctgtaagtggcggggtgtggcgggctcatcacgcttgttgtttgttaaagttcaactccgttggaccaagctgagatgaggcttggtctaaaataaaaccggagctgcgtcagtgtgtgggccggctctgtaggctggaggccactccacagccagcaaagtgtggctgtgcaccccagggctgtccccacccaggctggcgagctgtccccatgaggcccagctgtggcctctggtgaacccgagaggcagaatggccggccgatcctgaggctgtgtctgcacccacatggctgcggtgggcacagggcccactcccagggacccgattcccacactcagtgtctcccatgagctcctgggcttcaggcttgtggctccccttcagctggggtcagacacctcaggcttggctctcacttcttgagccaatgtcttggacatttcgtgaaaatggaaccgtgcaccgtgccaccttttgtatctgcttctttcactcagtgtcaccccttccatgctcacccacaaggtggcatgtctcatcactttcttcctttttatggccaagtagtgttccactgcatgggtgcccattctccaagagctgtggtacatggctggtctgagctcatcccagcccagtgtctcttggtgaaggagagaaccatggggtgaggacagagcagaggacccttcttactccaggaaataaacagcattttctgagccgtgttgagtgttgggctttgtgtcgtacgtcagctagaagagggttccccagatgaggctggggaggggtgggggcacggtctgcccatgctccttttgctccctcagggcctcccaaacactgagatcctagtttgaaaggatctgccaagttccctgagcgcccccctctcagagtcccctgcaggggtgtccccaacagcccctccagaatttaggcctgagaagcggaggagggaaacctccccccaggatgctcattaggaaagaagcccccagggccagcatggcagcccccaaaagatatgtcctagtccccggaacctgtgaatatgactttatttggaaaaagtctttgcaaatgtaattatgtttctcaacagaatatgacccgggatttatggtggtttaaaatccaatgacacgtgttctcgtaagagacagaagaggaggagacacacagctgggagagggcatgtggagatgaagtcagagacaggatgcagccaagccaaggaacgctgggagcccccagaagctagaagtggcaggaggcctcctccccggagtcttgggatggcacggggccctgccacacctggctgcagccctgtgaggctgctgtctgacttctggctcccaggactgtaggggaacacattccccttgcttgaagctgccccgtttgtagccacttgtggcaagcccaggccactcaaacacacccaacaaagtgaagaaataggcggctgggccctggctcagtcctgcagaggcacgagtcagctctgcggaggggaccctcgacattctgctggcaacagggaccgtgtgtgcggggccaggcctggtgtagccgacgtcaaccctgcagcaggtcacagaggcccgtggggggtcttccaggaggcattttatggggcacgtgccctgaggaactctctggccagtcacctgccctagctggatttacattgagagggcagcgagagaccccatgagtgtcacaaaacagtgatctcaaagtagctcactcacttgcagaggggcgttacccttgaacactcgtgaccatcctgggcccagcacacccacggggcagtagcgagcggtggagatgaggggcagagaccagtggggattcaggcggtcactgtcacctccccagcctgaggcctgggtaaggccagaaagctgagtcaccccacccgggggctcctgcagccctgcctgtggacatagccagcagcccacacggagtccccgggcgctgacctcttccaaacagccttgccagtccttcccccagaattagccgacagtgacccggagggaccaggggatctgaggccaccgcctttgtcccgaggggcttggccaaggatgcacagtggagtggacactgcttgccaggcctcttgtggactgcacgctaggcctctgtgccaggctctggatggggcaaaatcacaggtggcacatggctcatatggtattctggggatgcgtcctcccctgagccagtgctaaggaggtggctcccactgtcccatgcagtgtcctggcccttggtcagagtaaagctctggtcaggaggaaggagcaggataacgtggggctaacctgtctgctgcaggaaatgcatggaggaggaggtggctgtcactcttgctccgtcagtggtggagtctgtgctggttccctggggctctgcctgctccagggggagataagatccaccagccagggggcagaacagcccccggggcagagcctccagggaacagccccattccacacagagaaagcactgggtggggcgggaggcacgcacagacggtggggagggctgagtgttgggggcagccctgagtgctgtctcaggggcacccccagcctcaccatcaaccacccctccattagccttggctactgagatgcagcctagaagaggacgtgggctaggaagcctcctgggttaccccgtcggccgccacaagcctggcacccaggcactaggcttgcagaactactctgcctctcgctcggggccgatgtacgggtttacttttaccttatgcagagttctaacagggtggctaactggatctgcggcacacagaggatcaggatcaggaaatcagacaaggaagaagggctgcagaggcaggcccatgcacacagagggagaggccggatggcagagcgtgcacggccgaccccaggatgcaacagcaccgaatgccagtgccacagagagcaggctgtgccacacgcgggcctggcatgacctggtgcccaaacgcagctggcaggacagccttggatggactggagacattaaatgatgttctccatttaaagaaagtagagtaaatgaagaacattttagaacattccatcccaaatgggggccagactccgagtcggggtgcccaacagatctgcgggggaaaggtgctgtgacaccgcggtctggggggtttagggcacacagaaagctcactcgccacgctcaccacgctcactcgccacgctcaccacgctcactcgccacgctcactcaccatactcaccacgctcactcatgagtggatgagcaatcacagacagcaccacaggctggcggcaactccggcgctcttatctacccagcttctccctgcccagactctgctgtggggaccaggatgtaatctgggcgctgacccatgtccaccctctcctcgttcagctgggatgagccatgacccagcaggctggggtttccagggagtgcgcttctctcccgggggggccgtagcagagggcctgggtgctttaaccacagacgttcatgttcctacagtcctggaggtgaagtccaagatcaaggtgtgggcagggtgggttcctctggggactgcgaggcagtttctgttccaagcatttttgtgcccctggtggtggctggcaagccttggtgtccctggcttggaggagcatcacccccctctgcctccatcttcgcctggccttcccactgtgtgcctgtctgcgcccaaacctccctcttcttacaaggaagtgggccagtagatcaggggctgccctacccttgtgaccccatcttaaccagtcacatcgcaatgtcccaatttccaagcaagacctcactctgaggtaatgggggttagggcttcaacgtaagaatccaggggaacacgattcattccacagccgtgagttatgggcatgcttgtctcatctcacatgcctcccccaggccagtgtccccaagagcaggggccagggctcacccatctctgcaagaaggagaacagaaccagcaagcggggcgcccacgggcaggtcaaggggacggcgtctgagaaacccaggcaggctggggcccctccctcctgtggagtcgaggtgatgaaggcaggctggggctcctctctcctgcggagtcggagtgatgaggaccattctcatcctaccacctcctccctgcccgcgggagcctgggagtctcatgtccagcctgacacacacacgatacccatggccgcagcttcacgattagcgacggggggtgagctgactccatggaggccttgaaacccaccccgtcagccccacccagggctgcatctttatagttttaatttttaactgtactgcggtaaaatccatataacataaaacttccaacctgcccaacatggtgaagccccatctctactaaaaatacaaaaattagccgggtgtggtggcgggcgcctgcaacgcccagccactcgggaggctgaggcagaggttgcagtgagctgaaatcacgccactgcactccagcctgggcgaaagagtaagactcaaaaaaaaaaaaaaaaaaactcagatataaaactcagcacgctaacctgttagcgcagaattcagtgtcactgaacacacaatgtccagaacattctcatcttcccaaactgagcctgtccctgtgaaccactaactccccatctccttccccagcccctggcactcaccctccaactttctgtctccatggacttcgctactctagaagcttcgtatgactgggatggttcagtgctgagcttgtctcccgtgactggcttatttcacttggcataatatcctcaagggtcctccataggaggcctttgtagccagtgtcggttttccctcctgcctaagatggaacgatgctccctgatcgggatacaccacatttgccttcctcctgcaccggtgatggacacttaagctggccctttcacctgagaacacctgtccttccgtcagcctggctgcacctctaagccttccctactcatcagcctggcgggaacagtaggaatagccaccggccccccaccaaccatccttggcttcatcaagaaaatggacagctggctgtgctggctgggcagcttcctggcgtgccctcctggccagtcacctctgcaggtagcaggtgggctggcaggcacgagccagctaggacacggtgagtgatgactagatgtgtaggtgactgtgggcctcaccagagacctctgggcaggcaggggtgaggccagcaggcactgacagatgtggggcgtggagcctggtgtccaacttggctctgagagcccggtttatggcctaaggcagtggttttcaagcgggggaaacggtgccccccacaaaacacattcagccatgttgggagatatttttggttgtgacaacaacttgtgttgctactggcatcttgtgggtggagaccaaggaagctgctatacatcctacaaagcacaggacagtcccccacaacagagaattgctgagtcccaggtgccaccaatgccggggctgaccctgccctaaggctgagggcagccatcttggaaggcagcctgcagttctcgtggcagctggcacagagcaggacccatgcaaaccagagagctcctcactcagaagcttctgcacaccccgtgacagtggctagagggggtttactgcccaggatccacgctactcctctgtgcacgggccactgagtgcccagtagtgcctgggcaaatgctgagtggctgctgcatggcatggttgagttattgcagagaagttacaaaaacagactacatagtgagctgaccggtggccctcgaaagatatgtccatgcctttaacccctggcacctgccaatgtgaccttatttggaaacagcctctttgtagatataattaagttaaggatttcgagatgagatcatcctcggttactgaagtgggccctgaatccagtgacgggtgcccttatgagggatgagaagagagaggaggatgaggctgtgtgacgacagagacacaggttggcaccatgtggctagcagccaaggaataccgggagccccagagctggaggaggcaaggaaggaccctcccctagagcctagagggggctcatggctttgcccacaccttgattttggaattctggcctccgaactgtgagaaaatccatgtgtgtcgtttgcagcacagcccctggaggtgcatgtgggctgtgctcagccctgcttatgggacacggccatagcctcctgaccctcactgggcagggctctgggactctctccaacacctccactctaaccatcaggtccttcctggagcacaaacccaacagcccaggaaggttggcaaacgactcagaagtcatgtgggcctgagtggctactcctggaagctggttcccaaagaagcattttcacaagacaacctgatcacgcagcttcctgcctgtaccctggcggggtttccaatgggcctcctaactcccgggcaccatagcctcagtttccccactgccatgaagagaggcaggaaatgttcccaggggatttctctagtatctcaagggctgactgtccccccatctggagatctcagcaggaagggggcccccccgggaccgctgaccaatcccacaaatgagaacttgaacagagcaagcaggcgggtagaagggcaggggcggcatgcgctgggtgaggaggcagagccctcaaccggcctggcgtggggtggcggctgagctccccagggtaactgcatgtgcttttcatggaactggaactgcagtttgatggccgggcacctttcagatcagaggatgctctgttagagaaaggcacggaggagccacacacagtctgcgttgtgaaatgggtatttggttttcctctcctctactgacacatggctcctaaaatctcaggaccctccagagtgctgagtgtctttgtatgctagtgagatgactggtggctgggggtccctagatagcttcagaatgggggctggttaccaaaagaaccaatcccaagattagagggttggaattttccgccctgccctccagcctccagggaggagagagagaggctgaaggttgagtcgatcaccaatggccaatgattgaatcaatcatgtccgtgtaatgaaacttccataaaacccccaaaaggacagggtttggaggagtttctgaatagatgaacacgtggaggttccttgggggtggcgtgcctgggcagggcatcaaagctgcacgccttcccctgtacctcaccccacacatcactccatttgtaatatcctttataagaaaccggcaaacgtatttccctccattctgtgagctgctctagcaaattaattgaaccagagaagggcatcatgggaaccctgattcatagctggtcggtcagaggcacaggtcacaacctggggcttgttcttggcacctgcaaaggacgtggggcccatcttgtgggactgagcctcaccctatgggatcaacacactctccaggtgagcagtgcagaactgaattgaattaggggcacctgctggtgtccgagggaaccgattgcttgcttgctgtgtgtgggaaccccactcatctggccactgagggctctgtgtggattgcgttgagagagtatagtgggaagaaactgagtttgctttttcctatagcctcacagtccccccaaatttggcctcaacgagaggctgttagcagacacgttcccatttcttaaggcaactttccagaagtcaggaaacagcctatttggaaaacccaaccctgacctcccatcctgtgcctctccctggggatgacaggcccagttcaaatctccactctccacatgcaggagagagtcctggggccgcagaacctctccagccccggcctgcccactctgtgcctcagtgtcctcatctggaaaatgggccagtcccagcagctacggggaacatagctgttgtgaagataaaatgagcccccaaaggtggagccccacgcgtaggaccttccagaccagctgttagcaattgtcattgtttagcctggggtttggaggggggcaaggctactgcccctgtctgtccctgtgagacccggagcagctgcccgtgggagagtgactgacggatctcactgtgggccgtgcagtgtgtatggttcaccagggcccaaatccctgcccagggagaggcactcagcagggtcaggaggggccaccccgccctcaggtcacagtagacaccatcccatcccaacaccccctccctggcctggaccagcagatggacttgggaccaggagcggggtggccacctctgcagggacacaggtctttcatccggtaggcgacaaaaggggaggcccctgctgctgctgtgacctgaaaccgcagtctcactgcgacgacagaggcgagacctcagcccaccctcaggcttctgatgccacaaaggagcaaatgtcaccggggctgtcctgggcaaggcaccggtgtccccacccacaggtccttcagggattgcatcctctgagcccacgtgagcaccaaggacaccgtcgcgggaccacgtggggctgcggcctctggggatgggccagctgctgtgtctcctgctggggtggcggtggacctcgggagcttctctcacatgccaagcacgggcacaggatggcctcttggaagaggatgggccggtggcaagagcccaggccagggcaggcaagggccactggggcctgggaggggttgcgctctgattccccgatcaccaccccagtcctgccgtgggcgtctctttttgtctgagaatggatggaagtggctcctgcagtccctgggctcgcgctgtctgagctcctaatccggctggccggaggcagcgtcgcattgctaatcagctcctttgtgtgccagtctcgtcttcctgaccagctcccagctcctgcctgtctgcagctcctgctccagagacattcacggcccctgactcactgcagcctttgctggccctggggtggggctcccagggaggggctggccaagcaggggagtcagggcagctctgggaggccccgagccaccgcacgctctctcctggatggcgcccacctcagcgcccactgcagagctgagggtcctcacctcggggtcttggttttctcccctgagagcagctcagtgacagcaccgtctccctaaggccactgggacgggataattcacgcacaccctccgtacggcgcctgcacacggtaattgctcattaaacagctggtgttgtatttttttctgacaccaaatacatcattccaacatcaaccaattctctaatccctgccagctgggtgtcctactgctcagttcaattctgacagtacctcccagagtcagtgcagaccctgcgggcgaagggcccagtcccacaagactgccccagcctcggaggccagttgccaagaagtggctccccagatgacccacacttctgcctggctgactacgagtcagagctcccataacccttgctcaggtctgatatttgctagaaccattcacaatactcgggaacatgcatcacttatggcaaccagttgattatggaggctgcacctctgaacagcccacagggaagagaagctcggggcaaatggggggtgcagagcttccacacccccttgggtaccaccagcttggaacctcccaagcctggttgttttttataaatttatttatttaatttttttttttttttttttttgtagagatgggggtcacactatgctgcttaggctggtcttgaactcctgatctcaaggaatccgcccgcctcggcctcccaaagtgctggaatcacaggtgtgaaccactgcgcccagagttttaatggaggtttcaatacttaggtacagctgattaatcattggccaatggcaattgagctcaacctccagcccctcttcctgagccttctgcacctctagaatcatgtggttggtttttctggtgaccagcccctgccatcctgaagctatctagcctccgcctcccctaagtatcatctcattaacatataaaagacaggaaattcaagaggttttaagagttctgtgccaggaactagggacagagaccccaatgcatgcttttttattattccaagttgtcaagttgtcgagagtccagacaccttgcctcattggtcagtctttcctcaagatcgagaccctcccagcttccctgaccctcatgctacagcccagtcccattgaagcctccccctgccgactgggctggtgtagacccctggtgggccttggtgggagggtgtccactgccttgctggccttggcagatgctgggctgccccagtcccctccctgggaacaagggggaacaatgcatacacctccctgctggctctgggtgtctccagcgtgtcaggccctcgaggttcctccagctgcagaaccttctggggggcatcctgccttggccagctctgtgcttgccaagctatgattaagattctttgcttcaccagactccctggacttctcctgagtccatctgtgcgcttccgtatcaaatccaactttagcaagaactcccgaccctggatacctgatcaggccgctcacctcccacccccacctgggatgtctgctcaccccagcctgcctgcagcaagaatcccattaggtcagtttacccagaatctccctcacccttgatgcttccactcaggaattttccaccctctcactcccacccactcctgggccctaaatccccactagcccatgcagtattaggaactgagtcctatcccgtactaagtctcctccctattcaatattctgctactcccctaccgcaatagtcctggataaaaactgtatttattaacaacttttttttgagacagagtctcgctctgttgcccaggctggagtgcagtggtacaatatcggctcactgcaacctccacctcttgggttcaagcgattctcctgcctctgccttctgagtagctgggattacaggcacctgtcaccacacctggctaatttttgtgtttttagtagagatgccgtttcaccaagttggccaggctggtttcaaactcctgaccttgggtgatccacccacctcaccctcccaaaatgtagggattacacgcatgagccaccgcacctgtcctatcgctttaacttctgttcagctctagtcaccccacagcccagcacagagcaggtgcctgtaatcccagctggacagcgtgtctgagtatcaaacagctattcctcagtcttgaggaaggtacagatctgatttgaaaagaaaagcaacttctctgggacccccgcttgaatagctgacttgaaaggctgagctcttactctacgtaattgtcttccaagtgcaaattaactctgctaaaggaatccttggtccccataaccatttagacacaatcgagacagagaatttcaatgttcttggcaagcccctgcaagcccgaggctgagcttcatggcagcagagtgaagataagcttgttatcagctcactgagtttgaactagaaccggaaacatcctgtctccctgccagccacacagaatgccctagaaggctgtgggtgtggctggcatcagcatcctggcctggcctggtgcagccttctgggcaaaggaggcgctgacatatgtggcttgtactggacagatgtgggagccactgccctctcactccgccttccttcccaaggatggccggcaggggttgccagcatccgggtgggctgtgcccagacactggccacccctggagcaggcggctgctctccccactcagcggcccgctgcctgaaatagatgcttccagttttctcctgtgattttgatctttctgaaaagagcctctgacacagacgtgcacacacagccatctctaacaatcgatggatggctggatttcccttcctactgggactgccctgatcccaggtggggagactctgcttctagggctgcctagcccaagtcccatcccgtccacccgccacttccctgctcttgacctcagcccgtctcccgctgggctccgttctcagggcagcatctagagtttagtgggaggctggccggcgcctgtgcccggacatggagcccactctctgtccttccccttccagagtccccaaggatgagaacagaggctgtcactttctcccctaggaggcaggtgtggtctatgggagaggctgccctgcgcaagtgctgaaccctggctgttgggatcacgggttattgtgggttgaaaagtgttacccccaaacctatgtccatgtcctaacccccggagcctgtgagcgtgaccttatttgtaaacagggtctttgtagatgtaatcaagttaagatgaggtcactggggtacatcctaatccagtcattggtgttctcaaacaagaggacaatgtggacacgcatggtgggaaggaggccaggtgaacactgatgcagagatgggggctgctgctgcaagccaaggggtgctaggggttgccagcagccaccgggagcaggaagaagctggaggagtaggcaaggctcctcccccagggccttccgggaaagcatggccctgctgacatcccgacttcagactgctagcccccaaactgtcagagaccacgcctctgttgttctagccacagggtctgtgggacgctgtgacagcagccccaggaaatggattcccaggcacagctgtgcacacgggggcgctcgacgtgaaagctcatgctgaccacacaggccctgagaccatggtccgacttacgtaggtacttatcacaggctgcaagcaccgcagcccccagtgacctgtgcagcggaacaaaggattccacgccgactgagccaaaggcatcccttccagacatggatgaggtgcgggtcatttcaagtttcttctgcctctctcaccccaagcccacagtcacactggtccccctagtgaagggcccttaaaaataagctcccgatggccgagaaaggtgctcctctgtatttaggaaatggagctgcctgcttcctctttggtgatgggacatcgactaggacggcctcatgacatttgcgaagcgaggttgcttccgctgtcctctcctttggtgctcgaggcagtgtggccaggggcaggcgggggccgtggctcccctctcagaagctgggctcagctgggaagtgacccgaggtccccggccagggactggggagcttgagtgggacaccagggtcccagagctctgtccctgggatgggacgaatgtattaggacctcgaaggaatcttcagccctgttggaattcatgcctcttggaggtgagaccttttccacagacagttaacaccgacacaggtgctcgaggaaacagagctgcattttaggcgtgattctcaccatacctccatgtttgggtttttcaccaggcaaggggcttgcgaaagacacagcgaagctccggttcactcgcagccaccgcctctgggggacttggtgggctctctcctgctgggctctgtcagggctctgtccagtgctggccgaggcctccccatgtgcagggcactgccctgtagcctccccggtcccccagaaaaaccgcaccggcttggccaccaccccagaagccaggaagccaagagcagctcaggcctaccagctcccgccaggctcccctcttcctactcctgcctggggttcctgtatccctggaaagggaggcaccatcaacccaccccctctatgcccacccagcagcccaggtgttctgctgcagacccactcccggtagcacctctggaaggggacacatccctgccatgaacgacctcagcctccttacagccctttccccatgtcagttaggcagaggagaccctccctacctggagggtgggcaggagcacagctggtcttggagcagacgccacccctcccctgctggagcctgctgcatgcgtacccccaggtgggctggggcaggggatgctcttcggtttttggcaaatgctgcgttctacaccctggaccctgcttctcactataccagggtctttctattcaagactaaagtctagcccactgctactgctgctcagtgaaaatctcatctgctggatctgctggcgaggcctccgttcaggaggaaagaccacatccaaggggtcggctcgcatttggtcccggattcgcgtgggttggtgggctaagaactgagcgatgttgttagcgaaggtcccacgtgaaggagaaccctggggaggggcccggtggtgaagggggtataccctgtaggctcagcgcccaaacctcccttcagtcctgggccacggggctctcccaggcagtcagcgggtgaatctcagggcaggacaagctccaggagggcccagaggtggtggaaatgtgagtccagcctcagggcctccatggagcaggtctgagaaacatcgaggtgtggatggatggttatggagaggaacttgtctagcctcatgagcagacacgtgtggacccaaacagccacgctgcagtggtaaacgctctccaggaaggtccagggacactgagaaggcgatgcccctgagggccaagcggggagggccaaggggctggagtgccagcggaccccctcccaccccctccgagacctcatccctgtactttgctgggggcttcaccagggtctgcattttcacatgtgctcactctgcctgtgtctgctgcagcaaatgttctttttgagggagaaaacacatacagaaacttcccctggtgttgcctatgatgtggctctttcagcttcaaagatgtgtctgaggctctttcccgaggccttgagacggaggctggagcctctgctctgtgccctgcccgctgcccctccccctccctcccaccgcctcccccatctccacccggccagtctgaccctaagctgcgtggacggggagtggagctctacctcttaatttgtgggcagaattctcaaaacattcctaccacatgcagaatgtcacacctgactttcgccccagcatctgggctctgatggcgaccgcatgcctgttatctacccccggcctcggcagccccggtgtgatgcttgccatggcctgcattccaggcatggctgcttcctcaggctgactcagtggtttttttcactcaaattcccaagcctccactaagcaggagcatgaatagagctttaattctacaacgatgcgctagttacgtctttgtactaagacactaaaataaatatgctccatcaacatgaagcatagccctatatcccacttagcctcagctgtgggccccacctggggatgtggtgtctctgctcgtccacctggtccctggcctggagtgatgtgaaactcccgcaggcctggactctgggttctgtagcaggcacagtcaggagtgctgggctaggaccctgccgtatggccttgaggctggagggctggggagcgagactctctatgcgccaagcctgtgctgccagcttcccagcccgaggcacgggggagcccgtgggggtgtgagcttcctccctcctggggtctgtacattttattggagagcatggatgaaacttaaatgcgatgagtaattccaggcagtacccaagaccacgtttaccagtgacaatgcctgaggtcagggtgattcccaggagggctgcatggaggaggaggctttgacctcggctttgaagaataatatgagtaggtgaggtgacagttggaaggggcaaccggcatttcccaggtacagccaggctgcctgcgaacaaacgcacacaggcgagcagacagagtgggcctctcctgggaggagagaagctgagagaatgcctgggcgcctccagcccaggccaagcctcgggaggttgggactcctggtgcccagcagggccctggaacactcgtgcaccaagctcagggagatttatagctcaatttagttcctgtatgtcccatgtcacagcgagtcatttatcgagtgcttcaacttgacaacaactgaaaaattaatcccaacagcaagcgattaactctgcaaggggatcagatgtctcatttcccaggctctaatctccaggcattcgtctatgaagcgattcgtcactttctacccaagatgacacaggcagaggctgatcctgggcaagccgcgggccaccatgggctgcctctggggctcgtcgctgggcgtcattaaacctgtggctcgagggttctccgtggcgcagggggccagtgacggacacagcctggggtgcaagggagtcaccgtgtccagctgcatcgggacgttttccttacacacgtgtctcaggacggagggtgactctggtgcccacctgccctctaagctggacccagttccggaagcctctagtcgtcagcttgggctgccctaacagagcacagacagggcagcctaaaccacagacaggctggaggctgaggtctgagagcaacgtatctcagcgttggctcctcctgaggcctctctccttggatggccgccttcccccgtgtcctcatgtggtcatccctctgtgcatgtctgtgtccaaatcccctcttaaggacacagtgatatcggattaaggccccctctaatggcctcatttgactttaataatctcctttatttttttttgagacagagtcttgctctgtcaccaggctggagtgcagtggcgcgatctcgtctcactgcagtctctgtctcccaggttcaagcaattctgcctcagcctcctgagtagctgggactacagctgcccaccaccacgccaggctaattttttttgtaattttagtagagaaggggtttcaccatgttggtcaggctggtcttgaactcctgacctcaaatgcttcgcccacctcggcctcctaaagtgctgggattacaggcgtgagccaccgtgcccggcctgatcttaatcatctctttaaagaccctgtcttcaaatacagtcacattctgaagtactggggattggaacgctaatgcatggatttttgagggacacaactcagctgtgacgatccccagcagccccctgccatcctgactgccggtcccagctcctgtcctgacagctcagtcactggaacactcagccacgtgaggtgcaggagtgcagtgggacgcacgtcaattcagggtcaggagcctggcacccgggctctttcaccgagggccatgcgatcatcagcaagacgcttctcctctctgggggaacatgcagcagaacaagacaatgtcagaggtttgcttctgccctgccacttgagcttccagtgatgatctgcgtgacatagggttgaagtcaggatgtgtgatacatccctatattagttaacaccccctcagtgaataagagcccagtcacatcaggagtcactcctcatccaggtggggttgggataagctcacttgcaatgggtgattcaggggtccctgcgtgtgccgcagaagaggctacaggcctggtggacaggaagtcagcagcaatctgaataaagtcatgaaagagaactcgaaatggcctggggtcgctgaccggactggctgcaggaagtccccgctggggatgacaaccttgctttgccttctcctttgtggggagcagatggtaggaacagcctgtgctgataggggaggaactcccgagtccagcccctgtccccagaaaacacaacatctgcaaccctcccctcctgataagaaatcacaggcacctccttgaccctccaaccacttctagaacattccattcccctcctaagagcctggctttgatgagcccccaagggggtccagtctcagatggcctcaaaagtcaatgcgtgctcagatgatcacccacagtgcagcttcagggagggttccagagcggcctcttttccacctgttctgtcctctcggataatgggttccccttgtaatcctggattccaccatgagtcaaagcttgcaaggacctacctgatcttattttaacaaagactttatattttggaacatttttggatttacagaaaaattgcactgcacagaaagttcagagttcccagattccctctcctcccccctcccccaggttcctctgttagtaacaccttgcatgaatcggctgttatttgttgcaattaatgaaccgatactgacacattataattaactaaatccacagtcatcagagggttccttctgggcattgtatattcgttggttgtaactatctataacgccccgttcccccactccagtgccatacagaagagcgccactgcccaacaatggctgtgccccatctttcaccctccctgcccccaatccctggcaactgctgatttttcactatctccatttttttttttttttgagaatgtcatatacaggcacacctcacttcattgcacttcacgaacattgcattttttttttttttaacaaatcgaaggcctgcagccaccccacagagagtcagcccatcagcaccattttcccaacagcacgtgctcactttgcatctctgtgtcacatgttggataattctcacaatattccaaactttctgtctgttatcgtgatctgtgatctatactttttgatgctactattggatttttttgggggtgccgtaaaacacactcaaataagatggtgaatttaatcgataaatattgtgtgttctgactgctccaccgactgtccactcctccatctctctccctctgtgcaggcctccttactccctgagacacaacactattgaaatggggccagttaagaactctacaatggcctctaagtgttcaagtgaaaggaagcgtcacacatcattcactttaaatcaaaagctagaaacaattaagcttagtgaggaaggcatgttgaaagctgagacaggctgaaagctaggctttttgtgccaaagctagccaagttgtgaatgtaaaggaaaagatctagaaggaaattaaaagtgctactctgggctgggtggggcggctcacgcctgtaatgtcagcactttgggaggccaaggtgggaggatcacttgagccctcgagtttgagaccccatctatatgaaaaataacaaataaattagctggacatggtggcatgtgcttgtaggtcgcagctactccagaggctgaggcagtggatcacttcagtgcaggggtttgaggctgcagtgagctgtgaatatgccactgcattccagcctgggtgaaagagtgagaccctgtttcaaaagaacaacaacaacaaaaaagcgctactccagtgaacatacaaattatcagaaagtgaagcatcctcattgctgaaatggagaaagtttcagtggtctggatagaaaatcaagccggtcacaacattcccttaaaccaaagcctaatccacagcaaggccctaactctcttcaagtctatgaaggctgagagaggtgagtaagctgcagaacaaaagtctgaagctagcaagggtgattcatgaggttgaaggaaagaagccatatccataaaataaaagtgcgaggtgaaacagcaagtgctgatggagaagctgcagcaagttctccagaagatctagctgagatcactgataaaggtggctacactgaacaacaggttttcaatgtagcctgtttaggttagcttcttttgcttaatgatacggatttaagtttcctccatatattttgtgactcaatacacctcatttcttttttatgcctcgatagccatttcttttcattgctgaatacttttccattgtctgaatatatcacagtttgtttgaccactcacctactgaaggacatccaggctacatccagtttttggcaataaagctgctataagcacttaacgtgcagcctgatcacatttattttctctctgtctctttctttctttctctctctctctctctctctctctctctagctttcctttatttttttgtcttgctctgttgcccaggctgggttgccaggatgcaggcacagttcactgtagcctcaaactcctgggctcaagtgatcctcctgccttagcctcctgactagctgggactacagggacccaccgccatgcccagctaatttttttcttttttttttttttttcttgagacagggtctcactctgtcacccaggctggagtgcagtggtgtgaaatcagctcattgtagtctcagcctcccaggatcaagtaattctcctgcctcagcctcctgagtatctgggattacaggcatgtgctaccacgtccagctaatttttgtatttttagtagagatggggtttctccatgttgaccaggctggtctctaactcctggcctcaagtgatccgcccgccttggcctcctaaagtgagccatcgctcctggcctcattttttctcattttaaattttttttggtagagatggggtcttgctgtgttgcccaggctggtctccaattcctgggctgaagtgatcctcctgcccttggcctcccaaggtgctgggattataggcatgagtcaccacacctaggcgagcctgactgtatttttacaaagccagggccataaatgtagtggcattgctggtgtgactcagaaggacccaaccacttccatatttcaagtgctcaccacataccaggcattgcactaaaagcctcattcattcattcattcattcattcattcattcattcacctcttcactcaatatttaccaagtgcctcctagatgcaggctgtgtcctgggtgctgggaatgaagctatcaactggcctcaggatctcacgaattacagacaaaaagcaagcaagcaaacagatgatcacatgtgagttccagggcggggactgaacccaggccagcccaccctgaggctcttgctgctaaccaccacctcctcctaagaagggactcacatggagggcgttccatatggaagcttccagacagatgttctggatgctcagcagtgggggaggagcccagatggagttggcagtcctggctctgaggctggatgtgacccttgggaggctcattccagagcttgatgtcggtcttgctgctaaagccgggagcagggagcaggctggcagcaccgcggggccagggcaagagctgacagtggggcctgggggagctgtgggtggggggccctcacagctgtgtcctccaagattcccacagtctggaaggacaagcagaaagccccctgacctgggctttcctgtgcaaaggcccaagtggttccggagatccccagtgatcccgaggaggctgggcctgcacgtttccaacggacaagcggctttcttcatgcacacagctgcccagtgcatctgagcccacctggaccctgcagctgggctttctgcagccacagctcccaggcgtgccgagccggggctgagtcactgctactatttgaacactttccccttcaaaatgacagtctttggcaaatatgttaaataccaattgagaacaaatgccaccaggaactctgatcatccttcatctgctgagcaaggaaatgccaggggagaagggagaggaggcgagaccgtgagggggcccggggtccatgctctctggctgttccgtggcaggggtccagctgcccaccaaggaggcctgggtctttctggggattctcggagaggttctttctatctggaggtgtgcgagggggagccccctggccccccgactggaggctcattcacctgcccactggggcttcggtaggagcgtcaggccatgggcttgtgggcttgatgtcatgtgggggacacctgtacctgccctctggacaatgccacgggagctctcagcaggaagggagcagccggcttccccctgcgtcagcatcgggctcagcccattcggcgtgcacgacccagcccagtcgtgcctgtcaccgccacagagctggccttcaagacagtgcctggacagagcttcggagctcaggctggagccagcctgccagggttccaagcctggatctgccagctctcacttggatggtcttagacaagtggcttacctctctgtgcctcagtttcctcgtctgtaacacagaggcaagatcagtgctcccccatggggatgctagctgggaggccacgtggggaggtagtcagtccagggcctgatgcaccttgggcccctgagttttgcagagagccagattctacacttgggcactgggtgagtgaaccgaaagagacaggactgtgcacacctgagcgggaggcgaccagaaagacacactgacggcccagagcgcagggatgaggcagctacaggagagcacaggagggctccggcttcctggaggacgtgaaagaaaacagcagcacagctgctgcatggagagaaagcagcccccgttggagtcggcctgcagcgcgtctgcacacggaagagagatgtgctcggggcaatgtgcacacacacgcctcttaataacgatttcctcatttcggagactcttaataacaattttctcatttcacagacgctatatttttttttccaagatggagactctttctgtcatccaggctggagtgcagtggtgtgatctcggctcactgcaacctctgcctccagggttcaagctattctcctgccttagcctcctgagtcgctgggattacaggcacctgccaccacacccggctaattttttgtatttttagtagagatggggtttcaccatgttggccaggctggtcttgaactcctgacctcaagtgatccacctgcctcggcctctcaaagtgctggcattacaggcgtgagccatcacacccggcccatagaccctattttttttagaacacttttagctttaccaaaagaaaccaatgcagagagcgttcagagagtttccacacaccacgcttctttttctcacacaaatagcaacacagttaacagtctgtctgctcctggcttttttcacctcaaatcacttactcgggagatcattccctagcaggacccccagagccgcctcagctttctgacagtggcacggcactcctcacactgggcgctccatagcttacctggcccgcgctttcctggggacacacctggacaagtagagctgtgggatccagtcctgttagcacagaggctgggccagagggcatctgcatcgatcattttcataggaattgatgagctgtcctccaaggaggacgtgcatcgtaacctctccccaaaacagaagacggtgcgccctgcccagtcccctcctgcccaaatggtagatgatcagactccaaaaaaagagccctcacacaaaacagccctttcctcttcctgccccagaccacccatattctggggggttgctttatttatttatttatttattttgagacagagtctcactctgttgcccaggctggagcacagtggcgtgatctcagctcactgcagcttccgcctcccgggttcaagtgattctcctgcctcaccctcccaagtagctgggattacgggcacacaccaccacgccaagctaatttttggatttttagtagagatagggttttggcatgttgaccaggctggtctcgaactcctgacctcaagtgacctgcccgcctcagactcccaaagtgcttggattacaggcgtgagccaccgtgctcggcttggggttgtatttcaagtggagcagaatgtcctggatcctctggacaccccggtgagtaattctatatactagcaaaaaatgatcacaaacagaaattcgaaaatacctctaccatatcttcaaaaaatacaaactaggaataaatagaacaaaagatgtgccaagacctgtatagcaaaagcattaaacatggctgagagaaatggaagatctcaataaatggagaggttttagatcatgtggcaggagactgaatctctcccaactggatctatggactcaatgtaattcctgtcacatccccagtagggttttttttttttttttttttttttttggtagaaaaggacaagctgattgtaaaattcatgggaaatgcaaaatatctagagtaagcaaaacaactgtaaaaaaggacaaagttggaggactaacttgacctgattccaagactttttttcgtttgtttttttttttgagactgggtcttgctctgtcacccaggctggagcgcagtggcacgatctcggctcactgtgacctccaactcccgggttcaagcgattctcctgcctcagcctcctgagcagatgggattacaggcacccaccaccacacccagctagtttttgtatttttagtagagatgggtttcaccatgttgaaccaggctggtctcaaactcctcaagtgattcgcctgcctcggcctcccaaagtgccgggattacaggcgtgagccacggtgcccggcccacttactataaagatacagtaatcaagacagtggcaccaagctagacaaatagataatggaagagaaaagagagcgcagagatagccccacacacacacgaagaacgggtttttgataaagggcaaaggcaattcaacagagtaggaatctgcaggattcttcctctctcatttctgctgttggctatgtgtgtcttctcttttctccttctggatcagcctggctagaggtttctatttttttgagacatggtctcactccgtcacccaggctggagtgcactggtgtgatcatagctcactgcagcctctacctctgaggctcaatcaatcttcctgcctcagcctcttgagtaactgggactacaggcatgtgccaccacgcacagctaatttttgtatttcagtagagacaaggttttgccatgttgcccgggctggtctcaaactcctgagctcaagtgatcgcccagcttggcctcccaaagtgcatcgattttctcgacgttgccaaagaaccaacttttggttgctccattttccttgtttttctattttctatgtcattgattgctgtgagcttaatcacttcttctgcttgcttgttgttgttgttgctgagacagggtcttactctgttgcccagactggagtgccgtggtgcaatcatagctcactgtagcttcaaacttctgggctcaagtgatgttcccacttcagccttcagagtagccaggactgcagacgtgcaccgtcacacccagctagtttttaactttttgtagagatggcagggggggtctcactatgttgcccaggctggtcttgaactccttgcctcaggtgatcctcccatcttggtctcctaaagtgttgggattacaggagtgagccaccacacttagccttactttggttttaatttgctcttttccttttagcttctaaaggtagaagctgaagcagtgatctgaggcctttcttcttttctagtatagatattttgtgccagaaatgttcccttacagacactttagaggcattccacacattttgatatgttgtactttcattttcatttggttccaatattttctaatttcccatttgatttctactttgatcccggtgttatttaaaataatactatttactttcctaatatctgggggattttctagagatctttctcttactggtttctaatacgattccgttttggttagagctcacatctgtatgacttgaatagttccaaatttattgagacttgttttatggactaaaatatggtttatcttaataacccttccaagtacacttgaaaacaaagcacagaggattctttccacaactgtcagttaagtcaagctggttgatgggtttgttcatggtttcctatatcccggctgactttctgtacacttccatcagttacagaaggagaagtgattatacttgtagttttatttatttttccttgcaggtctattttttgcttcatgtattttgaggctctgttattaggtacatacatgtttagtgtttttaatgtccttccatagaactgacccttttaccataatgaaataaccttctttaatactgttaacattctttgttctaaaatctattttgatactaatatcgtcatcccagttttctttggattagtgttaatgtggtatatgcctttccaccttcttacttttaactcttttgtgtctttataattaaagcgagtgctccttggaggtgagcatttattcaacttgaagaatctgcccttaaaataagggtgtttatatcgtctgcatttaatatgtgattattgataggaagtttaactctgtcctctttccattttgcttttcatttgtcccttgtatattttgcccacccccgccaattctctcattttctgccttcttttgggttgataatttgtttgtttgtttgttttgagacagagtctcgctctgtcactaaggtggagtgcagtggcacgatctcggctcactgcaacctccaccacctgggttcaagcgattctcctgcctcagcctcctgaacagctgggattacaggcacccaccaccgcgcctggctaatttttgtatttttagtagagaggggtttcaccatgttggccagcatggtctcgatctcttgatctcgtgatccgcccaccctggcctcccaaagtgctgggattacaggtgtgagccactgtgcctggccgggttgataattttttatgattccattttatttcctctgtcaccttatcagctattattctttgttttgttatttcagcagttgctttagaatttatatttatagtagacacccttaacttatcactgctgatgttctaccacttcgtgtacaatacaagaacttacaacagtacacttccactcttcccctcctagactttgtgccattgttgtcacacctacgatctttccatgtcgtaatccccaagctacatttattcttctgtttaaagacagttatctttcgaaagaattaaacaaaacaaattttacatatatagccatgcagctaagtccttccttccttggtgtatttccatctgtggtcacttttttttttttttttgagatggagttttgcttttgttgcccaggctagagtgcaatggtgtgatcttggctcaccgcaacctccgcctcctggattcaagtgattctcctgcctcagcctcctgagtagttggcattacaggtgcatgccaccacacctggctaattttgtatttttagtagagatggggtttctccatgttggccaggctggtcttgaactcccgaccccaggcactgtctttttatctgaaagacaacctttcatattctttatagtgtacctgctggtgatgaatgattaaaccttttgtatttttcaaaagtattttacctttgttgaaataattctgtttgaattatgttgaaataactctgttgaataattctgttttttcttctctttcaatactgtaaaggtatttgtccacgatctgctcactggcattgcttctgacactatgcctgctgtcatctttctctttcgtcttcatgtgtcacgtgtccttttatccccatgtggctgcttttaacatatttgtccttatctctaatttggagcaatttgaatcctatgtgcctgggtgtgtttttgtttctttttctctcatgtgtcttgtgcttggagtctattgagctgcttgggtgtgtgagttcattgtttacttcaaatttggaaaaagttccctcattatttcttcaaatatttttcttttcttttctttttttttttttttgagatggagtctcaccctgttgcccaggctggagtgcagtggtgcgatctcagctcattgcaacctccgcctcctgggttcaagagattctcctgactcagtctcccaaatagctgggattacaggcacccaccaccatgcccagccaacttttcatatttttagtagagatggggtttcaccgtgttggccaggctggtctcgaactcctgacctcaactgatctgcccgcctcagcctcccaaagtgctgggattacaggcatgagccaccgcacccagccttcaagtattttttctcccctccccctacaatcgccccctcttcagggactctacttacatgtatattgggctgttggaagctatcttgcagctcactgactgatgttcttttaaaaagaattctttttttttctctgtgtttcactcaggatagtttctattgagacttctctgagttcactattactttataacatttaatctaccctcgatctcatcctgtgtatccgtcatctcagacactgtggttttcatcactggaagtttgatttgggttaaaatgtaaagaactgctttatgctaaaatatatacaacaaaatttatcatattaaccatttaaaaatggacattccagtgggctttcaaaatatcttctgtgtctacatttaactttttggacatatggaatacagttttaatgattcttttaatatccttgtctgctaactctaacatcggtgttaatccccagtcaattttgataatggatttttctcttccttacgggctgtattttcctgcttctttgcaagactgggaatttctgaatggatgccagacatcatgaattgtacttgttgggggcgctgggtagttctgtatcctggtcttgagctttgttctgggtgtagttaagtcacctggaagcagtttcatccatccatccatccatccatccatccatccatttatttatttttgagatgaagtcttgctctgctgccaaggctggagtgcagtggtgcgatctcggctcaccgcaacctccgcctcccaggttcaagcaattcttcctgcctcagcctcccgaatagctgggattacaggcgcgtgccaccatgcccggctaatttttgtatttttgtagtagagatgggatttcaccatgttagccaggttggtcttgaactactgaccttgtgatccacccacctcggcctccgaaagcactgggattacaggcgtgagccaccacgcctggcctcaatgtcttcaatgtggatgttcttccagtctctgcctgagttccctctccctgccccacagcctggaaacgctcagtgcaagaagctggggcaagtatagggctcatcccatctgtttctcatgctttagtgatcactatcatttattacctggtgtctggttgtaaaacctattactttatatattttatcttttctttcagttgtttcatgaggaaaggtaaatccagtttctgtttctccatcttggccacaagtagaagttggagcagaagtaggcattattattattattttttttaattttcaagttccttttctaatggaaaatcgcaaacataaagcaatgtaaagagtaatactgtattagtctgttttcacgctgccgataaagatatacctaagactgggtaatttatgtagaaaaaaaggtttaatggactcatagttccacatggctggggaggcctcacaatcatggcagaagggaaagggcatgttctacatggcagcaggcaagagagaatgggagccaagagaaaggggtttccccttataaaatcatcagatctcatgagacttgttcactactatgagaacagtatgggggagaatgaccccatgattcagttatctcccactgggtccctcccacaacacatgggaatcatgggagctacaattcaagatgagatttgggtggggacaaagccaagccatatcaaataccatgatgagctccatggtctaccctgaagcttctgccatcgtccatctcatcgcattatttttaataagacaaagaccacacttccctgactttacaccacctcacttctcagggatgctgttaagagttgaccccaaatgggagtggaaaagtgacactgcaccctcgcaggacagggatactcccctcatcaaatccagggctgggaccacagtccccagtccccaggctcattcgcagaagcatggctcccactgtctgaaccgcaacatggttgccaagactttccactctgagtccttctgaagtttgcagtcacaattgacaagatatgggtgacattgatcctgaaaaggaagaaattctggtgtttctaagagtgaaatttaccccaccctgcccttcccctcccgtgtttgatggtgagtgtgccccgagcagctatcctggcttgcacagatactaccagagcagacaagggtgattaacaagtaattcatttagtctccatcataaccacttagcaatccatttcctctctatttcctgttcagagacctttggatatgccaatctgaataattgattggagcagaaaagcctcatgcctttgaagtccctcattaattacctggacaggaagaaggaagaatctctactcagccacaaagcggctaaacacgatcaaagaaaccatacccggctttgatggttccctccgttagccagaggcaccatttcccctcgaggctggaggaatgcttctggaaccctctgagctgctgctgaatgccaccaccattgttatcgggtggtgccaccatctactctaagttaaacacaccgggctatgattgatggagaggtgtctgcagagcatctgttatgaagctgtgattggctaaattgtgtccctcttaactcctatgctgaagacctaacctccggtactcaagggtgtgactctatatggagacagggcctgtagagaggtaattaagttaaaaggacatcatgaggatgagccttaatcccggctgactggtgtccttataagagctggagatgaggccgggcgtggtggctcatgcctataatcctagcactttgggaggccgaggtgggtggatcacgaggtcaggagtttgagaccagcctggccaaaatggtgaaatcccgtctctactgaaaatacaaaaattagccgggtgtggtggcgggtgcctataatcccagatactcgggaggctgaggcaggagaattgcttgaacccaggaagtggaggttgcagtgagccaaggtcgcactactgcactccagcctgggtgacagagcaagactcttgtctcacaaaagaaaaaaaaaaaaagaactggagatgaggacacagacacacatagacagacgactacgggaggacccagggagaaggcagcgcctacaagccatggaaggaagacccagaccctgagacaccttgatcttggacttctggactccagaactgtgagagtcaacgtctactgtcccagccaccctgtctgtggtgctttgctggggcagcccgaactaagacagatgccacaccctggaatagctgcagggctgggagggaagctgcagacaccctatgtatttgtccaacccaaacacgtcaaatggactgagctattcaaaccaaaactcagcgaggagacgggcaacaaaagagttaatggggagacaggatgtgaaatgggtctgggccatcagctgatggccagtactggaggctgggtgcaaaactgccgtgaggccagcagcggggtggtggagtctggctccgatcctgcctgcaatggatccagtgaaagggtcagggcaaagcttccaacaaggataacctagaaagcaggcccgcaggcagctgtagctgcagcctcttccgcgagacttaagctgaggaggctggagccagggatccttcgaggggcggcgccgtctccagcaccaggaagaatcttcacttcctcttcgaaaccgccctggaagtgagcttagggacagagctcaggcaaggcagtgcctcactcggtgggtgaagcctccttgcctctctcacagctccctgaaagctccttgcagagaacttctctgtttaataacctcggaaaagcattaaaagcgagtctgaagaactcatttaatggattcttggaggcggctgcaatcctcggagctccgtgaagctggggaacttattcttggtggagcctccagctggagagaaactgtttgaatttccccaaagccaattcgagttgttgttccttctgggaggatacatctcccagcacctcccctctcccatgtgggcagcggattcctgccccccccgcccacttcctcccggccgggagctgttcttttcagcaaagccacgagtagcaggcaggggcgccccaggccaggcatggtccgtctggaagaagccaggttcagggagcaattctgcaagataaaccaccctctggagggtgtggctccaagactttgattctttgagccaccatggctagacagccccctccttcctttctgacagaggacttgagcccttggcaccgcaacccagctgtttatagatggctgagaagcctgcctgtgtccagcaagagtgcagctgtgtggccagtggactcagcatccacgtccgagggactgctcacgttctctgaagatgttcaaggctgcccatgtgccctttccccgttttcaggcatgcagcatgcaggccccactcctgccgctggacttacagtgaacggagccaggaaagcgaatctgccttgacttgtcctggattctgcaggaaggccccacctgaaccacctcagtcccacagagagggggatcctctgtcctctcagggccaatcggactgaggacagtcccaaacccccgggccatcccgagcctaagtgtgtagtgaccccaggggaggctggtggctaagccatgccgctggggtcctggggggtcaggctcgggagcgtctggggtgatcctgctcatgcgcctcatggacgcatcttgccccggtttccaggtgcggtggagcggggagctccggggctggcagagtgagcagggcctgggtcctgagggagaaggcggctcgtaggctgctgtgctgggcagagggtggatggcggggttgaccaacgatgaggccccaggaagagaggcatgggtggcgctgccggccgcttccccatcttacctctgctggtgccgcagccctctcctttctgtggcccctccccacgtggaggataccgaggaggttaggacagccctcgggctcaggagtgcccagtgacccagtcctggccaatcaggggttcccgtttcccaggccacagtgattggttgagggatggtcatccaggccaatcagaatcctgcctgggtttttcctctacatctactggggaagatgctctcctgtccctggggggctgtgatgctggcagatgtgtgagcacggagggggttcctcagcccgggaaaaggctgaggccggcacaaagaagcaagggcaggaggtcagtacgaggagacggggacgacggtacagagcaagacagagacactcaccgagacagagacacagagacatagagagagagagagaagggagtgagagacagagacaggcccccagcaccattgtggactcctgcctccagctgttgagtctccccctgcacattattcacctatgaaacttgagctgttcggttgggcctcataagctgtcgctacctgactgttttttgacctataaaaatggcagcttcacaaggcttgaccgaatgacaagagggaacttctgtggcttgccgccgagagtcctggagaaagtaggtttggctggcggccacgccgacccgcaggagtcctgcccctttgaagcccttccctcttttagatctgccgggtttacaaggggcccaggtcgctcccgttcttgatgattaattttctaaaactggtatttctaattcctgatggtagaacttcaggccccagcgcctccctagggtgcacgcgtgggtgcccctgacccaggatggatactgtctggctctctttaggagctgtggtcaaaggtacccctgcttgctgcaggaccaggaccggggtcccactgccaggctccccagggaggccttgccctgaaaggggccctgggcagcccgagctgtgaactcctcctttggacagggctagctcctcacctgctctgctgcaggcccgggtctgcctccacagctgcggcctccagtggtgtgtgtgggctgcagcttcagacagggtcaccctccaggatcactgcagcccagctggctccatgagagggagtgccaaggggctggaggatgtgggtgtactggagtggggagtggggagtggggaatggggtgtcatagaccgaggccctctgggaatcaatgcccactcacacccggggcccacacccaccagggcctcacactgagctccctgtggagctatgggtgcagttccagggacatacactgcttgtcacccaactggaaatatgggtggggctctgagagtggacagtttcataaatcttgtagttatcttgtgcataacataactatgctgcatcttgggggtcaaagcactcctgtgcggtggtgttcatgggtgttagcatttctttcttctgaagcaatccaggaggctcagaaaaccacagcagctgggtcctggaggcggattctagggaatgactctccctggcttcccccaaggcctctctgaccctgtccagcctctcccccactccctggaggtcaggagtgtccactctggggtcaaggctgggctctgcatctgcacccgtgtttgtgactctccattgccctgcagaagatggcatttaatcctccccgctgcgggccaaggacagtgttgtgagcatgaagtaagcatcaaataccttgtgggtattcaccttagaggctgagtgacttccggtgatccacagcccgaaaatggaagggcagagaatcaacgccaggctctcggctaggccactgggcccagccaggccttctgcagagaaagggcatggcagcaggtcctggatacttggataccatcgtgctactttttctttgaaataaaatgttcattttccagtataaaagtctagatgctacccccaccatgtgccccaccccagcaatagctggctgagctggagtggtcccctgaccccacaggctaatacagtggccttgggtctagggaggagaggtgagctgagcctagcaaattctgtccttggggcagaaccaggggatccaggtgtctgtgcagggagctcagttggaggcccctacaggcaagggctgaggtcgatactggaggagtcggcaaaggagggtggtgcgtgcagggagaagtgatgaaccctgaggagagggaggggtgcggcatcagggggccccaaggaggagtggagacgaggggagagggaactggaaagcgagagaggaggaggaggggtagggctgggtgctgtgggctgaatgtccatgtctctgcaacattcctgggttggaccctaacctccaatggcatggtgttgggggtgaggcctctgggaggagactgagcccttgtgatgggatcggtagccttataaaagggaccccagagagctcgcttccactttctccctctgccacttgagcacagcgtgagaaggcggccatctccacaccagggacaggccctcgccagaatccggccctgccggcatcctattctcaggcttcagcctccagaactgggagaaaatcaacccctgttgggttttgagacggagtctcactctgtcgcccaggctggagtgcagtggcacgatctcggctcactgcaacgtccacctcccaggttcaagggattctcctgcctcagcctcctgagtagctgggattacaggtccccaccaccatacccggctaatttttgcatttttagtagagatggggttttgccatgttggccaggctggtcttgaactcctgacctcaagtgatcctcctgtctcggcctcccaaagtgctcgaattacagccgtgagccaccatgcctggtcacccctgctgttttgaagcccctccatctagggtattttgccctagtggatttagctgactcagacagaagggaagggaaggaaactaagggaggagagagaagagggaaacaaggagagaaagcccctctgttccccacaacattccacttccggcttcacagaagacacagggatggttggcaagaataagaaaagaggcccaacatcaggggtctccagggaaatgtgagctaaagtcacaatgagacgccacctcacactgttccaaatgaaaaagacggcacacaccaagtgccggcgaggcccaggagaggctgacccgccacacgtggctggcagggatgcaagatggtgaggctgctttggaagaccgcttggccgtctctcaaacttacacatccatctatcacgtgacccaggctttcctcttctgagtatccaagagaaatgaaggcacctaactaccccaagtctagtgcatggacattcacagcaactttatgcgtggtaggtcggagtggctgcaaccaaacgcccatcgatcgtgactggtcaccaaattgtgggccatcgacatgatgacggcccatcactcggcaacgcgaaggaacggactgccggaacacacacgcctcagaataatcacactgcctgagaggaaccaacccaaaaaatagcttcagtcgcgtgactccattttatgtgatgttctagagggtgcaggctgctgtgatgtgacggagctgggcggtcactgcagcggtgggggcggggcagggctgtgatgtgagctgggtggtcactgcagcggtgggggcgggggggctgtgatggagctgggtggtcactccagcggtggggggggggggcgggggcaggagcaagccggctggtggatggacttgtcaccttgaccttggcgatggtttcccaagaatacacacgtgaaaacttatagaattgcacactttaaatatgtgaacttgactggacattgattatgccccaataaagtttttaaaaagtgtatcatgatatgaccgataccacaggagaggttgccccatgtgtctgtgtgtgtgggggcggggggggggtggggcatggcatttgatataaagaaaataggagttactgggaccaagacatgaagatgaccccagtggcccctcctacattgaccagatcaagcttcaggttctgggagagagctggagtccacatcccacgcaagcccctggctgcccctgagggtgaggaggggaaacggggcgccagccgatgccccaagcccccaaccccacacctcacttcagccaacggccacttttatgttctgtctgacttagagtatgcaaagtacttctcacaccgaagacttcaaggcacacttaccatcctggtgacagcggaacccgctgggggccctgaaaggcctgggctgatgatgtggtcttgggctccacaccctgccccaggggcggatggcgctatgccagtttctctccagccaccaagacccatgcacctggcccccagcccgggtccttctccaaacatggacacttctcaggaagtctgatctcctcctaccagcgccgagggatggccaagcccccagcatggtgctgatggagaactcggccagttcctcttgtctatgaccacagggctcacagcactcatggcggcccctgcccaatctctcttagaccctgcctcagtttaccctgctgatcaatctccagatgggccgacacagactgcggaggtgtggcccaaagccagcccatgcttgtttggggcctttcttctgagcttccccacactccccacagcctgctgggaactcataccacagggcactaaattccccaccttccccactgggagaggcaacatcagggtagggggtgggggtctttggaggcaggagaacaggctggcttgatgcctgcttctgctccatcccagcactgcaactgtgactgatcacctaatgtctcccattcattcattcagtcattctttcactcattcatctgactctggggccatggctcctcccattttcacacatttgcactttgccaggggacttctagtgactgtccctttgcccatgggggtggcgtgccctgaagggtcccctccccttctctgactctgcatgcagccctggctccaccacggagcaggaagagaaggaggggctggctctgatgggatccaccctgtgcactggggaccaggccgttctgcagcatggagcacagaccgggggtctcagtctatgaactgggggattaggtcacatgtttgctgtagtgcgaggacacccaggacatggaagcccctctgaaaccattatggttggcagccttacaaaactctgaccccaaacctcgctgcccggcaagctttctttgctttccttccccatcctcttcattttgccatgatacccggaggctgagcagagaggccccgctatgagtcccatctgtccttcaggccctgcccaaccatccccatccccacactcacacacaggaagccacacacacaaagggcacatttctgtttcaaagccttcattgcagctgatcctctgcggtgcattcaagctgggccctccttgctccctgctctgggtggggacaaggacatcacactgagtgggaaggacactggggtccaggccaagccacccaggcgggcagcagaggaatggtcacccaacggtgactgtcaaagtacaaaggccagccggatgtggtagttcacgcctgtaatcccagtactttgggaggccaaggtgggcggatcacctgaggtcaggagattgagaccagcctggccaaaatggcaaaaacccatctctactaaaaatacacacacaaaaaatcagctgggcatggtggtgggtgcctgtaatcccagctactcaggaggctgagtcaggagaattgcttgaacccgggaggcagaggttgcagtgagctgagattgtgccactgcactccagccagggcaacaaattgagactctgcctcaaaaaaaaaagaaagtacaaaggccaacagagtcagccccaaagcggggacacagagtcccctggggtggggaggagacaccaggcttttctttatcattccctctgcctccacctttggtgtttccacatgtgttttgcaatgtgtgagcgctttacagactgcaagtaagtcgacactcaggtggtgggtggggggcgcaggatgagatgtgtggagactctagggctgtgaggtggctgctgactggcttctgcatagcccccgcccgtggtgggtgatggggtggcaaacttggggggcgtgggctggatagggtggaggatgctgagctcctgtgaggttcctcggagctaggctggggccctggtaggttttaattccttacggcagaatcccctgggccgtgctgcagcctggcagtgtcaggggctcagtaattatttgttggtggagacacctgagcattgagagtcaggaatgagcttcggtgtgctgcatgtcccatttcccagagtggaaatgtgttcccccctctccccacaaggagagcatttcacgggcttaaattttggcagacagactcttggaatctgagcaccaggccatttgtgtctacggggaactacctgtccctcagcacttcttacaagccctttgttgtcacaggtgctgggatgcagacgaggaaaggagaggctgggggtacagacacggaagctgcaggtgaagatgtggtgcagagccctcctgcgagggacagcaagcggctgcggcagaccccatgcacctcctggggagagagccgtgccagtggggagcactggacttagagtcaaaaaacccacactcatgcctgtaatcccagcactttgggaggccgaggcgggcagatcacgaggtcaggagatcgagaccatcctggctaacatggtgaaaccctgtctctactaaaaacaatacaaaatattagccaggcgtggtggtgggtgcctgcagtcccagctactggggaggctgaggcaggagaatggcatgaacccgggaggcggagcttgcagtgagccgagatcttgccactgcactgcagcctcggcgacagagcgagactccatctcaaaaaacaaacaaacaaacaaaaaaccccacactcccaggcctaactctgcccttaccagcctgaagaagctacctggctctcccagggcctccgtttccccatcagtaagactgggatgcccagggctgctgtgaggcaacgaaagcccctgcaaacaggtttcatcatacccttatccctcacttttctcccctactaaatagggcagtagtgctgccaactctgagggactgtgaggggggccatgagtcagcaacaaggacacagcaggcaggtggtaaatgcctggtgagtgctggtggctctctagaaataatgagtatcacgcagttagcggaaggggtggccaggacactgtgggagcccaggagagcgcccgtcctgcacctgccacggaggccacgccgctgtctccctccctggggatgagctcccccagtgtccccagccccacatcaccagacgccagcctcttccctcagtctggatacagtgacacagacgtgacaccgtggagcccagacagccccaggaggactcgtgatccccgtggggtgagaggaaggaagagtgactcagagctgcatttttctggaaagcatgataagggatcatcagtgtcaaaaccccgagctccaggcaggggccatgatttctccagtgaccccaagaccaccaggaatgacccaaccatgtggagagtgaggagggccgtggccacgcctgtctccttggtggagccacttcatggcacccacggaccacgagacatctctgggctggggaaagtcacatgattccctgagcctcaattccactgcaaatggggaccaaaagccacaggcgggtttgcagaattgagccaggtaacaggcgtggggtcctggccagtgaccacccccaggcccacaggcactgctgctactccttttgcaggggaatcatcctttcctgatgtgcacaaaatagatgaggcaacagattgatttgaggggccaggactggtttcccacccaggcccacccccacctgagcattcaggcactggactcgtggctccctgccctggctgcactgtaccccacagccaggtgggctgataaacggaggtaaactgtgggtcaccattcctgtgttacagtcccgacccccacaacctcagaacgtgactgtatttgcagatagggccttgaaagagctgattaaattaaaatgaggccattagggtgggccctgacctagtaggactggtgtcctttaaggagatgaggacactgacacactggtggggatgacctgtgaggggacagggagaaggcagctgaatgcgagcccaggagagaggcctcaggaggaaccagccctgttccatcttgatctcccattccagcctccagaatgtgagcccaccaacgtcccgtgtaagccgcccagtctgtggggcgttgtggtcagcctgagctgactcagacacacgaagacacactgacttagtgcggtgccatggcatctcatacactgtactctcgccattgcacagacagggaagcggcctacagatacggcgcctgtccaaggtaggactcgaatcccggcaggatgcctgcagggcacactgtacttcccagaaccacaacaggctgcaagaaacagagactcctgctcccccaagacaggaggaacgcagattgcttttgaacttttattccagccccgcaagagtgggtttcaggaatggcaccttccctgctcacctgaggatggtgatgttgttggcacagaaggcgaggtctcagggggacaggcgcatcacgacgcacagccttcccatcctggaccacagcattgcacggcccaagagctcgtggccacgacgggctccggaggcccacatccttcatttgcaccattctggtactgacagtggttcctcccctgtggagtagacagcgtgtccccgagaaggtggggggccctgggccacgtctcacaggcagaaccttcatctcacaccatcatgaaccagccaggtgcgtgacctcatgcttggtgtcatcgaatctgctaatttacatgaaatggagcaacaggatggcccatggaagattttagcccagttcagagataaccaagagattggttttcttctcaaagggggatgattgctctttccttggaaatgttacttattcatgatggtttagatgtcggggatgcaatgagcccagagaccatctgccgggtcactctcagctcttccctggcctccccacaggatgggcggcctccccttacagcgcattcccacacacctcagcaccagccgggcgaccccatccaccctctgcccagctgttgctgaataaagggacgtgggaacctgaacacagaggagcatgaatgcaggtgagaacgaggcctgtgctggatccaggggagtagaaacacagggctgcacaccctaggccctactctgatttattaaattaggtcttgctcagtctccaggtccagctcacccctggcaaggtggccaagggcatggatgcatccccagtccaaccctgccctgtgctgggcgtggggcatcatatttctcaagaaaatcatttccagccagtgagctcactgggctaccttagcaactacatgaaacacagatcaaagtccctcataggagcatgaagtgtccctgaaaaggcccagctgtgggacaggacaatggtggctgcctctgaggacagccagaagaggctgcagctggcactacatcccttcccttccttctgcccagaaagtggcgcttgcaggccaccccataaggcaaagcccagtcttgggtgatggtatgaatgtaagacaggcatggatgaggctgggccccaggtggcatctcccaggcctgggcggtgatggcatgaatgtaagacaggcatggatggagctgggccccaggtggtgtctcccgggcctgggccggatcccaggacccccggtgtccccgggacctgtcctgtgcaggtcagcctgctgtggtcagcaaagccacggctgcaagatgtctacgccctaatccctgggacctgtgtgaccataagccgcaaaagggactttgcagatgtgatgaagacctggagatggccctgatgttcagcgtcatcacaagcgtcctgataagtggaggaggagccgggaggagcagagctggagaggtgaggatggaagcagaagttggagggatacgctgttggctggagatggaggaccacaagccaaggaacacaggcggcctctagaaggtggaaaaggcaaggaaacaggctctcctggagcctccagcagaaaccagccctgaccacaccttgactttaggccagtgagccctgcattggacttctggctttcacaacgctaagataataaacacgtgttgctggaagccaccaggttcgtggtgacttgctgccaatgcctcagccacgggaagtgcacagctgacttctacaaggctgagaacatcagaaagccgtggacatccaccaggctgctgcgaagggacactttgcagaccagcccctcccttttggtcattaataaacaggggcgtggggtggctgggctgaggcacagcgcagccttactggctacattttgcaactgaagaccctgtaatgagccacaaggtgagagctcagccctgtaccccaaatggccccagtgtccagggggccaccagcagggtgtctctgaacatccctttgtcactgcagaccgtgccagcctccagaatgctcaatcgcgtcccttaccctcctgcaggatgaaattggaccgccaatgagcggcgtgggcctgcagcctgggctgctggggacccggccttgtctgggcagtctgggtctgctcggtgttgccagaagaaattgtgggcacctggtggcacccacgggggctcaagatgaaggaggagggagtggtgttttgccaggaccaaggacagcgccgtggcactggctcagcggttacaggagccacttcctcccactcttcaggcctgaggccgcttccccgctgctggctgcccagccagagccagggctggggcaggcgggaacagcgaggccagcaggccacgggccacatcttcatgccaccctgagaccacaaagcctgtgctgctctcaaagtctggagccagtttggctggggggaccctggggggctcacctcctgttccctctgtgggtcccaggatgctgcagcacacacgtgtgggtatacaccccacactcctctgtcactctgccctgacctggagcccaccaggtccaggggctctcaaagttctggctcttccccgtcatcagcacctaagtgttcgtcactgcgaggccttctgaggagccaccagggaggggggatgccagatctaggggcaagaggcacctggaccaagaatagattaaggttcagggcactcccttctccagaaatcaccatgaggatctccatcagggacgacggcaaaagtaagtctagcgtttgaagggcaagggaagaaaagctcttgtagtcactgaaataaaaccacaaacctgactggctgttccagtaccttaggaaaggcctctgccttcctcaaagatggcatcttcctatctgaatggtatattttgtgttacattaaggttgttggtgcttcagtttttgttactgttttttttttacttctcaccaacaccataactcactgtactttaaagctagctaggccaggtacagtggctcatgcctgtaatcccagccctttgggaggctgaagatggcagatcactcgaggttgggagtttgagaccagtctggccaatatggcgaaaccccatctctactaaaaatacaaaaattaaccgggcgtggtggcacgtgcctgtaatcccagctactcgggaggctgaggcaggagaatcacttgaacccgggaggcggaggttgcaatgagctgagatcgtgccactgcactccagcctgggtgaccgagcgagactctgtcaatcaatcaatcaatcaatcaatcaagctagctagctgaaggcaaagactgaagttggggcctggtgcacacagcagcattccatgagtatagagagtccagccctggaactggaggaactcaccccaagcctcactctgccagctctgagctgtgtgagcggtatggcccctgggaagccacttaatctctttggactatgatttaatgtcctgtagagcaaagctcctgatctcctctcttgggcacacgagggttggggccgtaaatgtttgccagctctgccccgagcctcatgcccacagaggccatcctgcctcccctaggagctgctggtcaatgggaggggacagatcccgggccaggtccagtctcctttccctgccgaagagctgaggccagaggaggggttggcctggggagacagcagacagacccagggcggagagtccaaggtgccatcagtcagagaaggccttgcaaagaaagcagagaggggctccaccccagggggccaatgccgccatcctcatgatgagaaggggcctggcattggcaccagctgaaaggaccacctaactgtccccacacatccggggcctccaagccgctaactctactactgctgactgaatgccgtggaggccgccagccccggccggatccaattagctcatgcacacatctgcaagtgacgggagggctgggttgagatgctctctgctaggcctgctcggcagatgggacccactcagcttccctgtggagtccctgagccagtgtgtccctctgagctccctatagaggcggcaggcagcagatataagctcaggtccatatctgaccagtgcgtgcaggctaggcagcgggaggatacgcaaacctctcccctcgttcactgagggtggccctggagcgatgggccttcacaggtcctggtgggcacccagtcgggtgtggggatgcagggtctcacttccgatgctgtcggggtccctgaaggggccttatcccagagatgacagccgaaaacacagcgtgtcacaggcagcatctgtgtgtgctatggtggtgttctagaagctggcggagcttcagaaccacctggggggctttagacaaatgtagaccctgggccctctccctggtgatctgagtcagtcagtctgggctggggatgggggtggggtgtgcgtgtctgatgagcaggaccctcaggtgttggtgaggtctgagaagccccaggaatcactggcagggtctgctgtgcagctcactctcctgaggcttgcagcaggctcgtggggccagggtgctgccctgtggctgggggtgcagctcagcactctgacagccacatggagcgggggacagagggaagattgggggagaatctgcatggtgcctggccctggggcaggggcactgggctgtggctgagaacatgtaagggagttacggaggccagagcggggatgccttcatctatctacgggctcaggtatggctccaaagatgggggattcccaggctgactccagaaggcctagcagcatgtccccaactgatgcaagaggtgggaggaggccttgctggcagagggagcatgtggcgagaaggtgacctggagggcaagggtacagggccaggatagagccagaagatccagccgcagaacaggggccagcgtgtggcagcagcatccacagtgccctgatcttcggggctgtggcacaggcagagggagtccagtcctgccctgtgcctacagcacagcaagtgctcggtgaatactggcaggtgcgattttcatgagctctgattcttgcaaggggctggctgacttctggctccaaggagggcagtgccaggaaagcgcagctaaatgccagctgcccagatggcacggaaaacatgcactccgggtcatcgaatcccaaattcactggggttgagccccctccatcttgagtggctcaggataaaatctggagcctgtccactccacgctcactgtcaggagcctcctaatgaaccatcgaggctgtgtgtcccttctgcagtcttttgtccacccagtggccagaacgatcctccgcaacccaacaagatctcaccatcaccccacggtataacgtctgcgggctgcccgctcctcacaggtaaaagccagcatggcccagtggcccacaggttcccacggcctggcccagccatgcctcccctctctcccttgccactctctgcagcttgctcagcccagctgcacagccctcctgcttccctctaacctctgggcatggcctgaccaccgtgcatgactctgcagccaccgcgagcatgctcctcaaggtctcatccccggccgacccccagagccattcaattatcggccgtgatggctgcctgtgactcgggtctacctgccagcgctttggctccactctgcccttggttggcccctgatgtgtccccagctctgagagtggggcctggatcaagggcacacttgcgggtctggtgagtccgaaggtaggaggtagttactaagccaggcatcctggcgctcgaatcacatgcagggctgagtctgtgttccgatcccgtgtgacaggcctatcatctgtgtcttttattttctctttctgatgctctggcatccagggttttgctgaccctggagggatggcccctcaagaatcaggcaattcctagagaaagtaaacagctcacctgagagctggattttcaaatgctaaccaactaaaacagaggccaccccacccctcctctatccgggtcccatgctcccagccactaaccctgcccccatcaccccagggctgggtaccggacagccagggacaggccctaggccccagagctctgaaatgattccagctgccaacgctaaacccacttacactgcctacttagtctgctccttcctgcagaaatcatggtaaagctcctgtccacatttcccccctctccctctgcctcctaatggaccttgtgcttccctgaatggcccccaaggcatggcctcccctacctcctgggaagagtgagttagcagctgtccccctgatccgttggtctcgccatacctgaataataataaaacctacattttaaaacactgcggtacacaggacctgcctgacaaaggatccaggaaagcaagtccctgaaggcaattgttttgtgtcattccactacatgttctgaaaagagtggcagtgctggcacggtctggtgcatgctggtgcctgagatcgtcagcggagacgcagaggcctaagggctggaggacaagcccctgagctccgtggctaccaccccaggggcttggatgcactggattttgtgtgtgggggcatggtgaataccgcctcgcagcccctctgagctggcacagctcaggccacagcacgcccactctggctcaagggaaatggtgccaggctctgggccctgggagaccgcctgactcgagggtgggctcctgatcacaggtggtccatccactggctggcaggggctaaagccaagagctgatgcaaagggcactgccaatggggcagggatgaccagtagagccagctggatgggctgatttttgaagcagagaatttgggaccagtgacaatagaacagactggcagagtggggcagggacagcatgagggaggaatggggaagcagccagtcggtaaagctgccccaggtcctcacagctctaagtcccaggccacactgccctgcaatactctccaatttcacctggcatttaacacaaattgaccagaatcattccctgttctttgttcctaataaggacaggcttgcttttatccagacatccattcatccatccacccgcccacccactcattcattcatccatgtattcacccatccatccatctctcttttcatgtatccatctacccatctatccctccatccattcatccacccaccccactacccactcatctatccatttgcctacccattcacccactcattcgtccatccaactagccatccatccatccatccatccatgcattcacccatcctctatccatccatccacttaactacccaaccactcatctatccatttgctcacccacccacccacccacccatgcatttgtccatccaattagccatccatccatccatgcatccacccatcctccccccatccatccatccacccatccttcatccattcctccatccatccatccatccaacagctatctgaactgtttaatgacaacctcccatagggagacagctgggaaaaagaccgattcaaccctgaccttgtggagtttgcaacctgcaagtgacaactgaacaagtagccacgagtgtggtgaagtttcttggagaatcgcacaggtgcctgccctgggttgtgtaacatggtggaggctattctaattagggggaaggtcagggaaggcttctctaggatgtaactgtcaggactgaatgtcgcccaggagtcagcaagggagagaggagtgcttgaggaaagagagctgtgaggtgggcagtgggggcagatcaggaagatgggaatggggtgcctcctcagggaccctctggaagaatctttaaaagctgggcacaaggatcacttgcgccttagaaggcttgctgggggcaggaggggcaggtgcgaatgagggaggttctggggccggggtcacctattggcttctcttaaggcgtggccggggctagtggcaaggagggccccaaggtgctgcatagcttgtcactcagagctgggcagcctggacacactactcttcacagagacctcggaagctaactccgaggcggcccctgcatggctggccaaggggcacatgctgggacgcagactctcagtacagatcgccagcctctggcaccgttgctgtggaaaccaactggcaatgagaaatttagcaatttgaaaaaagcatttccttcccttatttatatctcttgacccttatcctaggggaatggcgagggaagcacggctcgcagctggagccgggagtgggcaggtgtctcgagggtaccgctccccggaacggggaaggacaccagtacctcacccccccagagtgggcagagcctagagacgccatcccagaatacgtcactcctgggaaagatgaaaataatgcagaaaaggcaaagtctccctcttccctcccccacctcactcctctcccagagacgacctcaaacgtcactccgaagattgttattcgaggtcattctccatgcaccgctgggcacatgcaggaatacagacacatgccagtgctcttgttgaacaaaatggggtcacactctagcccatggctcctctgcagcccactccctttgctgagggcctgtgttgctctcccgaccacaacactagggttgttgcgtcacttccactgccgtacagagttccacggcgagctgggccgggctttatgaaagcagttctctcagatgtccagggatgccacgccacatgaatcaccaagaaatgaagcaatgcacttgccagtccctcctctaaatgctttctctaaaggcagcctggccaacaggacccctaactagacaggccctaatggggcagaggggagaagcggggagagcgatctggagaaaggagcctgtcgcggcaccacgggtacatctgtaaacatgagagtcagggaaaaacgaaattggtctggggcattctacgcagccatcaaaggcatggatgacagtgcttaccgacaggaaaaaatattccccacatgttcagaaaaaaagggtaggttacaaaatggtatggaacagcgagtccgacattcagagaaaaggtataaaaaagatgcagaggcatatcttgttttattaccccttgctttattgtgctttggggatactgcatttgttacaaactgaaggtttatggcaacccattgttgagcacgtccagttttttttttttttttttttttaagagatggggtcttgctctgtcacccaggctggagtacagtggcgagatcacagctcactgcagcctcaaactcttggcctcaagtgaacctcccaccttggcctccccaagtgctgggattctgggtgtgagccactgtgcctggcctgaggcaagtaaatctgttggtgccatttttccaatagcatgtgctcacttcatgtctctgtgtcacattttgacaattcttgtaacatttcaaactttttcagtattatgatatctgtcatggtgatctgagatgactgatctttgatgcttctattgtaattgttttggggtgccatgaactgtacccatataagacagagaaattaactgataaatgttgtgtgttctgactgatctatcaactggctggtccatcgtctcttcccatctccttgggcctccctattccctgagacacaacaatatagaaattaggctgattatagctcttatttcacatgccaagggaataaaaaaagaaataaggccaattaatgatcacacaatggcctctaactgctcaagtgaaaggaagagtcactcatctttcactttggatcaaaaactagaaatgattaggcttagtgaggaaggcatgtcaaaagctgagataggctgaaagctgagacagtcctcttgcaccagtttagccaagctgtgaatacaaagaaaaagctcttgaaagaaattaaaagtgttactgcagtgaacacacaactgataagaaactggaacaaccatatcactgatatggagaaagttttaactggtttggatagaaaatcaaattgtccacaacattcccttaagccaaagcctaatctagagcaaggccctaactctctgcaattctatgaagactgaagagctgaggaagttgcaggaaaaaagttggaagctagcaacttccatcaagtttaagaaaagaagctgtgttctgtaacgtaaacacgcaaggcaaagtagcaagtcttgatggagaagctgcagcaagttctccagaggatctagttaacttcattgatgaaggtggctacactaaacaacagattttcaattgagacaagacatccttctttttttgagatggagtcgcgctctgtcgcccaggctggagtgcagtggtgcggtctcagctcactgcaagctccgcctcccgggttcatgccattctcctgcctcagcctcccgagtagctgggactacaggcgcccgccaccacacccacataattttttgtatttttagtagagacggggtttcactgtgttagccaggatggtctcgatctcctgacctcatgacccttccacctcggcctcccaaagtgctgggattacaggcgtgagccactgcgcccggccaagacagccttctattggaagaagatgccatctaggattttcatagctagagaggagaaatcgatgtctggtttcaaagattcaaaggacaggctgactcccttgtgaggggctagtacagctggtgactttaagttgaagctggtactcatttcccattctgaaaatcctagggccttaggaattatgtgaaacctactctgcttgtgctctataaatggatcaacaaagcctggatgacagcatatctgtttacagcatggctatttacagcatgaatattttaagcccattgttgagatttactgctcagaaaaaagagattccattccaaatgttactgctcatggacaatgaacctggtcacccaaggtctctgctggagatgtaaaaggaaattaatgctgttatgcctgctgacccaacagtcacttacagtctatggatcaaggaataattttgactttcaagcctcatatttaagaaacacattttgtaaggctatagctgccataaatagtgattcctctgacggatctcggcaaagtcaattgaaaaccttctggaaaggattcaccattctagatggcattaggaacatttgtgattcatgggaggaggccagtatgtcaacatgagcaggagttgagaagaagttgatcccatccctcatggatggctttgaggggtgcaggggaagaggtcactgcagatgtggtggaaacagcagaagaactagaattcgaagtggagctggccgggcacggtggctcacgcctgtaatcccagcactttgggaggccgaggcaggaggatcacgaggttaggagatcaagaccatcctggctaacacagtgaaaccccgtctctactaaaaatacaaaaaaaattagccaggcgcggtggcgggcgcctgtagttccagctactcgggaggctgaggcaggagaacggcgtgaacctgggaggtggagcttgcagtgagctgagatcagagattgcgtcactgcactccagcctgggcaacagagggagactctgtctaaacaaacaaacaaacaaacaaaaacagaagtggagctgaagatgggacttaaacgctgcaatctcatgagaaacttgaatggatgaggagttgcttcttagggacaagcaaagaaagtgatttctcgagatggaatctactcctggtaaagatgctgtgaacattgttaaaatgataacaaaggattgagaatattccataagcctagttgataaagcagcagcagggtttcagagaaaagactccaattctgagaatttctgctgtgggtaaaatgctatcaaacagcattgcatgctacagagacacctttcatgaaaggaaaagtcaattgatgtggtaaacttcattgttgtcttattttcagaaattgccacagtcaccccagccttcggcaaccaccgctctcatcagtcagcagccatcaacattgaagtgagactctccaacagcaaaattatgatgactcgccgaaggctctgatgattgctagcatttctcagcaataaggtattttaaattaagatatgcacactgcttagacatgatgctattgcacacttaacagactacaggataaacataacttttctatgcactgggaaaccaaaaaaaaaaaaaagtgtgcatctcgctttaatgtggtatttgctttcctgtggtggtctggggctgaacccacaaatatccccaggtcggcctgtgcagaaaacaagagctgagagtcatcctggagttaacgaggctcctcttggggccaaggctttcatgcctggcagattcattgcttataattagtatccctctccccagtagatgttatcttttaaaaaaggaaaagacaaagaaatggagggaaagggaaggtctacaaatgggtcagaaaaaggaaggtagagaccaggcatggtggctcacgtttgtcatcccagcactttgggaggccgaggtgggcggatcactggacctcacttgaggtcaggagttcgagaccaacctggccaacatggtgaaaccctgtctctactgaaaatacaaaaattagctgggtgcggtggtgagtgcctgggatcccagctactagggagattgaggcaggagaatcgcttgaatctgggaggcagaggttgcagtgagcagagatcatgccactgcactccagtatgggctacagagacagactctgtctcaaacaaaaagaaaaagaaaaagaaaaagaaaaaaaagaaaaaagaaggtagaaaagaaagaaccaaaagatagaagaaggagccggaatccacagagccaatctgtgcagataaattacaggagtaagcgcattgccctggactcaaacgctgtcaacttctggagatacaacatttgcttttcttaaaaaagaaaaagaaaaagaaaaaaaaagcaacatcatagctccatttttgtcttctccaaggaaacataacacatttcaacaacttaaaaagggacaggaagaccatgtgaaaacatcctgaaatagtgttttctctcaagggcagacctgagctacactgatctcctgaaacattttttaaaatgcagagatgtgggccgggcgcggtggctcacacctgtaatcccagcactttgggaggccaaggagggtggatcacttgaggttaggagttcgagaccagcctggccaaaagggtgaaacctcatctctactaaaaatacaaaaaaatgaggtgggtgtggtggtgtgtgcctgaagtcccagctactcgggaggctgaggcaggagaaccgctgaaaccgggaggccgaggttgcagtgagctgagatggcaccatccaagatcgcgccatcgcactccagtctgggcgatagagcgagactccgtctaaaaaaaaaataaataaataaaaaataaaaataataaaaaataacaagcagaggtgtggagactacatttaaacagggcatgcaggaagcccagtccctgtcaagcctctaatactctcctgtggctcaggctgtgaattgatgtgtgctgaccgccggcctcctcactctacctgctccgtcttccctctgcacgcaggggacaggggaaagacagaggcagctgtcgctggtcccccaggggacagccagggcaggtgaggactgggtcctgcctggggaggctggcactgtctttgggtcagtccgagaggagatgcagtctgctcccactcggagtgagaggcaggacttctgctgactcgggtggagcttccacgcaggcttttgggtgggacgtggccaccaatctgatgcagccaacacagactcaagcagcacacacccagctctgcatcccagcacaccccctccagccacggccaggggagtctttctgaaggccgtgcggcatctcggtggccccccttctgcccaaggcgggtcttgggcagcctctgtccctctgtctgcaccccccgttgagggcaaatgtgtgcagccctggtcctggcctgcttcacctcttagaacaagggctgtgtggttaggccaactccctcctccagccccctcccatttcggcccatcatctaagcaacagtggctgcgtctgcccttttgctatggcccaaggcagctgcggattcccatccatgctccttcagccctgcagccatgtccctctgcatgcaccttcagggacccgatgtccagcagagggacacccagacatccccacctcgcctggggtagcactcagggtttccagcctcctcggccctgcccccaggcctgtcacctacgtgatgcaaccccaagatgtccagcaaaccctcgccgaaaggagggactcacgaagggagcctgcagctatcggaggggtgggtcccagccctggcctcgcatgaaaaacttcccacgtctgtctggccccatagttcggggaaggcctgtggctgcccctgctgcctgtcaaagtcctcccagcaccatttccaacatgaacgcacactgtcccagcacgcgtaggactttggtggcatttttggctaggtgtagctcctctacttattatattctataatttctcagcagtctccacgcagttctgagaactcttgctgcattgagaaaaatctaacctacagcctgtttttaaatgaatgttgcatttaacagtgaatgaaggtaggatatagtaattaaatatttactaatctgaacattcttgctgcctttttttattctggggctgtgaaatgttgtttctagatctggatcctggaatgctcaagagctcttacaccaaagtggtcctggaggaggctggtgctgtttcatcagactcagcctcagtttccccacctgggcatggtggctacctcgcctgcctgccccacgggacgtctgagcaggtgtgtcagaaaatactagagtggcaggaaggcacctcccacacctacaacacccccagggagctctgtccacaaccaactcctgttgagtgaatgaacggagtgaagagtgagctaaagggcattcagtgtcaggaggcctggggcagggttgggcaggttacattcctgactttgtgggcaaacggagtgtccaccttctcgagtgacaaggactccaatctggatccctttggcctcagctggagggacctatgcaactgttatcattagttccttcgttcgttcgttcattcattcattcattcattcaatgaattgctacagtccagatgctgttctaggctctggtgatacaatagtgactgatgcacatgtgggacctgctggtgtcagatgctgagtgaacccacgtggagggtgtgaggaagggatacaagtgccagggaggggcttgcagaaagaagggtggaccagatgtcctccagggcctcttcctaggcactgccgtgttggagctgcccgattcgtaaatcgctgcttgctcacatcaattctttaaaattttattgtgcctcagctgactttataaacaatgcccatccacagatgaatgagtcaacagttgtggtctacccacaccattggatatgattcggccacaaaaaggaccgcagctttgacatgccggggcgtgggggatgctcagcgacttcatgccaaacacgaaagatcgcgttacgtgagtccacacacggttgcccttggtgcactctggagatcggtcccaggaccccagcacagacccaaatccaagaatattcaaaagtcacacagttggccctgaggaacccacgtatatgaaaagccagcctcctttctacgtggggtgggttctgcattccacgaatactgtatttttgacccatgtttggttggaaaaaatctgcatgaagtcaacccaaggagcttgagtatcaacagtatatgaaaagcctggaatagacacacttttagaggagaagtagcttggtggttgccaggctgagggcgggcaggggcaatggggctcaggtgcttactgggtccagggtttcattctaaggtgaggaaaatgactgggaactggataaaagttgtggtggaacaacaccgtgaacctcgaaatgtcactgattatacacactgagtgaatgaatggagtgaagagtgagctaatgggcattcgttgcccatcacctaagcaacagtggctgcgtctgccctttcgctatggcccaaggcagctgcggattcccacccatgctcctccagccctgcagcccatgcccctctgcatgcaccttcagggaccccatgttcgtggttcattttacctcagtaaaatttcaaaaaaagtgaccctgaacaaatgatgagagaagggcttcagggccgggagccgggagccgggtctctctgagcccatttcctggcaggcttcacatctgggtgggcctcattcttcctcattccccaaggtggtttctgcagcctgcagggccccccacctctcagccctcacctgccaatgggcccaaggcttgctctctgccagggtacaagaaaaacccaggctggcccctcacatcggccaccggatggagtggggggtggccctccaggcagctttggccaggagggcagtttgaagggtgcagcccggccgtccaccccgaccccctctcaggaagccccggtgccagtgccaccctccaagcgccccctcgcagccagccgaggccgctgcgtttgttaaaaatacgcagcaccatctgcagcaacttggaatttaataaatttatttataaagcgactgaggcttcttttaaagtcgagtttttatccctgagatgaggctcctgaggcctatgaggctcacccagcttggctcactctctctgaaaaccacacgctggcccagacaaccctctgcgaaggcgacggtgaactgtggcctggagcccagcctacagcccctgtcacaggagaggtgagggaaagttgagaaccacagggcttccacggctcaggttcccctggaccgtgttgaatggcatctgcccaaaattcgtgtctacccacaaggggcttgccagcccttccccagctgctgggaggccccaccgccccgggtagcgggggaagattgaggctcacccagaagtggacttcaccaggaaatgactcagagagacccagctcccagccacaaaacccttctctcaaactgcggattgtggcctgatttggacacggggtctttgcagatttagttaaggtaaggtcatgctggattagggtaggactttattccagcgactggtgtccttgtgagagaaaacagagcggggtttcagtcgcaaacacagaggagaacatcgtgaggatgaagcagagattgcggtgaccacctccacgccaaggcatcaggggcacctcgccaggatacgggaaaggcaagaaggcccctccccaagagcctccagagggagtccacccagctgacaccttggtttcagaattctggcctctagagctgcaggaggatcaatctctgcggtgctgagctgtcctgcgtgtggtgatttgtttggcagcccaggcgagcccccttccccgcctgctctgtggggcacctgggccagggctgggccagagcccggacgcttcccagtgccatggtgcctcctgctgacttcaattcccacaggcagacctggcgcctgggaaccaagaggggaggggcatgggcaccagttccggaaggagccacaggcaccaggcagagaaactgtccagggtatttccaagggacaggccagggtgggtggggcaaagggaaagagctctgaggaccccctacccgggttctagggttctggggttggaaggggcatcagggtcctggtctgggacccacccccaccaggccttgctatgccaagaggactgcaggactttcctgaagtagaaaccactgagggcagaatcctgatgcgggggggcggcaggcccagcagggcaactgccaggacagcagggccagtgcagcgcagggactggtggctgccccttccctcaggccttccttccttcctgccttccctgggctgctgcaaggctcaccttctagaccacaacagtccactctctccggggtcacgggcactttggtggggtacactcaggggctgtctggagctgtgctctcccccagtgtgaggaatcatcgaggcttctcggaggaggagagaacagaggacagtgcgtcgggctgtggcacaacatgggcacaggcttggaggcaaggggcctttcccatgactgaggtctcctatggtctatatctattttgcaagcgcagacatcctcagatcctatgaacaaagctgcatacttgtgcaccggtgctcgggggtgactggtctatatctgttttgcaagcgcagacatcctcagaccctatgaacaaagctgaataattgtgcaccggtgctcagggggtgactgttccctccagactcaggggcgcagcagcacagaggagcaggtttcgcacaaaatgggcacaaggtcactgagcccatgattactcctggcactcatgccaggctcagcacccgccgccaggggaaactcctccctgtccctcattctctctccacccactgccccccgcctttgagctactcccttccactacccaggcaccccataataactgtggagatgccaagaagcagcaagtacttagtagacacaggaaacctggaggagccctgggaaggggttgcctctttgccacaccatggatttggggctcacagggaaagccccctgagaggcggccagtggagctggcggcggtaagataagagggtagagaggatagagagggtagagaggatagagagggtagagaggataagagatttttctttacctggcaaagtcctcatgggacttctgagcaggcatatcagaaaataccagagtgatgggccgggtgcagtggctcacgcctgtaatcccagcactttgggaggccgaggtgggtggatcacctgaggtcaggagttcaagaccagtctggccaacatggcgaaacctcatccctactaaaaatacaaaaattagctgggcagaatggtgggcacctgtaatcccagctacttgggaggctgaggcaggaaaattgcttgaacccaggaagcggaggttgcggtgagctgagatcgcaccactgcactcgagcctgtgcgacaaagcaagactccatctcaaaacaaccaaccaaccaaccaacaccagagtggcaggatccagaccccttcagaccccacctgagatgcaacccctgagagaggccttgcgggcacccctgcaccaaccaagtctgacagcagctcctggaagctgtgcttcgtctctgcacagcacacagggcaatgctgtccgctaactgcccctctggacactcaggggtggagtgggctgcagaactctggccatgcgctggagtccagagccagcaggggaacgtgccgtagacagggtcccatagaggggcagatggagcccgtttgcagctgcaggcgatggggcgggacgaatgactgaggtcatttgtcgaatgacctcagggccacacaagttgggctggagagaagggtattggaaggtggagaagaatagaggaagaggctggaaatggaggcttggcagggagcccttgactatctgggaaggagctgaaaatggatctgaagttagcacaaatgacacaagaaaaaataaaaactcgaagagttctgtaaccttgaaagagattgaaccagaagttgcaaatcctttcataaagaaaacatgaggcccagatggctttctgagcagggtcaagccatcgcagaaggaacacataattctaacccgaacaatgtcttctggagaaaaagagagaacactccccagcttcttgggagactggcaagagcttgactccggttggaaaagaatggcctcagaaaggaaaattacagacaaatctcactcatgaccttggatgcaaaaatcctaaacacaatattagcaaatggaatttggcaacatattaaaaagattactacatcatgacaagtcgggtttatcttaggaagctaagactgatctaacagaaacatcaattaatacaattcattagcaaagaaaagccatgtaatttttgcaagtgatacaaaaaaggacttgaggaaattaattatccgcttgcaattaaataaaaatctcttgcacactaggaaaagaataaaatactttaacctgataagctgcatgtcaaaaaaaaaaaaaaaagactagagtcaacagaaattttgaaagcttttttttttttaaagatcaagaacaaagcaggtattcccactattcccacttctattcagcattttattgcaggtcctagctagcggagaaaaaaagagaaaggaagaaaaaagataatcagtcgataaaagatgagaattaataagagaattcagcaaagtggctggataaaataaaaatcaatataccaaagccagccatatttctacatttcagcaagaatcagcaaatgcaattctgaaaaatatatcatgaagtgacatcagtgaaactacctaggaataaatctaaaaaaggttttgcagaagctctttgtggagatacttaaaaaaccagtttgaaagagaaatgtaggcagggcgcagtggctcacatctgtaatcccagcactttgggaggccgaggcgggcggatcatgaggtcaggagatcgagaccatcctggctaacacggtgaaaccccgtctctactaaaaatacagaaaattagccgggcgaggtggcgggcgcctgtagtcccagctactcgggaggctgaggcaggagaatggcgtgaaccccagggggcggagcctgcagtgagccgagattgcgccactgcactccagcctgggcgacagcgagactccgtctcaaaaaaaaaaaaaaaaaaaaaaaaaaaaaaaaaaaaattggctgggtgtggtggcgggcacctgtatttccagctactcaggaggctaaggcaggagaattgtttgaacctgggaggaagaggttgcagtgagttgagattgtgccattgcactccagcccgggttacagtgtgagattctgaaagaagaaaagaaaagaaagaagagggagaaggaaggaaggaaggaaggaaggagagaacgaaagaaagaaataaaaagaaagaaagaaagaaagaaagaaaaagaaagaaagaaagagaaagaaagaaagaaagaaagaaagaaagaaagaaagaaagaaagaaagaaagaaagaaagaaagaaaatgtatcatgttcttgaacaggaagacaacattgtgaaggggttaatttttcccaaattggtctattctgggtcaatgcaattctaaccaaaatcccaatagggtttgttgttgctgttttgttttggtgtaacttgataagctgattggaaaatacatatggagcaggcacggtggctcacacctgtaatcccagccatttgagaggctgaggcgggtggatcacttgaggtcaggagtttgagaccaacctgaacaacatggcgaaaccctgtctctactaagaacacaaaaattagccgggcgcggtggtgcaaacctgtaatcccagctactcaggaggctgaggcatgagaattgcttgaacctgggaggcggaggtgtcagtgagccgagattgcgccactgcactccagcctgggtgacagagcaggactctgtctcaaaaaaaaaaaaaaaaaaagaaaagaaaaagaaaaagaaaaaaagaagaaaaagaaagaaaatgcatatggaaatgtaaagagccaacgattgctcaaataatcctgaagagataaaaggtgggtgggttgggggtgaaggggagaaatattcagaggtaatgaaggtggtgctcagatagacaaatggaccaacggacagccacaccacagacctgcatccatgtggaagtttggtttatgacgcctccagcacggaagatcttggagaaaagtgttttattccaccaatgctgctggaaggatggggtgtcctcaggggaaaaagtgaaattagatccatgcctcacataacacacacacatacacacacaatctgaattcttggattaaggacttacatatgaaagacaaactttaaactcctggaaaataagattgggaaacagctttacaaactcttgggagaagataatttcttaaataagacagaaaaatcacaaactctgaaggaaagtttgataaattcatctacattaaattagaaatgacttgtcataaaagaatgaaaagacaagctaaagattagtaaagagaatatatctatatctatatctatatctatatctatatctatatctatatctatatttgagatggagtcttgctctgatgcccaggctgagcgcagtggtgtaatctcagctcacggcaatctccacctcctgggtttaagcgattctcatgcctcagcctcctgagtagctgggactataggtgcatgcaaccacgcccagctaatttttttttttcttttttttgagacagagtcttgctctgtcaccaggctggagtgtactggcacgatctcggctcactgcaacctttgcctcctggattcaagtgattctcctgcctcagccttctgagtagctgggactacaggcgcatgccaccacacccagctaatttttgtgttcttagtagagacagggcttcaccatgttggccaggatggtcttatctcttgaccttgtgatccacctgcctcagcctcccaaagtgctgggattagagatgtgcacaaccgcacctggccaatctttgtatttttagtggagacagggtttcaccatgttggccaggcttgtctccaactcctgacctcaggtgatccacctgccttggcctcccaaagtgctgagattacaggcgtgagccaccgcgcccggccagtaaagagaatatataaagaacacaaatcaatccgaaaaggatgaacaactcagtagaaaactggcagaagatgagaataagaatttcccagcaaaggcaccacaaacagtccagaaacataaaagatgctcaagtccattagtaatcaggaaacgcacattcaaatggcaatgaaaaattattaagtacctcccagattgacaaaagctgccaggtctgaaccagaacaggggcagctgcagcatggagccaggagacctgccacccaggtggctggaacgcagctgatacagtttggatatttaaccctgcccaaatctcaagttgaaatctaattcccaatgttggaggtggggcctggcaggaggtgtctgggtctcagggcgggtccctcgtggcttggtgctgtccttgcaatagtgagtgagttctccggagctctggttaagtgcgtggcagctcccccttgcttgctttcgctcttgcttctgctgtgtgaactgcctactcccatttcaccttccaccatgagtaaaagctccctgagccctccccagaagcagatacaggcaccatgcttcttgtacagcctgcagaactgtgagccaattacacctcttttcttataaattacccagtcatagatatttctttacagcaacacaagaagggcctaatgcaactccctgcagagaggtctcggcctccacgtggtagagctgaacacttgcctcctagtgatctagcagctgctctcctaacacctacactcagacatcaggagaatacgcaggagtgctcagagttcctctgtttacagccccccaaaccaggagggggtcacacgtccctcagcaagagaacagacacatcagtgatgggacgggtcacaacaccagaccccagattcccacctccacgaggctctggaaacaaaaacatttcatcctcttcttttcggtaattatactggtggcaacgcctgtatttactctctgcatttatcccactgaatagttggacattttgatgcagaaaaatcagtgtgcttgattacatgacatgattggactggaattatatataaaatacataaaatgttacatcctctgaaatttattttatagtataaattgtataacattacattttacaatattaaacaaatacatgcatgatgtatgtttattctgaaatgcacgtggacccacaggctttggatagcgactaagaagctgtctatcatatgatagagtcctacacaggtgggaaaatgaataaacgagacacacacaccggggaggcagaaccccagagcatactgctggcccgtggcagaggtcggcaaagaatgcaggtggcaaatgtccatttacagaaagctggaaaacaggtaaacgttagctttgtttagtgatatcaacacaggtggtaaaaccccaaggaaaatcctgaggaagcggtggtgggggacccctcacagccctactggctctgcacggtgtcccttggctcaggccagcacctccgtgatgcttccatgacatggggagaaaccgccaaccatgggccatgtacaccagatgggtccaggcccagatggcagttgagcccgaggctcaggccccatgagcagttgtgggcaggaagcttggctgccgtcctgagaccaacaccaagccacagccatcaccgctcctcctccaggcttcccttcctcctctggggcagcagcccatcttcccagctgcccgaaggagaaaggcatatccccagtgtccctccacatcctgaccctgaccctgtccagcagctggtccacagctgcagtaaacccagagtccagcagaacctttgctcagtaggcacacaaatcattcttgagcaggtgagccactaataatgtgtcactgacaccaaggaacagagggttgagtgacttgcttcaggccacacagctagtgaggtactgagctgggacctcggagaaggtgcctcctccatgctaggcagccctctcctgggccagtcctgctccccactcccaacagccttggtgctttcagaaaaactcaagaggcgccaggagaatcccacagtcccccttctcagcctaatttgcaggcaaggaaatgtctgtggagctctccactcatcaggatccatcccctgcccaggggacaggcagagacctgcccgatgccctggtggtggccgcaggaatgctgagcagatggtgcttggcacccagaagtggggtgaggagagcagaacgacccgataaaattatttatgcaaatatttaaccacaggcactgcagcaatgcaaaagtaacatcgaggggcccatgaaatgttagctgcctgccgccccaagtgcctgtgtgcagagccagcagcaagccagagagggcgggagggtttggggaggagacggtgccttggagggagcagcctggagggagggacagcccctctgtctctgcgcaggcccagctgctcaggcagagtctcccttctcctccctcctttaataaacacccatgaagggctctctcacccatggtggggcatttccatggtgagcaaaactgggagacacaagtgagcggtgcaagagcacgagagtgaagctggatgcccgtggggggctaccctgcgctccctgctcctcccagcctctctggcagatctgcacatggcagatgggaactgtggggcacacagctacgtggaggaccctccagaaccctctgccctctgaatggttgggacagtgagtccaggagggccagggggtggcctgggagaggtggtgctggtgctctgggctgcagtgggcactatgatcacgccagtttacagacataaacgctcggcttggggagggcaggcgcctgacccgagacctcctggtgagtggttgctgtgtagagacaatgaggaccgcactgaaagcagtggcaacaaagcttccccaatgtcatacatgatgcgttgatatactacacatgtatacatacaacatgcattctacatacagcatagcggcatgccgcaagcatacgcagtgcttttcataaacaaaaccactgaagtctcacaatggcccctgaagggggtcagtcatatgatcctcaccccatttcacagatgacaaactgaggcacagaagggctgagggtggcaatgggacggaagccccagtggcctggctctggccccctcccaatccatctgcactggccacacaagggtgctggacacagggcagtggtgtgtgggcagcgtgtgagtcacaaggcaggttccgcggtttcagggcccatcgggattcaccagcagcagcaccaggctctacagtcaggaccagatgggccttggtcaggcagcctggggcagggccaggggcctgcagcagccctccgaggatgggaggctctgagaatcctcagtgaagggcagggcttgagcctgggatggcgctttttaacagggccacgtgtctttctacataaaaaaagccccctgtcatgccaaatcttaaagtaaacatgcctcttctggaagatgctctccctgctaggcctggccactccatcgttgtgagccccgggggtgggaacacccagagtgagaagtgaagcctcctgcagcccagcccggagacagcctggctggccacgcccagaaggcagcaagcgggtgagcccgcgacaggcgcaccctcagtggctaggaaagggcccttggcaggaagcccccctgtgaccactcatgtttaggctggacactccacacttgcattttcctaatgcagctggtctctcaccctccagcgattagcacgctgggaccacagagccatgtgagctcctgcagatttcttaatggccggctgcctccggtggccttatttttagccatttccactctactgaccgctcagtgaagctcagatgtatcaggcgcacggggagcatgtccatatcgaactctctccaaggaggcggagggggacgaggaacgcagagctcaactgcacgtttccctgggctcattgcacaaattgagttacagatgcagatttccaacccatttcttgatgttttcctcctggaaccagagcaaagaaaacccgaggaaactgcacggcaacaggccccaggacggcaggtgggctggcagcaagaccactttcttatctagagctggatttaggggcctgaagccagcgaggaaggaggaaggaggaagcacaaatttaaatgacccttctagaacaacctattattcccccccctccttggggtaaaaagatggcatgaagtaccctcagttaagaatcctggggaaagataaccatccgagggtcgggctccccagacagacgacagcagatcggggctgcttcatgagtgctctgctgccaggaagtgtgcatggcaggggggcagctggaaggtcatccagagccaccccaataccagcaaagaccccactcaaaaatcagcccaacccatgtctggaaatcagctcttctggctccattgcccatccttcccccaccttttccactgaagagactcctactcactctttaaagatcctagcatgaacaggcttggttgctcctgcctttgatcccaatgctatgggaggctgaggtgggaggatcgcttgaggccaggcgtttgagaccagcctgggcaatccagcaagatcccatctctacaaaaaataaaaaattagcagggtgtggtggcacatgccatcatatgacccgggggtgggggggtgtcacgtgattgtaccactgaactccagcatgaaccacagagtgaaaccttgactcaaaaaaaaaaaaaaaaaaaaaaaaaaaaggccctagcttgtatcctcagccttactgtgcagacttcagagtttgaatcagcaggtcctttgtggggggccaagtcctgcagtacaattacccctcagactcccctcctgggcgtctgtgtctttgagggcctgtggtcatcctcaccatttctgtaacttctaggtcctggcttggggttaggagctgcccaggtgcaagatggaatggaccgtctgctccttgggcctcaggcgcttctgcagtcctgattcctgttactgggtcaaaccgcagcaggaagatacggaagggaggtgcgctaggtgatgtctctgagcaaccctgttcttcggctgttttcatccttcagtgcaaagcccttaaatctctgcacagccctggagaaggatgaggctcgggacctgagttcccagtcatgtcgtctgtgtctgcagctcctagacaggtgcctggaggggcaggccagcaaggggtgcccacccacttggcccctccacatagccggggtcagtggaagtccaaaatccacactcggatctgaggcctcagccctcttctgtggcccctcagacgggggcggccttcctggaaacatccgccttcctccccgggcaccaacagcaatatgtgccttttcaggtctgggaagaatgtggctccggggtctgggtactgcagattgcccaggtcacgtaccctaggtcctaggggaattttaacagatgaactggtttccaggctgaactctgagcccagcctccgtggaaggtcagaggtgaccagctggcagattctaagaacctggccactttccggctcctctctccctatgtgcctgccccacacccagctccccaaccaagtacatgcttggccaggtcttcccggaagtcagaggtgaccaactgggtcctggtcaccatcacaccccactccctgccctcaggtgcccattctgtgcccagcacctgcacgcacacactggctctagggcctgtttgccagcatttactccctgggcccacgggtccagggacttcttggaaaatgcctgtggccgtcagcaaacagagcagatcagcttggaagaaggcatggcctccctgtatacccctggcttgtccaaggagaacaagggcaactcccaactccccacaccacagggcccccaggacatgccaccatcctgtgagcaggcagtggccagctctgctctgtgttgaagcagcagcaccgcctaatgccagcctggctggccagttccgagagttggggttaagcgggagaggccccatgtggtggccagaaagagaccactgagtattctgtctcttggacaacatatagcccccctttcagaaagaagaatctggttccagctccatccttgcgttcctgtggggcagcatgagcagctgctcatttccacagttgactctgaccagagaggctgagtggcttgcccagagtcacacagaaaaggcagtgccagggctcctgaccactgcccgccatgtccgattcctgctgcctttgccagataaaggtaaatgtgccagctgctcttgtgggaaatcggaatctgaccctaatttgcaagagatttttctttttctttgttttcttttagagacagggttttgccacgtagcccagcctgagctcaagcgatctccctgccttggcctcccaaagtgcttggattgtgggtgcgaaccacctcacccagccagaagggatatttctttcctctttgtgaaaagagctactattttcagctactgactgggctacaggaggagctccctagttgaacacgtagggggcctgcaggcttccaaggccacctggcgatgggaactttttctctcgaacaccccagctcctgatgggggatcatggggtctggagggtaggtctgcacctctgagttctgggacctgggctaagtcacccagcctttccctgagcctcagcttcttcatctgtaaaatggggtcatgtaaaggctctgcaggtgggcaggacacagcactcggcagcagggagccactgagagctactgtccctcctcctcttggccgagcctgggccccatcagccgcaggagcgctgcttcctcagggcctctctccctgcttcacccacctcgacacgggggtgagggccacgggctcccggaaacccattcacagccgaaagctcgtgctatttagtctcatctgtgtgcagccgatcagagaattgatctcaaattacaaacctctcagctaaacgcggtctattacgcaaaacctcattccagcggctataaataacccttacaacacagtccccaggaactctctggaaagatgtggcacggttttgaataacgagataatggaaacacaaacccatgctaattaatttcactgctcagagagagctcgctcctcgcttagccatggtcagtgggactcaatcaagaaaaccctgggatgaaacgggagacgtctcaagggaaacctgttggcaggagggcccagccacgtggagctgcagcaagtggtcgcgttgtttgttcacggacctgtggcaccgggcggcccagagagggcctggccggctcccacctctcaaagccctgctcggacaatgctgctgaggcaaggctccgggacggcccacccaacagaggaatcagacacaaaggcagccctgggctaggtctgacggcagatggtttcaaagcgaaagaggaagaatccgaggactcctgttgcagggtcacaggaggccccaggaggtggctttatctgttcaaattagagacccccagaaagatgatgacctggcgtgtgaagaaaccagcatgggtcacaggaagcattcagaggttcctcagtaagttaaacacccaaccaccatgtgacccagtaattccaccacacagggaggcaaaaacaagcacgcacagccatgctcggagcagccccatccgtgatggccgagaggcggtggaaacagccccaacgcacatccactggtgaatgaacaaacaaaacgtggcacgtacaaatgatgcgggatatatgatagaatggaatagatacataatatatctatattgtatattgtatatactgtatattgtatcttgtatatactgtatattgtatattcatatactatattgtatattgtatatacatgtactatattgcatattgtatatacatgtactatattgtatattgtatatgtatatagatatacataatatatctatattgtatattccataatatacaatatggaatatgtatattatggaatataattcgggcatgaaaaggaatgagacacagatccacactacaacagggataaaccttgcaaacatgacgccgagtgaaagaagccaggcgtaaaaggccacattctgtgattttatttataggaaatatacggaatcagtgcatccatagagacagaaagctcactggggatggccagggaccagggaggggtgaggggagcggctgccaggaggttcggggttccttttggggcggttaactaggtctcggtggtggtcacacagacttgtgaatgtactaaatgccactgaattattccccctttaaatggttaaaatggcacattttacattacatgtatttgaccacaatgaaaagaaaacagttatgggaccaatgggagctttggtgcccctaaaattccatcagcattgcctgttcttaggcttgttcacctcttaatacgaggcgtgcaaactcagctcccagtcccctcttgctgctcagctgcaaaaaaatgaattattgcctggttttatgagtctaatgttgtgacctgctcctgccactgatgccaaggccaggaggtctgtcagtcagggtggcacatgacacgcctgtgcccccggccagtcccactgtccctgatctcagcttctcccatgcaaactcagaagctagaaacaggctgctggcctttgttcttctctccctgaatccaaggatgatggttttccaagcaggctacatttgtaaagtaatcctcgactctccgttttatattaatgaaagccagccagagctgctgatcggctccagcggatgggacaggcccggagaattccgtggggcagccggcacaatgccagcccagagcacagaacacggcatggggctggcgtgcaggaaaaccaggcacccctgccggcccctctgggctttctgcatcttttaagcagctctcagagcccacagactccattccagggcctgtggggatccacaggactcatgccaagaatgacggaaatctttctgagctcaaaactctctgaatttgaaaaacaaatggtcctttgaagaacactgcttccatatggaactatggggcacggtgatcagaagagctccagcctctttaaaaaccagcaaatgatgcaccctgatccctttgaacgtccagaaaaaggctgaacctagagccatagtgactaagaggcaaatgcagcctttcaaaatctccacaacccaagaattgccttttcacatgtgaagccaacgcttcagaatgcaagaaaagtggcagctttcaaaaggagtttggaggttctcagatttaagcgcaaatgccacttcctgaggctggtgctaaaactgcaggaaaaggctggttggcagaagctcacaaaggggagtttatcagtgttgcaaagggcatgttcacggacacctattggtgttggccttgttctctgtggggatggtgaggcggggccagcagcctgcagggctgtggcattacccgttcctcgacagttttctcaactcatcgtcactccagccagagccctgggctgctccccacctgccctgcttccccatcttccctgcaatgccccatggcagccctgggtacttggttaccaccccacgacccacgtcctatccttcagggactgcctcacctctgggctgtttggaaggacagagtgacatgggacagaaacagagggtgtctggtttaagggctacttctgcatttatcattccattctttattttgggtctaattcaaaccatgatttcaaaaaggctaagaatgtacaaagggaagggacccactggccccagggcaagatgggagggtgtcctggtggaggtgtcgtctgagactccttcactcctctagccatttaggaagaatttctaggtagtcaagcacccaggatgggccttccaggatgaatgggggagtttaggaaactgccttcgtttctactgaaaatggagaaaaaaggcaattttcagttcttgcagcactcagcagtgtgaaactgggctgctgctgaaagggaacgagaagcctcgttccaaatttacttgccatgggaggtgggggagggggggcgggtggcgaggggcgtgaacactgggaaggcatcacagaaggggagcgtcttgagcgttctgcccaagatccaggaaggaggcggcgtccgggcgtgacacaggcccaggaggggagctggatggggtggtggggaagttgcctgcgactcctgcctgggaaccaggggtctgtgctggtggtggggcccctgtggggatgtgtgttctcacagagaggactttaataagggttttgaaggcgtcctgctgctgagtatgggaactcacacgtgctgggcaggagagaatcagggctgggctgatcagggaaacgcagaggggaaaggaagcctacctgtagcccccatctctgacagaggcaagatgaacaagcacctgccatttacctgatagcagctgcatctctcgccaggtacagctgcaggcgaaggcatgaaaggttgggtttctctacatacgtgtgtacacgtatacatacacatatgcatgcgtgcatacatattcttgggggtgttttgccttctttgtacaattacgaatatctttagatccatgcatactttctgatggaacttcatccctgaagtatgcatactgtacaggcaaggttaaacgaaactccacgaagaaaaatgcaaaacgctcaacgctccagaagcccccagcggcccccggcagccaccttcctccctgcagaggcacccggggtctgcgcgtgcaattcccgcgctctatctagcactcactgtcacctgctcacttccttaaacaatacatggattccctttgccttttttcaaattttacagatatcattttggcctttttttctttggaactttccatacgcaatatcagactctatgtattcctctgtggcctccacgttcccctccacagcatgtctgagattcacgcgccttgatgaatgcagttggcattcattcattctcccaccagcgcactgtactccacgtgtgagcaactcacggcatccggatcctttcttgttcacaggcacttgcatcatttccagcgtcttgctgttatgaacagaggtgcttggaaacttctcgtgtgtgtctcctggcccacgtgggagaatgtgtcaggggtgtgtgccatggagtcacatgctggtttgcacagcaggtgtgtctttcatattagtgggcaatgactactgttttctaaagaggttgcaagatttgggactttttttcatgtttttcttttttctttttttttgagatggagtcttgctctgtcgcccaggctggagtacagtggtgcgatcttggctcactgccagctccgcctcccaggttcatgccattctcctgcctccgcctcccaagtaggtgggactacaggcgcccgttgccatgtccagctaattttttgtatttttagtagagacagggtttcaccgtgttagctaggatggtctcgatctcctgacctcgtgatccgcccacctcggcctcccaaagtgctgggattacaggcatgagccgccgcacccggccatgtttttctttttttaaaaacaaagtgtagaaactcaaaaggctctggaagacctggccatgtgcagcagtgttatgagttaaactgtgtcccccaaaaagaggtgtggaagtcctcaccccaggatctcaggaggtgaccttatttggaaggagggtcattacagatgtaattaagatatcaattaatgtgaggtcataggggagtagggtgggccctacatccaatgactgctgtccttgtaagaagaggggaacttgtttttttttttttttctttgagatggagtctcacactgtcacccaggctggagtgtagtggcacaatctcagctcactgcaacctcggcctcccgggttcaagcaattctcctgcctcagcctcccaagtagctgggattacaggcacgcaccaccatgcccagctaatttttgcatttttagtagagacagggtcttactatgttggccaagctagtctccaactcctgacctcaaattatctgcccacttctgcctcccaaagtgctgggatcacaggcatgagccattgcgcccaaccagaagaggggaatttggacacagacacacagggagcccaccatgtgacaataaaggccgagactggagccaggcagcgcaagccagggaaggccaaggagtgtcagcaccaccagaagctggaagaggccaggaagggcctcctggagcctctggagggagcgctgccctgctgacaccctgacctttgtcttccagcatccaatgacacagtaaaagtttgctgttttaagccagacagtctgtgggttttgtttttttttttgagacagagtctccctttgttattggggctggagtgcagtggcgtgatctcagctcactgtaacctccgcctcccaggttctaagagattctcctgcctcagcctccagagtagctgggattgcaggcgtgccccaacatgcctggctaattttgcattttttaagtagagatggtgtttcaccatatgggctaggctggtctccaactcctgacctcaggtgatccacctgccttggcctcccaaaatgctgggactgcaggcatgagccaccatgtccagcccaacctgtggtttcttagcagccctaagaaataagtacaagcagcattccaggcccttccttcatcccatcctccagtctttgtctcagtgaccaaataggccttgggtctgttgctgtgagagcaaggatgaccaagcccttctgcagatctccaagagtctgtgtgctcctctgagcctggggtgagcctctgagcccttctcaacacagggctgcaggcctcccctccccactaacttaacaacacgggagtactggatgtccccatggccgtgttagaggtttctggagagggaagaggaagtgggcagctatgctgctcctggctggggggctgtggtcccagggccttgctttaatgggttaactggaaaggcaaaaggaaggaaagaagagaagcctgcttagattggattccccccatgcacagaacccattcgtggacatgccatctgcaatgcttcatggaagacatcttccgatggcagagggggatcatgaactcaacactcagcctccctctgaaccaagagctgttggggaatgagtagggggtggagaacagtgggtgggcctagaaggagaagctgaacattgcctatacacctctgcctaatgcagcccacaccccgctcctcctggtggactctgtgatgagggcctgatacctggtgtgggactgtcctctaggtggccttggacgagcccagttctcccctctcttttgctttcagttcttaagaataaccatagaatgtgctagaaatgcaacaccccgagagagggagggctgactggaatagcctgagctctgtcccagtcttccccggaaacatgatgtccatcaacactttagtccaaaagtcatatggccccggggtataaaacccaggaggagctgctttccagggtcccttagtggcggcgcaagggagcacatgcagtcaagactccggtcagctttcctgagccttacaggctggctcggccgaatcccaggcttctattgtcccttgctgcatatctgtaagcaatgaaccagttcatggaactcgctgtgtgggcggctggctcaccaggctaggacaaggtggtaagcggcgcgtggtgaacctgctccacaccttggggcagagctgtcaggccattcagtccaatcctggggtttggtggtagaaggaagcccacccacccacaggtctaagccaccttggccggtattggctttgttggcaacaagggaggaacttgctctctgtggctcttacatcctcggtctgtctctttgttggttagtggggaggtgagggtgggcaccagcatttactggggccactcagaccccagctgtccctgagagggctgctgaggaaggagtggcagacagcgtggatgccgagaccagagcctgcctctgggaaatggacagaggccttggaacccatcctcccttcactgtccttgccgttaggatgcccttccctgcattcagggcctcagctgctcatcaggatggggggcacatgagattgccattcttgtaggttgataagagttcaatatttgctagtttgacatgatgcaactgaacggaccccacggccgactgctccttgctccgataagtagctactgagctgaaggtccccgagaagtctcaatgagcagaaggcccaggccctgcgtctgttggcgaccccacactgggctgtcggaactggctccagggaccccaagaggaggccctccccagcctgggaggggcctggatggcacctctgagttggggcctacaatgagatcagagggtgagctgagcagaggatgtgaattcgagtgctaggaccgcccgaggagggcgctgggtggtactggggaggcagagacaactcaggaggctgaaagtccagggatgagggaggcagggccaggccacgaggacagaggaggcactgttccccacagaccctggaaccaggtccctggtgcccagtgctgggtcctgagcaagttctcctgagggttaaaacattcacacctgagaaggaaggcagggtggggtgtggggggatctgaggcctccggaggctgctgggtgaaggctgggagtgccagaagggagtacttccaggctggggtggcccagagcctctccctggcccaggggactcctgccaggctggctcctgaccagtccccaggcgaggggagcctgcggggcgtcccccgacaggggccgctgaggaagaggagatgacaaatgccccgcaaagggccacagggtgcagcagccaggggcagagccgtgtgtgctcctgtgtgtgtctatgatagtgtgtgtgtatgtgtgtgagacagtgtctgagagtgtgttgtgtgtcactgtgtgtcactgagtgtgtgcctatgagcgtgtgtgtctatgagtgtgtgtgtaggtgtggcagtgtctgagtgtgtgtatatgtgtgtgtctatgagagtgtgtatgtgtgtgagtgtgactgagagtatgctaatgtatgtgtgtcactgaaagggtgtgtgagctgtctgtgtgtgtgtgtcagtgtctatgaatgtgtgagtgtgagtgtctgagtgtgttgtgtgtgtgtgcatgtgtgtcactgagagtgcatgtgtgtcaatgtctatgatggtgtatgtttgtcagtgcctgagagagtatgtgtgtgtgtgtgtgtgagtgtgtagtgcatgtacatgcatgttaaaaccctttaaaaatgtaaaaatcttcctcagaaactcagtcatggatggaatgtggcccccaggccagagttcacccagccctgccataaaagaaagaaacgcgaggaacggagtggggaggtggagcagatttgtcaaaacgggcagtcagagcctctgcagagctgatcgtgggcttcagagcagagctagggggcagacgcagctgtcgccacgggaagcataggaaccctcagaaccccacgggacctacaaagcctagagcaagctcgagttcagagttaacgggagaagaaggtggccggaatgagggaaagaggctttcatgatcaaggtggagtttaccccacgtgcatatgaccaaaactctgaaaaacagtatttttctgaataaacgtctaccatgccaagcatgttagaaatgtttgattcaaagagaacacatggacacaggaaggggaacatcacacaccggggcctgttgtggggtcgggggagaggggagggatagcattgggagatatacctaatgctaaatgacgagttaatgggtgcagcacaccaacatggcacatggatacatatgtaacaaacctgcacgttgtgcacatgtaccctaaaacttaaagtataataataataaaaaaaagatgtttgattcaggctgggcacagtggctcacgcttggaatctcagcactttggggggcgaggcaggtggatcacttgaagttaggagtttgagaccagcctggcaacatggtgaaaccccgtctctactaaaaatacaaaaattagccagacgtggtggcacgcctgtaatcccagctactcaggaggctgaagcaggagaatcatttgaacccaggaggcagaggttgcagtgagccaagatcacaccactgcactccagcctgggcaacagagttaagactcggtctcagaaaaaaaaaaaaaaaaagaaatgtttgattctgatgtgattcgtgcaggggtgatttcagaaggtcagaatgaacccactgagagggaaaagtctttgaacaaaaggacaaaagtctccagagttaaccgccatttatgtctagcctaaccatctgaggaaggaacgttctagaatcccagggccaccccgccctaggttccaatgaatggcccctggctctgcccacagccaggcctggcctcacctgcaggtgatgtgcatggctcggattcagtaattaagtcataaaacacaaggctggctacttagagcagaattacgaggcatttcagcttgtgaatacggtaatccagcttaattaacaccgactgggagagcaaggcgcaggcttctgggttaaatcagcccatgcggaaaccctggccgccgcttaccctcatcacgctatgctgagcatttgtcattgtgtggaataaaaataaacctgagcttggaaaactgggcaggtgaccctggaaaggcccggaaaccacccaaggctggctctccagggcctttgtgttaaaatggaacaaatccagcaaccctgagaggcgtatccagggcaggcgagcttctctgggacaggggacacacaggctgacccggcagatggccaggagatggacggggtgaatcattgcaggtgccgtgcacagccgccccagtcccttacccacacccttcgtcctgcaggctcgatctcccttcaggacccccgctttctgcccatggccctgcccaggggaggcggaccccagcccagcctgtgacactctaaggacttcctgagggttcatcatttcagcctgacaaccacccttgggttagattcttattgctcgctgtaattaattactacaaatttagtggcttaaaacaacaaaaatgttcttacgtgccagttctgtaggtcagagggccaacccagggctcaggaggctgagagagcggcgttggcagggctggctccttccgaaagctctcagcgagggtcctttcctgtctcttccagctctggggacccctggcgttccttagctgagggttcattactccaagttctgccttggggggtcccatggacttctcccctgcatgcatcaaatctacctctgcctcccccttataaggacgcctgtggtcacactcaggcccccctaagcgatccgtgatgacctcctgattgcagcaagatccctcagttcattgcatctgcaaagccgcctttcccatggaaggcagtcggtcgacaggctctggggataagcacgtggacatcttggggacccttattcagctggccactggcaggcacaactgggctctgcagagaggctgcccagggacccttccaggcagtgataacgcctcagggcccctctcttccccatctccctcattctctttggggctgtcctggctgcctccatgaggcgtgctagtcagtgccggctcacagggaggaggcctccataacagcaaggcccttggatgctggagggtgagacgctgcccagtgtgaaatctacctctgttaccatgggacttggaggagcacgtttggggctcagctctgctaactgatgctcagggaggcaggaggggagagttttaaaagagccacaaagtaccccggaacttagaaggacacttgaggaccttgtttaagactggaacagaatgtctatcctgggagagggtgtgctggtctccctctctcttctcataaggacacggatcccatcatgagtccccaccctctgacctcatcaagccctagccccctcccaaaggccctgctcctgacaccatcctggtgggggttagggttccaacatttgagtgtgggggtcacacagacattcggtccacggcaccaagctgatgcttcctggtgtctgagatggggagaggcctctgcatagcccggctggctcttctctttcccaaggcagaagaatcattaccttgccggggcctcatcagaacaaaaatgtaattgttttgtgccttttagaaacctcctgagttgggagaaatggagattttggtggctgtccatgaagtacttaattaagcagaacaggtaatcccatcgttattacaagaaacacacagagctccaatatctgtggaaatgcagttgcctgtgggcctggaggctgcctgccccgcctggtctcccccacccccaccatgggcgccttccttcacaactatctgggttgttgcattaaggcttgtcttgcccccagacaaaatgtggagtctgttgttaccgtctgaatgtctgtatccccccaagttcctatgttgacacatttggagacagggcctttattggaggtaactcgggttatacgaggtcataagggtggggccctgatccaatgggattagtgtccttataagaagaaactccagagagcttggtggcactttcacacacactctctctctctcctctctctgccatgtgaggaagccagctgcctataagcaggaagcgacccctcaccaggaaccaaattgctggcaccttgatctgggacttctagtctccaaataaatgcttgtttaagccccctggtctgtcgaaccttattacagcaacccaaactgaataagacatgtggggtccggtatgacgtaatatctgtgtgaccacaacaggcctcagtttctccatctgaaatggggatggatggtaacagcacctgcctcaaaggctgtgggggctgaaatgaaagctcaggcaccaaggcaccgggatcgggcagggtgtgatcccgacttcacctctacaggctcacatcaatgacagcagcccctgggcagcctgctctgacctcccaggaagacccaatttctggggtgtccaaggggcagtcctagacacttgaggagattaagtgtcataagacatcagcccctcttgtcctgatcactattttgcagatgaggaaaccgaggcaggagcggccagggtactcatttgaggtcacaggtggaacatgcgaagcagaacccagaccagcttggagcccagcactgcatggctattgcttatgccctgcacaccatctgcccatttctttctggcctggctcctgcctctgccccaccacactgccagatgcacaccaaaggctgtgcccctacagcacccttggcgaggacgtggcccatggcaggtgcttgggaaatacgggtggactgggtggaaggaaggaaggagagaggggactggaaattcttcccagctccttcatttcccagatggaaggtgatttcatcagatgggaggtctgatacggtagccccagccatgcgtggctgcttacattacaaaacaacccaggcaagtgagtgtagaaggggagactctgcctgaggacgtgggtatggggaagaatgatggagatacatggggatgatccattgctgtaactcttctggagacacccataaatgatcccagaaaagcatgattgagggcttaatggcagaggtgatcaagtgtgactgacaggtgttgccgacagacatcccagcctgcacacccccaggcctggccagctcttctgtccacacaggaggggtgagggccaacttctgagctcgtttctcttcccggctctgtccacacggtgccgggaggttctggagctgagcccagcgccatgtggaggggcctggcccaccttgctgggctggctgccccaggcacattggggcaaaggggtgtttgcctgtcactagtggggtgggtgagcctgacaagaacagctggtcaaccactcctcggctccttctagaaccatccaaacccagcaggatgtccaatggaatggacgtctccaatccaacacagcaccgcaacttcccctgcctgccaaaggcttccccgtctcagcaaagggccccacagctgcccggcagtgtatggaagagcccaggactcaactcatgtcaacccccgcccccacctgtgctgtgccccaaaaccacccccagcctcagtcctctccaccccggtgtttgatgtggaacagccgccaatggggcttcctgaccctctgtgcgagtgtcctgggcttttgttacaaagcaacacaaactggggggcttaaaacaacagaaattgattcactcacagttcaggcggcctccagtccaagaccaaagcttctgggaggggccatccgttccggggccctccctcagctccaggggctgcggccaccctggtgccctccccttggcttgtaactgcacctgccagcctctgcacgtggccttctgctcatgatctcaagatctcatctcaagatccttaactataaatgacatctaaggacatctgcgaagaccgtgtttccaaatgagattcccagtggacacagttctgtggaacaccatccaaccccctactgtctccaatccagtctccgaacggaagtcaaacaagctgaacaacacacacgcgcaagcaccactgctccctgccacaaaccctgtcacctggggagtagagtctaaattcttctccacagccaggtgcggtggctcacacctgtaatcccagcactttgggaggccgaggcgggtggatcacctgaggtcaggagtttgagaccagcctgaccaacatggtgaaaccccatctctactaaaaatacaaaattagccaggcatggtggcacacacctgcaatcccagctactagggaggctgaggcaggagaatggcgtgaacccgggaggcggagtttgcagtgagccaagatcgcgccactgcactccagcctgagtgacagagcgagatttcgtctcaatcaaaaaaaaaaaaaattcctctccacatcctgtggggcctgtgcctgcctctcccacccttcccgcacttgggtgcatggcctctgcccctccaggtccccgggcggtttttgcctctggggctctaagcccacctcctccgaggttgccgaccttccctgccggccagcactgcacagctattgcttatgctccacgcaccatttgcccttttggaggatcatcgttatttattcatttctttctggcctggctcctgcctctgtcccatcatgcagccagatgcaccccgaaggctgcgcccccacagcacccttgatgaggacacggcccatggcaggtgcttgggaaatatgggtggactggctggaaggaaggaaggaaggagagaggggactggaaattcttcccagctccttcatttcccagatggaaggtggttttcatcaaatgggaggtctgatacagtagccccagccacccgcggctgcttaagtttcaattaattgatattaaatacgtaaaactaagaattagctcctcagccacactggctgcattttgagtgctcagtagctgtgtgtggccagtggtgccatatcgagcacatgggacatttccagaaagttctaccagacagagttgctttagaccaaggaaggagagagaattcagggctgtcagcattatgaaggtcccagggcatctcttccagcctatggcccctcccaggccagggcagggtgtggacagcaacagagaccccactggggagctggggtataggatgggtcacaactcagggctaagggtgcgcccagagctgccaccaagaactggagccatgggaggcagggcaccttcgtccctgtgcagggaggggcagccttgggtgtggacttctgggagcagaggccctggtttccctaggggaggggtgggcccggagcttcctgggagcctgcagcctcaggaggggctgaggccgggggagtgtgcaggactaacggacaccatgcctgccacttcctgagctgagggcagagctgatgggggcgggctgtcacctgcatggtcttattcccaggcttgcatcctacccctctcccccatggaggaggtgggaatggagcaacgcccccagccaatcccctggttccctggtgctcccaagggattcctgccagctctgcggccctcagacttgaggccagggggtgttggacacactgcacccctcacagagagaggaacaaccatcccctcctgcctgagccaggattcacccccagacatccctcagaatccatttccatctttccaaagagatgctcccatggccacaaccttcttcaaaaaaaaaaaaaagaaaaagcctcaaaccgtctttcccttaaggcagcagtcctcagccaggggtgatggtgcccccccaaaccccagggaaccagaggaggaaccagggaaccacgtgtcaacgtctggagacattcttggttttcacaactgggggctggtgctggcatggagtggggagaggccaggctgctgctggacaccccacagtgtgcaggaggggcccgcagcagagtgatcctgctagaaacgtccccggtgtcgtcctggggcaacactgtcccagttccacacctggcagggcggctctgcgaaatgcctccacccagagcctggtctctatcggctccctcacctggtggcctgcggggggtgtcccaagggttctcaccaggagtttagccaatgtacagtttgagagaacagcccccacaagaccacccttcctcaattcagacaccagctgcaagttctgggggtctccaagaccaccctcaggtttggtgatttgtgggaaagactcgtagaactcactaaaagcacctatgctcacagttatggtttattacagcaaagggatccaggctgagatcaggcaaggacaggcaggcgtggggggcagagtccaggagggtccagacatggggtgtctgccgtcctccctgggaaagtggggataagtccctcccagagatgacgtgtgacaacacgcatggggcattgccgccagggatgctcccagacctttggtgtcccgagtctttgctggggctctgtcacacactgccttggtggcagggctttagtttccagctcctcctggaggttagggctaatccttctggtctccagtttcttctggaggtccaagctgatgtggcatgacccagagctcccaccataaatcacactgtcagactgtccagcagtcaaagcccccaggcaaacagagacacatacatcaggcaggatattctgggagcccagagaccacctcccaggaggtgaaggcaaaggttagctctctctttggatcaagttggtgcttcactacccagacctccctccctccattttagatcagaaaactgaggcccagaccttaggaaatctgagcaggctctgagcagtggaggatgtgggctctgagccagtccctgcactctcctcttttactcaggcccctccgctccccaagtcccctgcctcccagaggtccacaagcccaagctgggggaaatctcagtgcagcctcttggatctctgtgcaaaaatgaaaaaaaaaaaaaaaaaaaaaaaaaaaagacacgtttgtgcataaaatacacactgtagaggaaggaaaaatgcaggaagagaagtttccagtaattcaccccatggcaaccaccaggccagcgtgggacctggagtattaatcctctaaacctggggcccctcccgctcggagggctgagggctgcaggcctctggggcctccccgcctccagttccgctgccttgttctcactcccaggcagcctccgtcccagcctcccatcccggctgagcatggtaccccgcacacacggttgctaagaaaccgttgccaagagtcacaactcagctggcaacggaaaacacccccagcagcaccgtttgctgggcccatttaggaagacatgttttctggtccactcaatgcctcatcctctttgcaaacatttcaaacgttttcttttacatggcttctagatatcacttagcatgcactctatatttaggaacggttatgaaacaaacatatcacccacaatatctgcactgactatggcatgaagcctggtactgggatcaagaggcagggagacaccagggaaaaatcctgcctcatatcacagcgaagcctggtgctcctggctgatttgggagcttgtcggtaagtctcatctggtcaagttcgacaacccccaggtggcaagctttacgccacaaagcccattggactgcaggaaacaggaaagatggacagctctagtcctcggccagaggcagagctcgtcagtcagtctcatctggtctaatcccacaaccgccgagtggcaagctttatgccacagagcccactggactgcaagaaacaggagagaccgatggctccagccctggaccagaggctactatccctgtagtacctctgaaaggccaatccttgtagcagccctgaaaggtccagatgcagccccttattctgcagaggaggagtccaaggtggcccacccacaggaggcagagctggcctctgttgctgtagtggagaaatactgcaccccaagccacatcatgacactcttcagcccagagtgggcagcctgaagaggaaagactccatcccagcaaggatgaaggctgcggttcccaggtcctccgtcagcacgtatctcatttcctgggcacccaagacagggaccccgggaggccctttggttggctttggcgcagccgtgaaggtcagatgggagcctggaggtggggggcgtgggggtggcatggtgttgggggactttgtccctgaagtgtctcctctcacagctcgctctagcactaaaggttcctgtttttgaggtttgtgatattagagttgttccccaaaattccgattttcctccttcttgggcacacacagggctgcaggtctccaccctcctgaagttaggtgcggccaagtgagccggcggctgcagggacgtgtgtcactccaggaaagatgaagaccaactcaccacccaccacactgcccttgaacccagatgtggcaactataaatggatgatggtccagctggtgggggcgtcacccaacccggttcctaagtgaggagggcaaaggacagcacccagcagacctgacagggcagtgagagtgagcaggaaataagcctttgtttttttaagccatggcaacctggagattatttgctactgcagcctaaccccgctgtcctgactgttacaggtcaggtggctacagcagaatagcccttatcctaaacgcttggactagaagtattctggattgcatatatttttggattttggaatatttgcatgtacatttggtatatctgcacatataatcacatatatcctggagatgggacccaagtctaaatatgaaattcacgtatgctttatacacatagcctgaaggtaattttatacaacatttaaagaattttgtgcatgaaacagttttcattgtgttttgactgggacttaccccatgaggtcaggcttggaattttatacctgtggcatcatgttgatgctcaaaaagtttggggttttagagcattttggattttggatttttagatgagctcaacctggattggacctcaaagggtgcccttatacaaggtcaacatgcctagcaaggaagagagttgttttttgtttttttttgaaacagagtctcgctctgtcgcccaggctggagtgcaatggtgtgagcttggctcactgaaatagcggccttccagcttcaagcgattctcctgcctcagcctcctgagtagctgggattacaggcgcatgccaccatgcccagctaatttttgtatttttagtagagacggggtttcaccatgttggccaggctggtctcgaactcctgacctcaggtgatccacccgcttcagcctcccaccatgcctggctgagagttcttaaaactgaagatctcccaggtaagcccatctttgtgtggcaggatccacaggttaggctgggagggtccgggagcagaacgtggaagccaaattctgacgggcgcagcaggggtggaggctgatggcaccaaagtcgggggcggagagggcagtaaacacatgtgcccccctctgtcctacccaggcctcggtttccctgctcgcaaagtaagcatagtcactactaagcagtgccttaatatatcaagagctcttttccccggggcctccttcagtccttatagtagctctgaaatgtcctgcaacagctccctattttgcagaggaggagcctaaggcggcccacccatgggaggcagagctggcctcgacgccagccccatgctcactccacacccagcatcatgatgctgctgtcatcccccaacttccggcttcccgagctccaggcagtggagacccaccatacagcaggctgttagcaccgcctctgggtggtgaggggctgccgaagtttcggcccacctgccctccccaggacaggctcaaactgagtgtctaggaagagtctcttgactaggggagtgaacaggtcccagaggatcacagtactgctgtgggctctggctgggtaaatcatcccagctctggggctctgggctgcagcgcggcaaggcagtgtgttctgcacaaagacaggatgtacttggggagaggctgtaccattgttgtgagcggaagagaaattaattttaagcctggagttgattccagcctgggagggaaacgccaacacttggagagggatggtttcaggcatgtgcgcgccacagctcacgtgctcactgcagcctgaattcagtggggaaacgcgccccgggcaccctccctcctctgtcagtgttccaagccacccccacatcccagcaccggaagagcctggcccctccttccatctagagagccttgggtgtgttctccgctgagccacaccctgtcccctgccccaccaactaaaacacaccacccaggctgctgccgaaaaggctgggagaggggcagcgagccagactgaaaccgcctctttcgaactctctgaagggtttggtcagttctctgtcatttaacctagtgcttggtgatgaggacacagaatagagtgtggctctgctgctggcctcccgggtctccaggcctgatggagtgggacacacggacgtccagcaggttccggcctggcgggagagggaggtctggatcacaggctgcgggccaccgtgaccctgggggccgcatgtggtgggaagggcagcgggatgagctggcaaacactggggactccagctcccctaagggcctccgaactgctgccacagccgctactgctaggtgcactctgacatcagctccaagccggggagagggggtgctgccgtcaggaaggtgccacctgggccagaggcacgggacaccagggagcacctgctgcagagctggatgatcctggtgccctctaatgccctgactccaataagcctatctctgggcctcagtttccccaagtgtgcaatgaagggcctggccatccagacccccagcagatccggccccctgacatccattctagtccccttcctcactatgaggaccctaatattgtcttggcagttaacagacccagctacaaaaccccttttctcagtttcccctggctgctaggagtgaccaggagaccccagggtgcttatcaatgagacaggagaggacatcgtctgtgggcttccagagaggggcagacagcatgcacactgcttttgctcctggccctggtccgggagatgcactaccgtgggctttggcccccactcagcttgccctatgctagaaggttccctgatggcagtggggtgaggtgggctgcagagcccacgcttagagcaagagaaaggtcagccatcctgctgggctggcactgaccttgcaggtgccctgaggccagacggcaggcagcagcgatgccccaggtcccaggccccagaaggctggtcagcccccaggacaggaaccaggccacggctgaggactgtgagggtggcagacagaaggacaatcagacccaggctgcccaggcagaggcggggccaggaagagatctgcggacaaagtggcatctctaggcctctggaaattgtgtgtgatttcaagcaaagagacggtagtggttgaattttgtccccctaaaatccacgtctatgtagaacctcagagtgtgaccttctttggaagtaaggttgctggagatgcaatcacttgggatgaggtcatcctggaataagtgggccctaagtccactggttggtgcccttataaggagggaaaatacagacacacagagacatggccacgtgcagatggaagcagagactgggggatgtggccacaagccaaagaacacctggactccccagaagctgaaagagacaaggaagggtcctcccctagagcactggagggagagggccctgccgacaccttgacattggtctctgcctccagaactgtgaggggagacacttctgttgttcaagccccagctggtggctttgaaccctttgtgagagcagccccaggacaccagcacaaagggtgagcatgtaggaggccagtgtggtgacctgcgcatcctgtggtccctccctccggcgcccaacgcatcctcaggactagccggggcctggggaccggacagggagcaactggcagcagagggtgatgacagagcctgcattccggaatctgacccacaaagggctgtggcattcataggagaagccacggaagaccggcaggaatgacagaagcagcagcgagagcccttcagaggaccgcgaaacgcgaactcccaccccagcaaaccaccaaggggaagaggcgggcccccatccaggaggccttaggaacaggagagctgacttttctaaagcaaataaggtccaggttgcctaaaacaggggagggtagcctaaggctctcccagactcatgacaacttagaattgtacaagtggcacatttagctagaatctgggaggagcctgctgggggccgtgccattctgagggttcccggagttacacacacacacacacacacacacacacacacacccacacaacctccctcccacctgccttctccaaataaaaccatgtccctggtccttttctcttggtatccaccttctccatcatggaggaggtctcagctcctaatccactcggcaaagtcccagcggacagtgagtcactgagtgctgggccaggcacaagctgagctcagggcctccaaggcaaggtgacccagagggcgctgggaataggacagcgtaggtgcccccgcagtgggggatgtggctgggtgtctgtgaggatgcttcctgcatgacaagctggggttataagaacacaaaagcctgtaggatgaagcctggcccaaagcagtcggggtcccctgacctccccggcctctctccaggcagtgttctccccagggcgccaggcttccccagctccaagtctgggcgtctgaaatctgctgtgtaattggatcacgcccggcccgtgctgagcgcccatctgcgcccgtcttggaaaacacaagtctcagagaaggaaagcagttgccacaggtaattttctatcaaatatattacatttcttggaatcacacgcagaaattaactaattagattcccccttatttttgaaatgctttcagaggacaatggaaaggttcactctgttctgggaaacgcttcatttagacgctaaacattagaatgcgatttgtccttcaatcagggaagagtggactgagcggacatttttgtttttgtttttgagacagtctcgctctgtcacccaggctggagtgcagtggcgcgatctcggctcactgcaagctctgcctcccgggttcatgccattctcctgcctcagcctcccgagtagctgggactacaggtgcccaccatcacgcccggctaattttttttttgtatttttagtagagacggggttttaccgtgttagccaggatggtctcgatctcctgacctcgtgatccgcccgcctcagcctcccaactggcggacttttaaggatgctatccacgctccctgctcctggttccatcacgggccccgaacagctgcaggtgtgtgaaggcagtctgggaaacacttctgagtcagacccacctctctggttcaaccagaggctcctttctctccttgataacaatccaaattgtgattgttttatagaaccgccttttacaacagaatcatctccccacataccattttccctgatgctgcctgacaatccttgtctcccagggatgtgggcacacagccacatgctgctctacctcccacccgccctgagcactcggtggatgctgggactctgccggccagccaaccagaaaagggcgcatgagggtacatccgggctgcagaagaacatactaattggtttattttttgaaacaaggtcatgttgatctggaaggtaactcgggggaagagtagacaggaccagagggaggacagaggacaaggacatcattcagcaagatgagggcttgggaagctgggtctctgagaagcctgggcccctttaatcccagtgagccccttgcatggagcgttgatggatacggggcagggggacaaggacaggcgcaggtgctcattgaggagagaggtcctgggatccccagacctgggcatgagggggctgccactgggcacagatgggcaacctgggcaccatgcagaatagtgtctgcagctgatttagacacgttgaatatataaatacgttatatatattatgtatgttatatataacatatttatacatatattcatatacgtaacataaatgttatatttttatatatgtattacataaaaatatattgtatataatatatattctatataaaacatgtataagtatatttatatatatataaataacactgagttgaatatacaaaaatcctgagttcataatgacatactggtgaggaagagagagacagaccagggcagagaagacacagggagagtgaaaaagaccctacttcatccctcaacaacatgatagaaaaccaactcactggacatcagtagagatcactgaagcatcagcttcctatagagagacttgacaatgaaaaagaaagaattaagcatttatcttgccttcttgtacaaacagtgttcagcttaaccaagtcatcttatttgatatgtgaaagttcttcgagatggaagaatctcagctcatcactgcgaaggcatgccaggattaggaagtcatcagatgcaagcctgcaagcctcagtgtactcctcaatgtctgcagggcccaccccagagagaggcccctgggtgaccagccggtgaggagcttcaagaggaaggattcaccatcaccacctggatcctgtgtgcagcttttgtcacagcggtggcgagcacagtttctgcctcctggggagatggggtgtgaagctcacagcacctgcgtgtggctgggcccaacattaacagcgctgcaagagctcacctccatttataggaagtgggaaggacccaaggactggccgatgacaccacaggaggcagaaggcacatcgggggttgggggtagcctatggccaacctaccctgtccctctaacaacctaccctgtccctataacacgttgctggcaggaaacacgggagatggctcagactggagacctggggacatatctaccaagtgccacgtgggtcctgggtcaaagtcaccaccgtgaaaagacatttctgagataatttgggacatgtgctaatggaggggtttcagattccacccagagaccactgctgggtgcgtggatgggacagtgacactggggcccgcaagaaagatcccatgctgtgagagacagactgaaggggaagagggagtgacgcgatgcctgggatttgctgaagaaaaaaaaaagaataaaaaggtccgtctgtatatggatggcaagaatttcttggtaacaaaagcacagccaataaaagaaaaaataaatactaaggtcgatgaaaatttaaaacttttgtgcatcaaagggcaccatcaacagagcaaaaaggcagctaaagaatgggaggaaatatttgcaaatcatgtatctggtaaggggttagtatccagaatgtgcagaaaactcttacaactcaacaacagaaacaaaaatctaatttaaaaatgggcaaactggccaggtgaggtggctcatgcctgtaatcccagcactttgggaggccgaggtgggcggatcacttgaggtcaggagttcgagaccagactggccaacatggcaaaaccccatctccactaaaatttcaaaaattagccaggtgtgatggcacgtccctgtaaccccagttactcgggaggctgaggcagaagaattgctggaacccaggaggcaaaggtcgcagtgaggtgagatcacgccactgcactctagcctgggtgacagagtgagactccgtctcataaataaataaataaaaatgggtaaaggacttgaatagacatttctccaaagaagagatacaaatggctgataaggacttttctgaaaagatgttcaacaccactaatcaattagagaaaggcaaatccaaactacaacgggacaccatctcacacctgttaggatggccacgatcctaaaacagaaagtaatgacgctggtgagtatgtggggaaactggagcccttgggcaccgctggcaggaaggtaaagtggtgcagcccctgtggaacatggcatggctgctcctcaaaaccttaaacacagaacgagcacgtgagccagcaatgccacttctgcatctatgcccgaaggcattgacagcggggtcttgaagagatatctgcacacccgcgttcacggtggcagcactattcatggtagctaagaggtggacgcaacctaagtgtccacctacagatgaacagacacacaaaaggtggtgtttccgtagagttgggatagttatcattcaggcttaaaccagaaggagattctgatgcatgctacaacacggaggaacctcgaaggtattacactgagtgaaatgtaccaagcacaaaaagataaatactgcaggattccactgacctgaggtccctagagtggtcaaattcatagggagagaaagtgggatggtgggtgccaggggccgggggaggggatggggatgagtgttaatagggaagagtttcagtttgggaagatgagaaggttctggagatggatggtggtgatggtgaatggaaatgtacttaatgccactgaaatgtatacttaaaaatggttaagatggtaaattttacggtatgtgcactgtactacaattttaaacataatacaaagtataactgtaaaaaaaaaaaggggggaggaagtgaatggagcaaatggcggctgtgatctcttgggggccagctctccacaaggtcttcataaaccctcggtcacgctcatctgctgctcaagggcctccaatggctccccattgccctaggccttgacacagcctgaaaggccccgtagggcatgaggcccgcccctttctctgccacatccacccctcccgaatgttccagaatacgcagagtctttccctggtccaggtggggccttgcactcaccaccccggtgcccggcccaccctcacctcagctctaccctcctcttcaggtctcagcctaaatccttccccttggggagccttccctgaccactctgtcgacaaaggcgtggtctctgccctgtagctgcacagcatcctagtgtgtgtgagagtatatgcgtgagcatgtgtgaatgcatgtcagcacgtgtgtgtgtgtgaatgtgagtctgagtgtatgagcatgcgtgtatgcgagcatgcatgtgtgtgtacatgtatgagtatgtgtgtgagcagatgtgtgagcgtgtgaatgttagcatgtgtgaatgcgtgttagtacatgtgcatatgtgtgtatgaatgtgagtctgtgtgtatgagtgtgtatgcgagcatgtgtgagcatgtgtgcaagtgtgtgagcatatgaatatgtgtgagcacgtgtgagcatctgtgtatgtgtaagcacgtgtgtgaacatatgtacgaggatgcatgagaatgtgtgaatatgtgtgagcatgtgtgaatgcgtgttagtacatgtgcatgtgtgtgtatgaatgtgagtctgtgtgagtgtatgagtgtgtgtatgcgagcatgtgtgagcatgtgtgcaaatgtgtgagcatatgaatatatgtgtgagcacgtgtgagcatctgtgtatgtgtaagcacgtgtgtgaacatatgtgcgaggatgcatgatgtgtgaatatgtgtgagcatgtgtgtgagcatgtgtgtgagcatctgtgtgagcatgtgtgagcgtgtgtgtgaacatgtgtgtgggcatgtgtgagaacttgtgtatttataagaatgtatgtaagcatgtgtgaacatgtgtgtgcacatggtagcatgtgtgcaagtgtgtgtgaacatgtgtaccgtttcctggggttgtcacgacaaatcaccgcaaaccaaggggcttcaaacaacaggaatttttctctcagtctggcggcgggaagtctaagatcaaggggtaagcagggccacactcctctggtgggcacgtatgtgggtgcattcatgtgtgtgcacgtgtgtgtgcatgtgtatgggtacctgtgtgtatgtgcacgtgtgtgggtgcctgtgtgtgcatgtgtgtgtgcattagtatgtgtgtgtttccattcacagcacagccacagcctccagttatggagcctgttgacccacatagtgcctgtcaatctgtgcagtgcctgtttccccagcactcaggctctgtgagggcagggcctgctcttcctctctgcaggatcccaaaaaggcccaggctggtgctgagtacggactcagtgtgtggcccgcacacaactgattagacccagggtgcctatagagaccctcctgctattcacagatgggggcaggtggggctgggctgggtgtttactcccctcctggccgggccacggccagctctcctcctgcggtgcagaatccaggtgcccacagagacaaatgagcggccggagagccagcccatgataggcagctcctcagacctccccccaccaacccatcgggaagcagccactgcagagagggtgtgacccgtgggaggccgctgcccagcgctcaggaaggccggggcacaaaggatgctaggcactgggagtgaggctggcgccctggcgaggggagactggctgctccagaccctcgaaagccctggggcccagatcctggcagtcttgcaaaacagacctaggtgtcagacccctttccttcccgcaccccacactctaggctgcccaggggaatcccaaggagccttggtatcccagccagcctcaggctgaccagtgagtctacccagtgacggggctggagccctgtttggggtctgcgagctgcccacagctcacgccaagccggcttccgctctgtccatcaattcaggcccactgagcacaggttctcggggaatgctcaagagccccatgccaggtgggtcccattcacagatgtctgctcaccaaccagcaggaagctggaaagtacccccaggacagctagcagcccacagtgagctgtgaggcacacagcaatttggggctaattttctcctgcaaagaagttgatcccataatctggcaaatacactaatcgtcactgcactgctcagagcaggagcttagagctacagagtccggggggaacaggctcggcatagaatgagaccacggactgccggcttgaagaatgtgctgccaggatatgaaacccaaagctggcaatggaccacaagctactcccagtgacagaggacccaggccacagaccagctgctgtgctgggcacaatgcttctattgtcacggaaccctgcatccacgcccggccccgcttgcagatgggaaagctgagggtctggggctgcaggatgtgctcggcgccctgctgatgaccttccctgggccagcctgacccccggctcctctgatcctctctgctttaacggaagcaaagaatgagttgtaacagccgaggaccaaggagcagctcttctgtcaacagatgcaccggaaaatccgcggtggccgaggaagccctattttctttagtctgctcagcatttcttgtacaataataaaaacatctgaatttccaacaaatataatagaaagatttcctagaaaatgatctattctggctttggtcaaaaaagttgagagtccagccgggcacggtggctcacacctgtaatcccagcactttagaaggccgaggcgggtggatcaggagttcgagaccaacctggccaacatggtgaaaccccgtctctactaaaaatacaaaaattagctgggcatggttgcaggtacctgtaatcccagctacttgggaggctgaggcaggagaagcatttgaacacgggaggtggaggttgcagtgagccgagaccatgccactgcactccagcctgggcaacaagagtgagactccatctcaaaaaaacaaaaaaacaaaaaaaaaacaaaaaaaacattgagagtccatggctcacactgccctgagtctcacagagccagcctgggctggtgctgggaagggcttcccctgctggctgagggtctctgcagccaggacttgccactccctgatggcatctagaggcctctgtgttggggacccagatggcagcctcaggaaatggccagtttggggtggaagtgggctccgcaagtgcctgaaagggagtctcagtccatcaggcctttgctcagggtgccgtagcaaaatgccacaaactggtggcttctagacaacagaaatgtatttctcaccatgctgtgggctggaagagtcagtgtctggtgagggcccctgtcctggtttcttctcttggtgtcttcaaagggcagaaggggcaaaggggctctctggggttccttttataagggcactactcctcctcatgagggacccaccttcatgacctcatcccctcctgaaggccccaccttctaaaacaccatcacactgtggatgaggatttactgtatgaatttttcaggtgacacagaccatcacaccacagcaaagagggcctggtttttctttttcttttctttttgagagtcaatttccatctgattttcccagcaacacattaattgggtaaagccaaatccacatgagtaggtggggtgggtgcaggaaggagggtggcctgaggctcccctggctggccagggacatgaaggtgccctgcaggcccacagggtgggttctggcctccagggcctgagcggaccccccttgagccccaaggggtctttacctggctcctctctaaactctcggcctctcagtggtggagttctacgtggctgggattgggacatcagtggacccagggacggccccaaggaaggggctaggtctcagacataaggaggagggggcaggtcttcaggcccacaggcccgtctggggctcagagggctttgcccaggccgtccaggggcctggaggctgcagaacgtgcaggtgcagctgggatgtgtcgccaatggtaagcaggcaacctggggccacgcacagctagtgcagtgggctgagtggtgtctcccagaaagatgtgcccaggtcctaatctccggaactgagaatgggatcttatttggaaagagtcctcacagacataattaagttaaggaccttgagatgagaagattatcctggattacctggctgggccctaaacccagtgacaagtgtctttataagagagaggcagggggagatttgagacacagaatcgcagagaggagaaggccacgtgaagatggaggcagagacgagcgacgcagccatgagccaagggacgcctggagacacgggaagccggaagaggctgggaaggatcctcccctagagccaccatggggagcagggccctgccaggccctggatttcaaacctgtggcctccagcactgtgagtgaacgcatcgctgttgtctcaggccactcagtttctggtcatttgtgacagcggcctcaggacatgaatacagctatgcttcagagaggactgcacgaagctgaggcccgagccctgacctgggatcacaggcatgtgctggagctgggggcccactacgagcaggggagggctggggtaggaggggcgcatgcccagtcaggatccctccctgtctcccattctctagaacagtccctcaaggctgggctctggaatcctctgtaagttgctccatctcagaaagcctcagtttactcatctgtaaaacggagagtcaggcaagtccaccttgcagagctcctaggaagaatcgaggcgactgctgggtaacctgcttagcaccatgagtgcaggcaatgagcgtctacacagagagcctggggacttagagggatgcaaagagcctcttcgcttgaggcctgaaggttcagacagctaaaacatgggctggctactgcctggcatccctccctgatgaaaaataacaatagatcgtgtacagaatttttaaaattctaagtattttttttttctttactatgcttttttttctttttttcttttctttttttttttgagacgaagtcttgctgtgttgcccaggctggagtgcagtggcatgatcttggctcaccgcaagctccacctcctgggttcacaccgttctcctgcctcagcctcctgagtagctgggactacaggcgcatgccaccacgcctggataatttttttgtattagtagagatggggtttcaccgtggtagccaggatggtctcgatctcctgaccttgtgatctgcccgccttggcctcccaaagtgctgggattacaggcataagccactgcgcctggactatgcttttttcttaaacgtgctttagcttgtctaggaggatccagtacaaggcattgtgagatcaacagcagagaatggcatgtgctctccttccagaggcacagcaagaccgcctgccccagcctcccctgcagggaggaatgaccgccagttgagattgcagtcaacggaacagaagcggaagtgatatgcactttctcttctgccagccagaggcggccgagcccggtgacctgggcatctgcgtattcaggatggaggagctgggagctgggaggagcctgaagctgcttggaggagagctgcctgcccgacttgagaggggcaataaatatctttccacggctcaaatgaacagccagttttcagtatgtggcttgttacggtgtccagcattgcgggcacggacacacaatgtctaaaatgggtgcagttctacaaagcacacccgagatccctgggctgtgggcagtccagcgggcaggcaagcccctgccccagcttgcagctgtgctagcacaaaagggccaatctctctgggcaagggttgcactaggcaatcccactggggatgactcttctgggtgaccaaggttcaggctctttcctgggagttcctgggtctggagagaaggctacgggggactgggtaccaggatgggtaaggtcagaaggacaggggctggggtcactggcattcccctgagggaggccgcatttcacaggcttttccagttggtgaagcctttgcccgcagggtctctttaaaaggaaaccagacaaagccaacccaatacttgctgcgctgcgccctgacctcaaaccatcctgcctagctactggcaattaggctgcctttgagataaattttctcgcctaaaaatgcccatgggtcttaaaactttgattttccgttcgattcaaatttaaatccagaatcgcagtgctgtggggggtgggggggaaatgcccaggataaagacaatgtcctagctaacaaaccaaccagtgagtgacagaggggcctcagcaggaagtctgggcagaacggagcttgctaggtcaccccatgtgaactgctttggagaacagagtggtagctttgttagatttatggggacggcggctcagcctgtctaatcgcagttgaggcggggccgagaggtgtctcccctgtgtccacgctagctgggtgcttccctcccacggacacagaggccgggctgccacttccatccttcccctgacacctcccgtcatcttctgggaaacaccaagtgacacaaacaggacactgatttcctggaaatttatatctggctcaggagttgcacctgctgaagaggtgaagatgacaaaggccctccatgcgactgagaataacgcagagatggtccctcaggcttgagagccataatttcaccagctcgtttatttctaattagataaagaatacaagtttttaaaaaaagttactttacagaagagccaaggtgactacagttaataataatttattgcatatttcaaaatatacaagagaagatttggagtgttcccagcacaaagaaatacatgttggaggtgacgacatcgcagttatcctgatttgatccttagacatcgtgtgcatgtatcaaaacgtcacatgggcccgtacatatgtacaattactaggtatcagttaacaaatagctgagccccctgtgactcaccctccacccatctcttcctccaacgggttaccttggaggaaggcttatcttgaaggattatcacattggtgtggagctttccagaacttttgcataacatttatgttcccttggaaaatgtggagtacagagaatacatataatatttttgcatgcttttttaaaaagcagaggccgggtgcggtggctcacacctgtaatcccagcactttgggaggccgaggcgggcggatcacgaggtcaggagatcaagaccatcctggctaacacagtgaaaacccgtctctactaaaaatacaaaaaaattagccgggcgtggtggcaggtgcctgtagtcccagctcctcaggaggctgaggcaggagaatggcgtgaacccaggaggcggagcttgcagtgagctgagatcacgcgccactgcactccagcctgggcgacagagtgagactccgtctcggaaaaaaaaaaaaaaaaaaaagcagaaatattattatactacagtggttggtctgtgacctgtggttagtatttgggatggtgtcttgggaatcacgtcgtggttggtatgcaaatattcctctttcttttatacgttggcattgtttttggtcatttgaatgagggttgagctcctgccatgtgctgggtgctttctcttgtaggtgagcaagaaagacagtctttgctctcatagagttatggtcccatgggggaagactgaccaacaacaaaaggtgaacagaaaccataccgtgtgctggccagagctatgaataaacaggaagccgactaagggactgcaggtggaggggggggaggaacacagaggggcagaggagatctggggtcgggggctgagctggagctctgcccagggtctcagctgacccaagggtttgtacgtggcggcgagcaggggttatcactggtcctgtttcagagctaaggaaacatgctgggacttgccccagatttaacaggaaagcccaactattcaaaagttaaacaacaaaaagtgaagaacattgcttttttaaaaattccaaatttaaaaaaatgtagtagaagacacaaagcataaaatttgccattttacagtggccagttcatggcattaactacatttacagtgtgtgcagccatcaccagcgtgcatctccagaactttctcatcctcccaaactgaaactctgtccccattacacacgaactccccatccccttccccagcccccgacacccaccatcctactttctgtctctatgaatgtgacggatgtgactactctaggaacctcacttgagcggaatcatacagttcaaaggaagagaatgttgtatttggccactcctggcatctgtccatctgcttcccgatgggtcccaggctggatacctccatgtggggtggacgcagcgacaggaactgagggggcccccggccaagggcaggaccagcagccctcccgcatggcagctcccgcctgctgcaaatgcaagagggaggttgatcttggaagaacacacctttccaacatgcattcccagagacaatgcagatctcagcaaagtcaggggtgaggacagtgctgaaatccatctccagacctgcttgctaaaccccacagtgtcactgagtcccactttgctgtgctcatttcattgattccttcctttatgcattcagcaaacaacagcccatgccttttgccaagaccgacacctgtgcctcagacaaacacgtggagaagaaggtgactgcctttaagatgaccccagcctggcagggactatgaacaagcaggaaattcatcaaaagatctcgtcaaaggctgggcatggtggctcatggctgtaatgccagcactttgggaggctgaagcgggcagatcacctgagttcaggagttcgagacgagcctggccaacatggtgaaacccagtctttactaaaactacaaaaattagctgggcacctataatcccagctatcttaggaggctgaggcaggagaatcgcttgaacctgggaggcggagattgcagtgggccgagatcacgccactgcactccagcctgagcaacagtgagattctgtctcaaaacaaaaacaaaaacaaaaataaaaaacacatcaagaatgctttgaagaagcacacaaggtacacacaagcttcatcctgctcaatgccagaatcccggtgttgctggtcggaggcaggggctgtctaggggggctataggctggggatagggctggacatggggctgctgggcacacagcctgttctccaggaacaacaacaacaacaaaaacaaaaaacaaaaaactgaacaacaaatcagtccactgtaatcagaaggctcatcgaaaaacactctggaaaaattaactgacaacaaaaaatgtcttcccggaaaagatgaggctgggcccaatacaggaattaaaaccaatcactgctgaccccacacgggtgctgccgaggttcagctgctatatttacaacaagagaatgatgcatatgtcacgaattggaggcaacgccacctgccacaggccctcagggctgagtcccctcaaattcagtggccgacacctcacagtttcgcttcagtccagcagcagactggggagctggggcaaggcagagtgccctgggctttgagtccagcatcggggtggccaggacccccgagaaccctctgaccccctgccctgccacagcagggcatacagtgttcaagaactctggagccggagccagacttgggtttgaatcctgccctgtcactccctcatcatcacctgtgatgggtcatcctatgttcaccaaacctcagctgttccatgtgcaaactgacactaatgccatctccttcctcacactgctgagcgtggaaggggaccctggcatacagtaagtgctcaagaagtggcagaggtcattattgaaacagtccttgttattgttcccagagctgtgtggacccccagaactcgcatgctggtagcctgtggcggcaagggcagcgtttggatctcctgtgcttggtgccccctcaaacccaggacattcagtgtaaatgactgtgagcctcaggctggaaagatcgtttcccttcccagctagaaagactcatccatcaggctgtgtcagacgcacctgagccctccagggtggtcaaaggtaaggaagcttgtgtcccaagtgcagcatttagggcttcccaaggcaaagtgcccaatcaggctctctactctccaagttcgtggtgcatggtagccacagctcacctctcccaatacacaggatctccaagggccaccctgccatccctcaagttcctcagcccatgttttccctccttccttcagtttgacaataggggtggagcaaccactttgcaggatgtctctgcttaggggctatggagaagcatgggacctgaactctgcactctttgggaagaaggatcagataggattcaaatctgtttcaccaaccactaggctccaggcttgagcctaacaagcagttgctcaaaataacttggtagatgtgtgtaacccagatagataccctaaccccacgtggtccagtccttgttggaaagattttcaaggaatcacagtccagataccaaacagatagaaaacagggtttctgatctttaatagtacttctccagttattaaaaggaatctaacttttatttattttatttatttatttatttatttatttatttatttatttatttatttttgagacagagtattgctctgttgcccaggctggagtgcagtggcacaatctcggctcactgcaacctctgcttcctgggttcaagcggttctccctgcctcagcctcccgagtagctggtactacaggtgtccgccaccatgcccagcaaatttttgtattttttttagtagagataggggtttcaccacgttggccaggctggtcttgaactcttgacctcaggggatctgcctgccttggcctcccaaagtgctgggattacaggtatgagccaccgcgcccagccaaaagaaatctaacttaaagcacaaagcaatatcttttggtagccccaacttttatcatctgtatgtagaagtaagcccccagttttccttcaagtcttgcctgtgcataacttttgttccttccggctttctgcctaagctccctctgtttctttgttttcctctttcctctagaatctgcatcacagaagatatccagttgggcaagaccccgcctccctgacaggtggcacaggagggtggttggagcaggagggtgggaagtgatacgtggatcttggaagaacagcctggctctaccactcgccgtgtgtctgtgggtatgtgagtccccactctgtgctgtggcctcctcatgcagagaaaggagctgataaaagtcaccgagttaaacttaacacaaagtgagttcatgtgtgtgaactctctcaaaaacggtgctggcacacagtaggtgctcaagcagcgcaagcattttacacagtcactgccgtggctgttcggagtcttatttgcagtctgtatcatgctgctcagcagttaagcttttgttggatctgagctctgtcttaacaaaaggggacaggacccccttccctctgcggtccttctgcccaggcatgtgacgaaggtggtgaactcagcactcactgaacacccgcccatcccaccccggatggggactctggggtgtgcatcagcagtttcaagaaacacagaatgaccacctgacccagcaattccactcctaggtatgtaccctaaggaactgaaaacgaaaactggtacaaaaacgtttatgtcgacattattcacaaccataagttagaaacagcccaagtgtccctgaactagtgaatggataaactaattgtggtctaaccacatggtggaacgttattcacccacaaacagaaggtagtacggacacatgctaccatacggatgaacctaaagcacacgatgctgaaagaagccagacaaaaggttgcctagagcatgattctgtgggtggaaaatgcccggaacaggcagacccaagacccagaggggatgagtatttgcctggggctgggagggagatggagagtgagtgctaatgggtttgatggtaaattttatggtctgtgtattttaccacaataaaaaagacatacccaagtgaaaaaaaaagtgtataaacacatgacaaaatgtattactaacagacacatataaagaagtaaaattccacaaagataagccttgttatgcggacactgtctcctggtggcagcatccctggttttttctttggcttctctgcattaccaattttatttgtgtctgacatgatttactcgaaacacagtgaaataatgctaatgtaaaagctggctatcaggcagatatgggggtaaagtttactcaaaatttcctaggaccaggggtacaattccccctgtaaacccctcaggattccagtgggcctggggagagaaggctggcaccttccagggaagggctggcttctcacgctctctctgatgtaaatgaatccacccctccacctccatcagcttttcaagttcaggccctgatggagagggggaaggggtttgggaggaaggagacccttgtccaagacggaagttctatcctggctgtgctctcctcagtggtgccttcctttccttaaggaatatttattggtggcctgccatgtgctcggctctgggtggtcccttatctgatggggcatgtgcaggaagtgactatggcagagggttatgagcgggcatcacaggcaactttcagggagcagatgcaggaggtgccctggtaaagcaggtggaggaggcaaaactgtgggcaagtgtctggggacaggaggggtgtggcacattccggagaccagagagagtgtccaatggcgacgttcatctcctcactggcctggcacacgtgccatctccccttctcacccatataacccactcctccatctgcaaccccagccctgagggtgctgaaggaggtgcacatgcccaggaccgtccctgtctatctccatgaccccctaggtcctgccatggagactgaacacaaaggagatgcatgggaaagtctgctccatgggacccatctgaagatcctggggagagggaagtagagaacttgctggtgggtggttgatttcatgagaccacagcggggctaccattctcagggctccacagcatcagctctaactccccttctcatcccactctgcttactgttggcgcacacacaccctaattcccagggctgacaaactccatcaattaaaagatcctgtggggcacttagcacagggccttcctccagttcatttgccagtctaaccacttgtatcatgaaactccccacgaaagggcaccaaaggcgaagagaaatcagtactaacaagagcctgctgagaacactgggaggtgggcagtgggtgtatgggagggaggaggggggcaggtggagaggacccagaggcaccaatgggtgcatcagaggacctggcgccagcagcttccaacatggagatgtcagcccactatgcctcctgcagccttcgctccatgtagcctggggctgggtgtacagcatccacacacagaaaaagatggctgttaagattacatcccaatgatctgggacttacctggagcatcagacagacacagtgcaaaagaaacaagctttggagtcagcttagattcagacctccctggagggccctgggcaggcttcttaatctctctgaactgtgctgcatgctggagatgtagcagagacctggtcagcaaactctctgacccacagggaatgttccctgagggaggtggatagtaagtcagtcacctaacacgggagatgtatgattcctatggtcatggaagcacacggtgtgagtgtgagagtcagggcaacctgagggtgccaagaggggcctctctgagaaggcatcatgtgagctgaaacctcagtggtgaggggagtggggctcaaagcagatgcagatggacatggcaggacatagcagatgctcaaccatgttggctccttggcccctccttgtggaagagatttctccatcgagtagatgagactgtcactaagtaatgagcctctatgcccagaaactccaaggacacaggggacagaaatgaaaggtgcagggatggagggaggggacatgctgagggctttctccagactcctgaggaaggctgcatccaatcctcccagctgtctagttcagcaccctgcagagagccagtgccctggagtggttcagcaccctggagagagaccatgccacacaagggttcagcaccctggagagatccagcaatgctcttgctctgtgcagctgtacagccacacacatttgtacctacttcactaacaacccaggcccccactagaccagccggtcatgcccagcttcatagcatctgatcactccccaaatccaccttgaacattcctgaccccctaagcttttgctcaagaccttcctcctcagttctgcctgcaaaaacctcacttacccatcaaagcctggagccaacaccatctttcatgaagcccttttcctgatttactttggggccttcaccacactctgctttttgcctaccccttctagactgtgtgttcctcaaggaactgtgtctgattcacgtctttcttccagcccagtacctgggaggcagaatgtatgcttcagaaatgaatgagtgaagcttcagaagtaatttttacaattgccaccatttgttgagaactcatgatgccagaaactgctacatgcttcacacacacttttatttacagttcaagaaactgaggccaagaaatgagcaacctgcccaagttcacacagttaggaagaggcagagcctggattcaaacctggatcatatggcacagcctgtgcccttgaccgcggctcctctctgcctctctccaaccctgtgtgctgccatctgccagtcccatggcatctgagcacagcagccatggtcccctgaagtgattctgaatctttttatagcctgaaattgaaatcactgatgcttcaaattagaaccccaaaatgaacgagccaagacttcagatttgcagttgccgagctgcccgcatccaccttctcagcaagattcctgggccactcctcagcccgaaccacctgttcccagtcaatatggaggacaaagagaacgacctccccaggcccagaaggccacatgcagaaaagggatccaacctccccgccatccagggctccccacagagcagtggcctctgtctgggagaagaaagaccacagtgcattaagcctcagagagcagaccccaatgctgttggcctcagagactgaagatccccagtgctattagccttagagagtaaaggcccccaatgctattacccttggtcaatggatcctgacgacacggtgagaagccactgagctgccaggacagaaacaccccacactcaagagggatgcaggacagaccctgtttgtctttggtgtgaatgcaatgaaatattggccttgatgaccaaagcaccaatgtgaccctggctgaagaattcagcagtcaccctgggttcctgctaacatcagctggtgtttggtctttaacttggttattaagtagccattcaaaaccatctaaataagagtggaagaaattttggggatggggtggagagttcctagattggtcatcaggtccaccagcaggacatgtgacaaagtctctcacaataccccaaaaggaaagctagagaaatgtgagctgtgtgatgtggctgaaccactaaacccaagggatgctggcaccaggcaaaccacaacagggctctggccttggccctgggatttgctgctagagggcaaagtgggcatcaggaataggaattccaaggtgatctaaaagccagacccatgccaacagagaattgtacaggctggtaagtgctctgggagcagtggtttgagccaaaggaggagatatgcctgccagggactttggaggctggcgggtggggtgggacaggtacctctattagtgatgttcctcacaacagaggcacaaggaaaccatggctcatgtactcttggctggaagtgtccgacgtacttggcacatggtgggtgtgccctgtgactgctacatgcttcaaataatagtggtaacaaacatcagtcattattataatattattatccccgtttgttcaactaatagccactggtttcctcttctgagtcaggcatcattaatgatgatgaaagacaagatgataatcaatgacaaatactgactgaggccgggtggggtgcatgcatctttagtcccagtacttcaggaggctgaggtgggaggatcatttgaggccaggagtttgagaccagcccaggcaacaaagcaagactctggctctataaaaaagtacaaaagttagctacgtatggtggtgcgtgcctgtagtctgaactacttggaaggctgaggtgggaggatcttttgaacccaggagctcaaggctgcagtgagctgtgattgtgccatgcactccagcctgggcaacagagcaagatcctgtctctaaaaaagaaagttgattgaatgccagccctgtgctcagcgcctctgaccagcagtccagtgctaagagcccagttcagcacaaccacccattttatcaacacgaatactgggacccagcaagcataatgactgatcatgctgcatctggacttcattttctttcccttttctctttttttgagatggagtctcgctctgtcacccaggctggagtgcagtggagcaatctcggctcactgcaagctccgcctcccaggttcacaccattctcctgccccagcctcccgagtagctgggactacaggcgcccaccaccacacccggctaatttttttgtatttttagtagagacggggtttcaccatgttagccaggatggtctcgatttcctgacctcgtgatccgcctgccttggcctcccaaagtgctgggattacaggcgtgagccactgcacccggcctggacttcattttctttcctccaagtaatatttaactctgaagctgtggggattgacccttgagcagcgagctctaacaactgttcttcacaccagcttggttgcaaagtcaaacatgctagaggccacctcacatttctcaagtcccattttaaaataccagcccaagaaacatatatatttttttcaagacagagtcttgctctgttgcccaggctggagtgcagtggtgcgatctcggctcactgcaacctcccgctcccgggttcaagtgattctcctgcctcagccttccaaaaaaaaaaaaaaaaaaaaaagaaagaaaatgaagtccatattcagcatgatcagtcattaggcttgctgggtcccagtattcctgttgataaattgggtggttgtgacagtagcagaatcacctgagatgaactgggctctcagcactggactgctagtcagaggcgctgagcacagagctggcattcaatcaactgggattaacaggcacatgccaccatgcccagctaatttttgtatttttagtagagacagggtttcaccatgttggccatgctggtctcgaactcctgacctcaagtgatctgcctgccttggcctcccaaagtgctggaattacaggcataagccaccacacccggccttatgagatactcccagggtctccgaggaaaacaccagggcatccctcttagcatcctgacttaaatacaaaccacgagtataaagaagatccacgccctctctcgtgcaagtatttaatacgaggaaaatgtaattagcaaactcgagcaccacttttcaaggatgaaggatactgccacctgctttaactgcaagggaaaacctatttgcagaaattaacacaaaaatgagattggccacttcagggccaagaaaacaatcacaaaaaccataggcgtcatcagagccctgcagcaggcgggtaaggaatggccccgggaaattaattaatgcccaggaaggctttttcctctgacagcaaacagcactatctgtgccaagggggctgaacatttgtctcctctgtgagataactttcttctaagacacagtttcctatgtatgaaatggatacttttcaaaatatgaatacttcgattctaggaaatctgagacaaacatctgaaagaaagagaaaataacacaatctcaccacctaggggttaatatttcctttcctttttgttttctattctatgactatactggggaaagatggtattagatgatattgtgctgatcattttgattctgcctttctcactaagtagaatgtaaccttttctggttggtattaagagctccttgtaaacatcatttttaatgctttcttatgaattcacaacagatgtccattgccactgaaccattctcctattagccccgccccctccctgccccaactccttgtttttgccacactgtaattgctacctggttttgtttttgttttttttgtttttttttttttgagacggagttttgctctgtcacccaggctggagtgcagtggcgtgatctcggctcacggcaacgtccgcctcccgggttcaagcgattctcctgcctcagcctcctgagtagctgggatttcagacacgcaccaccacgcccagctaattttttgtatttttagtagagacggggtttcatcatattggccaggctggtctcgaactcctgacctcaggtgatccacccgtcttggcctcccaaagtgctgggattacaggcgtgatttctacctgttttttaaaaaattattcccttagcatggattcctagatgtaaaattcctggttcagctttatggctcttgttacatactaccacattgattgtgaaaacatttatggcaacttaggctttcccccagcaacacatgagtgctgtcaccagcaaggagtatagtcacaaaaaagtatttgctaatttgaaaataaaacagtcaccgcactgcttttctttttaccttttgcccatttatacataaagcacatcaaagtgttgttcaggcatctttgagccatgacattacagagtcagacaatgtgggttggaattccaccttctccactcaccagctacatggccatgtagttactgcacctatgtacctcagtttccccatctgtaaaatggggaggaacacacatgctatatggatgactgtgagggttaagcggagcactgcagggcttgtagggtttggagatccagctcagctgctataaacaaggacacagccttcttgggacatttgttgcaaatgttgtttgccctctgcctgcctgctgttgagttgaactgtaaggatgtctcagttacaggatattttagatcacaaaagtcattcaagaaacaacatttaggttgtcaaacaaggggtttgtggaagacagtcctagtcttaagactaggagattaacgcagcacctgcttgtgtttgggtcgaggagactttagttggcaggccacatcaagaggctggaatgtcaacttgcactgggccagtgggtcatcaccttgcctgcctgttgggacccccggcatcaccactgcagctttcatggatgcccagctctcgcctcatgattctgattcagggcgtgtgggctggagacgaggtttctataaccctcaggtgactgacgcccagccaggtttcactgagtgagacctacagtgagccctgcatgacatccaagtggcgtccccacctccacatctccttacacacttgatgcactaccgtcatccaggaaccacccacatcctccttagcacatgtcgtgaacttcagaagcaacctgtgatctctccagccccatgttgtgggagtgaaggggcctaataagggccatctcaaagagacagcagacaaagtcttcagcaaactcttatggcaggctcactctcctttgaaactctctggtctcagcttcctgacaagctctaatcattatgaaaaccagtttggactgggtttcctgttgtcaccagagggacatgggcctctgtcactcctggctggtggaggccccatcctcacctctgacctgcatagaaagaaacacctgccctgcttctctcgggggctgtcactgctccaagcctcggcttcagcctccctcagcaggtcccacgggcattctccgcaggggcattcaacttcccgccgccctgcccctcccacggcctctgaaatctctttggctccttctcccctgggctggctgacatttcacaatctgggacggcttagtgtcactgtctatcctgggaattccggcacactagctgatctgaaatggcaaatcgcaccatccatggggccactgtgatcaaatgtccctacccgtgggacattcacttatctttcacgtccacctctgaggtgaaccttttattaccacacagcttgagtgataacatctatctgtctcatgagactcccgatctggagatagctcaaagcctttgattgtggttggtagggtcagggggtggtcaaccaaggaacaaaaacaacagcaaaagaacaaactcttcccaaaagcttaggtaggagagaaataaattctacaagctaagtacccaagaaagtcatgcacagcaggaaatcatgacaggcaccaaggccgagagccggatggccacgtcggggcattctcacaaagttaacgagggaaaatgaagttctagagataccaaagacattaaaagccaacattcacttcaaagggtgcccattggtccaaaagttcaaaccgcagcatgcatttttaaagagaaaataaaaatctgtcacactttcgaggttctttcaaaatagcagagagaaaggaaggcttgccaagggctgcttggggtaaggaagacagaatgcctgcattttgggcagcttttcacgtggagaccttgcacctcaccgggagctcagaaaccccactgactccaggactggctgctcaccaaaaagaaaattcacgtgagacatgtgaggctatttcacaccatccctccaaggtcaaagctcttcactaaaaatagagaaacatggtctgttggaacaaacacgcacctattatgctatacaagattttaatattccggtggcaaaatccagtcgctaggaacacaactcaatggaattctcagtcttaagcccctagaggagaatttctgagtcccagaggcagctgtggacatgaactgggaggagccaggatcgtgcaagggtccagctgcctgcaccccgcaccctcattagtgtatgactggtgtggagcagcctcgtagggctgtggagggcccagtgctccttgggttatctgtgataatcataatgcaggcgcagccctaatgcatctcaggaccagccattcctagaatactggaagtcagaggttacccagaatataaaacctgccccaaaatggcaaatctatttgcataccagaggttaaaagcaatgtcagaggaggtgcttagaaacagaagtgtggaaactctcaaagctccaaatttccacaaaggcttcaaaccgacaggacaggtccaccttctcagccccacccaggtgagcgctgcagccacagacagctacatcttctaacccactgaggctccgctcactgggcaagtgcagggcccacacacgtgcctcagcaggccacgtttctcttattgatgaggttatccaggaaacagtccaatgagctgaacaacgggggttgttcttgcatctgcagccctcttttattattgaaaatcaagaaccaagagtgacctatttcaacaccccccccaccctgcctgtcacacgtgcacacactcttacaccacctatagacttcagccctgctgctaggcccaaggccacgcccccccaacacacacacacacacacacacacacacacacacacagacacacacacacacacagacacacacacacacacagacacacacacacacacacacacacagacacacacacacgaaggggactcacatcccaactgcatcctacagaggatgattcaacccaggccctctgcatttccatgaaggttacaaatcgagttagcccacaaagccacagcgggctccaatctctgtcattctggtggtgcacccgacagtttcaacacacaagaacccaaataagctcatttctcattcaaaccaggttctgattggtcaataataatttaaatgcatcttccagcaaatcaaagagatcaacatgaggcactcagaataagtttaagcacctgctccatcttacctggctctccaatagtctcttcccttctgactttccattgccccgtaatagtcctgaggatctctaaggagatcactagcagaatcatagcatgaacaagaagcttgggagcttaggcctgattgggagaaatgatcacgggtagccctctcaccacgggtggagatgtgggctcctcatttacagaatgaatgtctgtctgtccagcccaatggcagggaccaccaaatggctggctggatgccacgtacccaccccttccacctgcatgtggagttctgatgtacacgaggctgggctcagggtgacatggaagagcgcgtgcatccaagaaatgcgcactcccaacgaggaccattcgagtctactgaacctttaaaatatcatctttttcaacctgtaacattcttttcttcttcctacttccaaagagtcacatgttcctttgcataacaagattaaaactgaacacctaaactcacaaaaaggcgaggtgatcagatgtactggggcctccgaacccctcgcacacaccaacgtgccaaccgtagggactgtttgcagagccggagcactcaaacctctattctctaaaggaagagaatgctctttccttttcagtaccagcaaaagttcattttcaaagcatctgaattcctaagtttcctttttgcaccatcgacaccagccatccctcttgcccgggctccttggtcttggaaggccatcgtccatctgatggggtggttaccacaacctgcaaatctacaagctcttagccatcaatgttacagacctcacgccagcaactgccacacaagagtggttgccgactcacccataggacacaagaagggacgatgactcctcttggtgcctatttagtcacaactaaaccacccacaggtctgcacatgtccccaacatcatggtgaccacatgcctcctctttctaccttctacttcaagaccaatgaccaaattccacagacttttcctccttccaacgggttacggccaaggcctccaagacaagcccaacaccaggtccacaggcagtggcacccacggtgggagaaactgaccaatgaaagttcatggcagcctccacaagcacccccagactgggcctcgtggctgtgctgccaggactacgaccctctccccgagagtcggcgctctccccaagcagaaagatacagacacctgtgtccctacctcaatcaagaagtccccggtccttagtccggcttgccacgccaccccaccttcatccacggactccaggtactgtagggctgggaaagccggtgttggtgtgaattcttcaatgggtgtgtcagctgggaagacaagcagcacctggttacaagcctgggagatgtcttccaagttcacattgcctgacctccccacaggaccccgggaggaagtgggcccactcatctcccattgcaggtggctagtccaggccaactctcccccaggaagggcttgagattcatactcatgggctgatgcaactcaagcaatgaagtcaattgcaccttggggccgccatcatatttcttggcctctctgctgaaaccacaggataatgtgctctgtggtacatgtctacacgcctgtcattttctttaaaagcatcagtgactaaacattttcggttctaaaaatggaaaagttcctcccctgccacacagagctacagaaacaccacactaaaccacttgccaaatttacatctacgtagactcgcaaccaagggaattcaacttggaacgcggacggaacatcacgctgacccagtgggtggctacagatttggaatgtgctcatgagtcctctctacagggagtccaggcctctgtgaccactctgtgtgtgaccagtgtccctgggcactggcatgtgtgtgtgtgggtgctgaaccactactgcccagcacagtgaggcttggcttctggggccccacacagctgccaggtgcaactccagggcaggagatggacttttctagggaggcatgagtggccaagggtgggtgggtgtggagataaagattccagcagggggaggggagagcaaatcacacagacaggcgtggatgctctcacagagacagatgcatctgctctttctctctctggacagctcgctatggagctgcctgagtctgaggcaggtgggcatgccagctggggaggaggcctcctgcagcacaggtgcgggacccctggcacagcgcgtaagctccaagatgaaacttccacatggctgagccacacacacagtgggcggatgtcccctctcatggggaggtgatgccattttgttttcttttggaggggaagctgcgcgtgcagggtgactggcaggtgcaccgccatggactgcattcctgagcctcccacgacgggccacgtaacgtgtgtgctgccggctcagtccacggcagaggggaccatcttgtcacatttcctttgcaaagtcaccttagaggtgagcacacaaatgcctgccgcccttggagccaaagcccactcccagaatggggcagtttctaggtgcctgaaactcaggccagggcaatcctggggatttgagacccagagctctgagggtagccacagtctggctcaactagaacacaaaatactgaccaccccatcatttaaaaacaaaaggtaggaggggcaggagggagagagaacccattcagaacaacatcatctacagaaaattaaaaacattcctcaaggaagccctaacgttttctgagtaaggcacaatgtgaaggaacatggttgtctagcaactgagtgcccccaggaaaaatgcttatttaatgcttattcctgagctggggaacgtttttcatgcaggcgtatacacacacacacacacacacacacacacacacacacacacacacacacacacacaaacatgggaacatattcaggctcagagcggctgctcttacctttggcccctcgaagcacgaatccaaagccctcattgtcttttttctgcaggaccaccgtcttctcctcaataatgcagtcactgtagagagaattccggggacagcgaccattattgtagcccgtcatcatcaccgcggccgctcctccgccggggacgttcatcatcatagccaattaatcaccccagctcgccagatccaggcagcatggaggaaagga

SEQ ID NO: 2398 - DNA, 38398 bp, Homo sapiens
tcgccgagctgggccaatcctcttggtggaggaagctcggctgattctcggctcacgcgggaggggagtaaagggtggcggtccgggcctggagttcagtgggtgcagcctgcttgcgagctgaggccagacaggggggcgcctacggacgggtaagagtcgtggccttgccattggaggtcaccctgtgtcagcgactgggcagtgcgggagggtggggagctacggggtcgcccgggtcgggtgctttctgggttgacctaaggctgagtttagggaccgagtgcatcagagcagccagaaacgattaccttgcgtgttggagcagggactgtactcacggggcaactgagacccggagaggggaaggggtgtgctgagtgttgtcgcagaggtcggacggctgggacctaggaactgaatccagccgaggctcgctctttgagggtggcccttcgagagcacccctagactgacccagatgtataggccccagaccaggttccaagagaggatcactttagatcttacctggctaaaagcagcccaggacggtgaactggggcctttgggaacggactttgaaaggagtgagggggatgtgagcgagcatgaggggcggggagaggtcatcaaaatatactctttttgacacccacacaatgcagataaggaggagcattccaggccgagacgccctcatcagcagagtcacaggagttttggaagtgagaggtatgcttggagaattaaaagggagcgtgtgcaagggctgtggactgacatagacctgcagaagtggagctggaggtccagtttgccctctttagctatccccgtggcttttagccttcacctgtttttcctccaggcataggggcagtaatctagggagacagagggcagagagtaagtttctcagacagagaaaggcccgaggcttattagaaccttttaaatggagctgctgccctttgccctcttctctcttcagcagtgaacagattcctgacttttgggtcatcatcatccccccaagtagtacgagccagagttctcactgtgatctccaaagcttggcacgacgtgtccccttccatcgctccacaactcttctctcgtctggctcactccagccccagaacactggctttgtggttgaacctcatgtgccagccacactcctgcctctcatctttgtctcagttgtcctctccgcctgcctcctcttaggcaccctatttaagtattgcagcccccagtacaaacaagccactcaccttgctctacttttttttccaacagttcttatccccttctgacctactgtatattttgcttgtttgttttgctctttgttgtccctccactagaaggcaggctgtctgagggcaggcatctttgttgtattcactactggtactccaggacctagaacagagaggggcacatattagacaactgatgagtagctcccctgtttcccagctctcacctagctagtcctccctgctctaccaggttaatcttcgtagtgaacggccctggtcagggcatctccctgctcttaaaccttcagagcctgaaccgtaaagggctccttagcctggcctgtgatccctctgcccagttttgcccctggtaacccttctagcttaatgtccctccataccttgcttcccagtccgtcaacctgcagatcggaagcctgacagagtacaagggaaaaacacaagttctgcgcaggctgtgtgcaggctgtgtgaccttgggcaagtcgcttaacctctctgagcctgtttctcatttgttgagtgagaccagtactgtctacctgatgggatacttttgcatctcaatgggatgaactacttatatgtaaagtggcctgatgttgagcaggtcttcaggcagtattacagttgacccctgaacaacatgggtttgaaccttgtgagtccatttacaggcagatttttttctcatctctcccaccgctgagcagcaggatcagctcctcctcatcttccttctcagcatactcatcaggaagaccgtgaggatggagaccatgatgatccactttcactcagtgaatagtaaatatattttctcttccttatgatttcatagtaacattttcttttctctagcttaatttattgctgggacacagtatgtaatacatgtaatgtacaaaatatttgttcatcaactgtttacattattggtaaggcttccagccaacagtaagctatattagtgaagttttaggtgagtcaaaagttatatgtggatttttgacttcggggctccgtgcccctaacccccacattgttcaagagtcaaatgtagttcttgtctctgatttgctcttgtcattcccccccgcccaccatgcctggagccttagacttgtccaaaatctcttccctgcactgcagccaaggtgatctttccagtcgcaacactcactcctgcttccaacttctaggggctccaccatctttccccccttgtaactccctagcttggcacacagcccccacatgttctcaactttgctcccgatcttgcttcacacttgctgtgacacagcttgtcactgttataagaacatgctggctctgtgccatcactttgtccttcccaccctggccatggaatgtctttcaggacaccatgcgctctgttttactcactcttctggggccttttgaagtcagcttagggatctcctagttggggcaggcttccctgagccagcagcctgcattggtgctctgggcttgccctcatcagagtggaaacgcacttctgtgactctttgcttgctcctgtctcccaccctagatggcgggctccttgaaggttggcagtgtgtctttgtcagcttctgcctggtagtggctggcatttgataacttgtgaatgaggaaatcaatgcatgaggtgacacctgggggttcttttacaagttacagctcccgctttaaccctgggggtttgtttgagcctcacagtagctctgaggtagggaagaaggacgctgttttacagataaggcctcatggccagcggcagcacgataattcactcaaacccatcttccattccaggctgtctgctgggcctccaggggctcgtggtgtcctacagggtgctgagtgtgaggatgagagcagaaacaggtgctgtggaagcgactcaccttccctggggagggggaggaagtttcacagagggggcagttcagctaggccttgaaggaagaggaggcactcaccgtggagaggagagagaaggtattccatgcagaggaacagcgtaagctaagctcacaggcatgctgctgggtttctgagaggtctaccacaaaataaaagctggcgactttttttgtcctaaaagtaaatagagaaacaaacaactggtggaaacatggacaccgcaggtccgtggaaggacaaggtcaagctgggttgccccagcataatcaaggctaaagtgacacctctaaagagaaatgacctccaagctattggcctcactaatcctaatctgggtattttctttcccatatcacatctttgaattctgaaagggaggctttattgttgttcctacagggctcctgctttgctgtattttctctaagaaatatgtccataatgaaggtgtgtgccgcctcaggtgaatccttctctttgcatctgatcatctggcccagtcctgcagaggaggccaagcatgaggcatgaggtgatgggaaataggggaatcctcttttataatccaaggcttaggcccccatttcaggattccaaagaaagttctaagaaacattacttggcattccttggatagccaaactctactgaggtgtttggggaagggcagtttgcctggcattgtctgcccatggactgaagggatgagctctcagtggccacattctagcttcctgcactggaccttgtgcaagggtggggctccgacaacctttcccctttacaaagatgtcacacttctttctagaaggacgggacgctctcatctctctccctagtttgagacagaatgttctctccttttccctccaggaaatgttccccagcaggaaggaggaggttgggctaactcgcttctctcttctcgcttcacatgaggcggcacacaccttcattatggatgtgtttcttagaaaaaatacagcaaagcaggagtcctctaggagcaaacgtaaggcctccctttcaagatgtgatatgggaaagaaaatactcagattaggattagtgaggccagtggctacaaggtcacatctctctttttttttttttaattattattatactttaagttctagggtacatgtgcacaacatgcaggtttgttacataggtatacatgtgccatcttggtttgctgcacccatcaactcgtcatttacattaggtatatctcctaatgctatccctcccccaggcccccaccccccaggccccagtgtgtgatgttccccgccctgtgtccaagtgttcttattgttcagttcctacctatgagtgagaacatgtggtgtttggttatctgtccttgtgatagtttgctgagaatgatagtttccagcttcatccatgcccctacaaaggacatgaactcatcatttttcatggctgcatagtattccatggtgtatatgtgccacattttcttaatccagtctatcagtgttggacatttgggttggttccaagcctttgctattgtgaatagtgccacaataaacatatgtgtgcatgagtctttatagtagcatgatttataatcctttgggtatatatacccagtaatgggattgctgggtcaaatggtatttctagttctagatccttgaggaatggccacactgtcttccacaatggttgaactaatttacactcccaccaacagtgtaaaagtgttcctatttctccacatcctctccagtatctgttgtttcctgactttttaaagatcgccattctaactagtgtgagatggtatctcattgtggttttgatttgcatttctctgatggccagtgatgatcagcattttttcgtgtgtctgttggctgcataaatgtcttcttatgagaagtgtctgttcatatcctttgcccactttttgatggggttgtttgtgtttttcttgtaaatttgtttaagttctttgtagattctggatattagccctttgtcagatgggtagattgcaaacattttctcccatcctgtaggttgcctgttcactatgatggtagtttcttttgatgtgcagaaactctttagtttaattacatcccatttgtttattttggcttttgttgccattgcttctggtgttttagtcatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctccatatggctagccagttttcccagcaccatttattaaatagggaatcctttccccatttcttgtttttgtcaggtttgttaaagatcagatggttgtagatgtgtggtgttatttctgagcgctctgttttgttccattggtctatatctctgttttggtaccagtaccatgctgttttggttactgtagccttgtagtatagttcgaagtcaagtagtatgatgcctccagcttcgttctttttgcttaggattctcttggctatgtgggctcttttttggttccatatgaactttaaagtagttttttccaattctgtgaagaaagtcattggtagcttgatggtgatggcattgaatctataaattaccttggacagtatggccagtttcacaatattgatttttcctattcatgagcatggaatgttcttccatttgtttgtgtcctcttttatttcgttgagcaatggttcgtagttctccttgaagaggtccttcacgtcccttgtaagttggattcctaggtattttattatctttgaagcaattgtgaatgggagttcactcatgatttggctctctgtttgtctgctattggtgtttaggaatgcttgtgatttttgcacattgatttggtatcctgagactttgctgaagttgcttaaggagattttgggctgaaacgatagggttttctaaatatataatcatgtcatctgcaaacagggacaatttgacttcctcttttcctaattgaataccctttatttctttctcttgcctgattgccctggccagaacttccaacactatgttgaataggagtggtgagagaggggacccctctcttgtgccagttttcaaagggaatgcttccagtttttacccattcagtatgatattggctgtgggtttgtcataagtagctcttattattttgagatatgtcccatcaatacctaatttattgagagattttagcatgaaaggctgttgaattttgtcaaaggccttttctgcatctattgagataatcatgtggtttttgtctttggttctgtttatatgctggattacatttattgatttatgtatgttgaaccagccttgcatccctaggatgaagcccacttgatcgtggtggataagctttttgacatgctactggattcagtttgccagtattttattgaggatttttgcatcgatgttcatcagggatattggtctaaaattctctttttttgttgtgtctctgccaggctttggtatcaggatgatgctggcctcataaaatgagttagggaggattccctctttttctattgagtggaatagtttcagaaggaatagtaccagctcctctttgtacctctggtagaattcggctgtgaatccgtccggtcctggcctttttttggttggtaggctattaattattgcctcaatttcagagcctgttattggtctgttcagggattcaacttcttcctggtttagtcttgggaggatgtgtgtgtccaggaatttatccatttcttctagattttctagtttatttgcatagaagtgtttatagtattctctgatggtagtttgtatttctgtgggatcggtggtgatatctcctatatcattttttattgtgtctatttgattcttctctcttttcttctttattagtcttgctagcggtctatcaattttattgatcttttcaaaaaaccagctcctggattcactgattttttttgaagggttttttgtgtctctatctccttcagttctgctctgatcttagttatttcttaccttctgctagcttgtgaatgtgtttgctcttgtttctctagttcttttaattgtgatgttagggtgtcaattttagatctttcctgctttctcttgtgggcatttagtgctataaatttccctctacgcactgctttaaatgtgttccagagattctggtatgttgtgtctttgttctcattggtttcaaagaacatctttatttctgccttcatttcgatatttacccagtagtcattcaggagcaggtttttcagttttcatgtagttgtgcagtttttagtgagtttcttaatcctgagttctaatttgattgccctgtgtctgagagacggtttgttgtgctttctgttcttttacatttgctgaggagtgctttacttccaactatgtggtcaattttggaataagtgtgatgtggtgctgagaagaatgtatattctgttgatttggggtggagagttctgtagatgtctattaggtctgcttggtgcagagctgagttcaattcctggatatccttgttaaccttctgtcttgttgatctgtctaatgttgacagtggggtgtgaaagtctcccattattattgagtgggagtctaagtctctttgtaggtctctaaggacttgctttatgaatctgggtgctcctgtattaggtgcatatatatttaggatagttagctcttcttgttgaatggatccctttaccattatgtaatggccttctttgtctcttttgatctttgttggtttaaagtctgttttatcaaagactaggattgcaacttctgcttttttttgctttccatttgcttggtagatctctcttcatccctttattttgagcctatgtacgtcactgcacgtgagatgggtctcctgaatacagcacactgatgggtcttgactctttatccaatttgtcagtctgtgtcttttaattggggcatttagcccatttacatttaaggttaatattgttatgtgtgaatttgatcctgtcattatgatgttaggtggttattttgcccgttaattgatgcagtttcttcctagcattgacagtctttacaatttgtcatgtttttgcagtggctggtaccagttgttcctttccatgtttagtgcttccttcaggagctcttataaggcaggcctggtggtgacaaaatctcccagcatttgtttgtctgtaaaggattttatttctccttcacttatgaagcttagtttggctggatatgaaattctaggttgaaaattcttttctttaagaatgttgaatattggctcccactctcttctggcttgtagggtttctgccgagggatctgctgttagtctgatgggcttccctttgtcggtaacccgacctttctctctggctgccctttacattttttccttcatttcaactttggtgaatctgacaattatgtgtcttggagttgctcttctcgaggagtatctttgtggcattctctgtatttcctaaatttgaatgttggcctgccttgctaggttggggaagttctcctggataatatcctgcagagtgttttccaacttggttccattctccctgtcactttcaggtactccagtcaaatgtagatttggtcttttcacatagtcccatgttatttggaggctttgttcatttctttttactctttttttctctaaccttgtcttctcactttatttcattaatttgatcttcaatcactgatatcctttcttccaattgattgatttggctattgaagcttgtgcgtatgtcatgaagttctcgtgccatggtttttcagctccgtcagggcatttaaggtcttctctacactgtttattctagttagtcattcatctaaccttttttcaaggtttttagcttccttgcgatgggttagaacatgttcctttagctcagagaagttttttattaccaaccttctgaagcctacttctgtcaacttgtcaaagtcattctccatccagctttgttctgttgctggcgaggagctgtgatcctttggaggagaagaggcacgctggtttttagaattttcaggctttctgctctggtttctccccatctttgtggttttatctacctttggtctttgatgttggtaacctacagatggggttttggtgtgatgtcctttctgttgatgttgatgctattcctttctgtttgttagttttccttctaacagtcaggtcactcagctgcaggtctgttggaatttgctggagctccactccaaaccctgtttccctgggtatcaccaatggaggctgcagaacagcaaatattgctgcctgatccttcctctgggagcttcgtgccagagggtcacccgcctgtataaggtgtctgtcggcccctactgggaggtgtctccagttaggctacatgagggtcagggacccacttgaggagcagtctgtcctttctcagagctcaaacgccatgctgggagaactactgctctcttaagagctgtcagacaaggacgtttaagtctgccaaagtttctgctgccttttgttcagctatgccatgcccacagaggtggagtctatagaggcagtaggccttgctgagctgtggtgggctctgcccagttcgagcttctcagccactttgtttacctattcaagcctcagcaatggcggacgcccctccccctccaggctgcagcctcacaggtggatctcagactgctgcactagcagtgagcaaggctccatggccatgggaccctccgagccaggcacaggagagaatctcctggtctgccagttgctaagaccgtgggaaaagtgtagtatttgagcgggagtgtcccgtttttccaggtacagtctgtcacggcttcccttggctaggaaagggaaatcccccaaccccttgcacttcctgggtaaggcaacgccgtgccctgctttggctcaccctccatgggctgcacccactgtccaaccagtcccaacgaggtgaaccaggtacctccattggaaatgcagaaatcacccatcttctgtgtcgatcacgctgggagctgcagaccggagctgttcctattcggccctcttggaatgaactgagttcacatctctttagaggtttcagtttagccttattttgctgtggcagctcagctcaactttgtccttccatgggcctgtggtgtggggcaaggtggttggatttcaccagtacaacatatctctgttttcctatattatttttagcttaagattttgtcccagtgtacatcgtgggtgcacatattggtttttaatggattcaaataactaacattttaaaggaagagacttgaggcttctgatgtgtgaaccataacaatccaccagcccctaaaacattgctctttggagtcttgttttcagtagttcagagctattcttctgtatgtctgtgtggtaaagtagacataacagaaaatgtaccatcttcaccatatttaggtggacagttgagtggcattacatgcattcccattgttgagtgaccatcaccccatccgccttcagaactcttttcctcctgcagcactgagagtctgttcccatcagcagtcactccccactcacagagcatttgtccttttgtgtctagcttatttcactgaccataatgttctcgaggttcacgcatgttgttgcatgtctcagaacttcattcctttttatggctgaagaatatgcccgtgtgtggctagaccatattttgtttatctgttcatctgtcagtggacacattgctgctcctaccttttggctgtagtgattaatgctgctgtgaacatggatgtacaaatttttcttcaagtccctgcttttagtttttgggggtatatgcccagacatgaaattgctggatcctattgtaattctctgtttaatttttttgaggagctgccatactattttccacaacgtcgcaccattttacatgcccatgaacaatatatgagggttccaggttctccacatcctcactgacacttgctattttctcttttctggcttttgataatagccatcctaataatgggtgtaaggtgacacctcactgtggttttgatttgcattgccctgttgattagtgacgttgagcatcgttttttattttttgttttttgtttttttgagacagagtcttgttctgtcgcccaggctggagtgcaatggcggcaccatcttggctcactgcaacctctgcctcccgggttcaagtgattctcctgcctcagcctcccgagtagttgggattacacgcatgtgccaccacgcccagctaatttttgtatttttagtagagacggggtttcaccatgttggccagtctggtcttgaactcctgacttcaagtgtttcacctgcctcggcctcccaaagtactgagattacatgcgtgatccaccacgcccagcctgttgaacatcttttcatgtgctttttagccatctttaaagtagatcttctttggagaaatgtctattcagtcagagctattctcaatgtacattttaacccaagcgtatatcacatggtgaatttaggtgagtaggcaggggacgggggttgcctatgggatctgactcatttgcgcggctagctctgggtactccaacccatagagacagctaagctgtcaccaaaattcttatctgactcatagtatttacaaactttaaaataattggtatataatttgagacaaaggagattttgttttgacaagaggctggtttgcaaagaattgtgtgattattgtttcagcagtacagctccgttggggtgagacatgtttcttctttgacctcctacatcctcctctagcaaacgaggagaggaataggctctaaggcttcttgcttttgctagtcatacaaggggacttgtggaattggcagctctgctatttggatttcggcactacaaaggatactcgtatagtttgctgggtctgctgtaacagatgaccacaaactgggtgacttagaaaagcagaaatgtgtctctcacagttctggaggccacaagtccaaaatcaaggtgttgacaaggttgtgttccctctgaaggatccaggggagactcgttcttcattgtttccaccttctagtggctccaggtgttcctttgcttgtagccacatcactctaacctctgcctccatcttcacatggcctcctcctcttctccctgcctttcccctctgtatgtctcttataagaccacttgtcattggatttagggcctaccaggcctccaaggacctctattggcccattcttttcctacttttcatgcaaaacttaaggctacgggagcagttaaagttactttttggttcaagaagaactgaatgaagcatttggtgttagtcattatgctattcattgaatgaggccaaagaggaaatgattctttccacccaagtttgcttgcgagtcccagtctttctttacactcctgccccatgctgtcgctgtacacctactttacaaagcatgtccttggttgtttatttgttagccagcatctagttgttgcgacaaccccaggagttagcctttaggcaggacctgggagccgtttccaggacagataggacagcccctgcctgcccaagcttataccgcatggcagcagattagataggggagaactaaagtggtggagagagtccaaaggcagcccaagaggaggcataggcagggagactcctgcacaggaagctgtgttacaatgataataaaattagctgccttgaatggcgtgttgacaggtatttgacacaatcctcataatgaccttatgaggccatttactttacatatgaggaaaggcaagctcagttcttttaaataactcccccgagggctacctgctggtaaggaatagtagctgggatttgaacccaggcagccgactctgggttaatttattgccagctgcactgaggagtggcgtgatttgtgatttctcatgtgtagagggtgagcagaggcttacaagagcagaactccacaggggtgggcttgcttagcccggctggcctagttagcctgtcatgcggtcctgtcactgccccaggcacacgcccctcagatcccctgccagcagaggtcaataaggccttggtggggtcagaggccagatgtgagccatctccttgcccctgtagatgccatgtgccttttcatttgctcacatttccctgaatatctggggaatctggataagaagccagcagtgggcattcgtgattatatcatcactaaataacagtcacttgccccactgaagcccctgcaccttagatgggatatgcatgtatgcgatggagagcagtatgggagctctggtgggtgtgcccacacatggtagtctcatgacccccggccgatatgtgagtgcccactttgtgctgggcactatgcttcatgcccaagttgcaacagtgggcaaggctttggtgcaaggtgccaaaatccttgttctctagctgctttggtctagatacacattgagtcccagtgagttcaatatcagccacatgtctttcgaatgaacagttgacagggcccctaccaatgtgaaggggattctgggataaagggagggacagggcaggcacagagctacagattgacttcaatgcattctaaaaatggccatgacaagtcaagttttgacatacagtttcttaataacttccattatgagttcagaaaaatgttcccccaaatggctcctccagacattgagggtcctgcatccatttcaaggccattttggctttctacatgcccgtaaagtctgtccccactgggacacatgatcatgcccattcgttaaaagtggcaaggagtgtaaaattcgaggtgtggggttggattggagcaatcacagcaggtggaatcccagtgctgcctgccacctcctcactgaagtgttctgtgaatctagcctttcatgagcaaagttagactcttgtcttgtcgtgggttttgccatctccagatgttaggggagccatgactaagtaaattggcaactaccaagaaaacatggatgcaagaccaaatacatcatagtcaagtggcatctttgtgtttgcagttcagtatcatgggtgactgaggagaggagcaccctaagggctgtcactaaagccatactcctctgtttggcaacgttgtcggattttattgctaccgtctccctgctgtgaactgctgggtgcccactgtactctgatcacttctcaagggtttctgatggcccaagatgctaagttcctccacgcatcgtcagggcggctttaacttagccaagcaggagagctccgtctcctattgcactccactcatcccccgtcccagcatcccatgtcctgagctcctagacatgagcccttgtgcccatttcattgatgggaaaactgagctgcagcaaagggaagtgactggagcaattccgtacagttcgtgataggcccagagcaggactccctaggtgtgggcactgctacaccctaatgagcaccacaggggaaatccacgctgactgaagcgtgggagagccatggaaaaagctacaatgccaaagacgttttttatgttgtcactgataagtgagctgatttaactggcctcctgtgcgcctctaatctaacagtgtggtgagtcataggcccagtcgttggccccgttagccgggcatggtggcagacacctgtaatcccagctactcaggagcctagtgtcttgtcgaacagctgtcgctatggttcagctatttgtaaaaacatgaacggggggatggcatctgcccaaaacactaacaactaaagatgttttgacttaggcaacattaatgtctgtctctaactatgtctttaagaaaagaaaagttgattacaaacgggaccatattttgcttcgaaatggaaccagcagttagcgagccaatgagagaccaagtcgcacggactcatttgacagaggacactcccaaagtgaatgctgacatagaaaaggttaaccagaatcaggtaaggagaaagttgacacgtacataccaacaggctgatactatttacctgtgggtgaaaaattgtatttgtacatgtattaatcaatgttgggtattttttatgtaagatatatagctttgtttaagatgtgtcagttacttattgctgtgtaacaatatcagaacacagtggtttaaaagaacaaccatttctttgcttatgactgtggtttcggctgagcccagctggggtgttcttggatggtctcccctgggctcttgcatgtagttgcaatcacatggggaccccttgaagcatatgctcccaggtggccttgctcacacctctggtagtaactggtggctgtcaactgggcaccttggtttgccttcatgtggcctccagtagaccaggctgggcttcctagtgaaatggcagcagtatttattaggcctaagatttagtgtcgcaagtctcagtctgagagaggacttgaagaaattgttgagcctggtcgttgtcaggcttcctggagattcttcacatcagtctgcaaaggtttgctttgattgattcttaatcagtgctgcacttcaaaaatgtggctgggcacggtgtctcacacctgtgaaatcccagcactttgggaggccgagacaggtggatcaccagaagtcaggagtttgagaccagccaggccaacatggtgaaaccccatctctactgaaaatacaaaaaattagccaggcatggtggcagacacctgtaatcccagctactcaggaggctgaggcaggagaatcacttgaacccaggaggtggaggttgcagtgagctgagatcacaccattgcactccagcctgggcgacagagcgagactctgtctcaaaacaaacaaacaaaacaaaacaaaacaaacaacgtaattacatcaagacaaaatgtgtttatatcaaatgttaataggttcaagatccctaagaggttatcatgggccgtgaaatcaccctgtatttggtgtagaactcagagtcaagcctcctctgggcctctgtggttgaagccacgtgccatctgcagttcctcatttatgtaaatttgggttttatggctacttggcagccagcaaacaaaggtggattccaatggttatagcaaactgccattttcagctagtttcaaatttttgtgtccttcgaaataacatttttttctctcattagtggactgattttataagaagtaaaagttctaaatttagactactaaaacaaaaagaacacatttgtcttaacttactatacgttctgcataagacctctctgagaaaagggtcccactgctgacaacaaagcaaaacaagaagggttggaaaaacccagcgccctagactattctgttatctcaagattctattgcaattagattagtttgcctaaatggttttttttctttttttttttttgagatggagtctggctctgtcgcccaggctggagtgcagtggcgtgatttcaggtcactgcaacctctgcctcccggattcaagcaattctccctcctcagcctcctgagtagctgggactacaggcgcctaccaccacacctggctaattttttgtatttttagtagagacgggatttcaccatgttggccaggctggtctcgaacccctgacctcaggtgatctacccaccttggcctcccaaaatgctgggattacaggcatgagccaccgtgcctggcccctattcttaacactgtctccaagaggttgatcttataactcacctcagtaacccattatggagtcttgctgtttccagtcttgagttttatacttgattgttagtacatgttcattcttgtccactgtggctgtgagaagtaaaaagtggtcatgaaaagtttcatgtgatctcctgtaatcacacagcattataggtatgattatcacacatttgacttccctggggtaaaggccagtttgattcccatcactacaagggtctccagggaacagccattggcctactcatcccaaacattattgatagaacatttcaatatcataaaataatccacgtcacattgtccaagagtagcgtactgattagtcacaattaaaatcgtgaaatgaaatcacactggactaacagcaaggttgttttttgaagagattagcaaccttttgaaacacctgtaactagagatgccaaatgaaataaacaaggcagtctgaaatctttcaggatgctttagtaacatatctagttctgactgtctttgggcttagccagacttttagtaaactgcagaaatccaggttgggaaacaggcagctcagagttattctaaatagctacagtttgcctgtacagctgacttgggaggaggggagaagaaagggattgctagaaaagggattgatgtgagttttgtatttaatttggctatgacttgaggaaatatacatctcagtccaggtgcaaatcatgtaacctggtatgattacatgtgtttaggaataatcagaataaagcctagaaaagaacaggttgggaagttagttttgggtggtagaagaatggtgaggctgattttgttagtagattgcacatggacagatgaaggtaaagtacagtgccagctccagctgggcctggtggaatccagtatgagtgctgtttcagatgggacaccccaactgggagggaggtggatctagagaggatgtctggccctggcatcccttgagtctcttgcatagctcaattgtgttgatgtttaaggaataagtagggagatttgtttgttttttaaatctagaacataatttctttaagatctttcatttccacaaacccaagttggatttactgtatatgagctaaggaaattggaggttgtcatcttaaggaggcccagatacagttttagaaagaccctagggaggagggatatcacaggtcctcctcacagacacccatagccagcttgtctggtgtgcagcagccacagtttggcatcaacatcctgaaatgagggtatttaagtgcctgcatgtgctactgtgtcctttcattatgcccagtcaccagagttggaattacccaaggaatcgtgtgtgttgtggaggctgagacataaacaccatggctctccccatttcttcaacttccttgtagttcggaggagggaaagcagagccctgggctcatccatcctcactgcagccccaccaggagatcccatcaaggcggtcttagatttctaggctgaggcaagaaggggttgggcgatgagcccagagccacacagcccagccctgttgtggccagagagggaaagggactgactttgtcctgcaagtatggagactgctttcttctttctgttgttttcagtgcaagctatcagctaccaaatggctgccgttttgttttgttttgttttgtccttagagaagcgcccagggatcagctatcgggaacaagaaggtatcactgttttttggggtattttttagattgtccagttttggtcataggtggtttgatttcctttcactgaatacaaagcatggatcttgtcatcaaacccaaccaaagtcaatctcagtgtcattcgctatctctcttccctccttactgatcccaggagagaaggttagggttgcactagtgatggaacaccaggatgatataaagcttccaacttggctcaagaagagttccaaacaaacaagtatatctgccattgcagtggctcatgatatgtaagtctggactctgtagcttccagtcctcactaccctggtcttccccaccgttcctctctttccacaggccaagagatgcacagtgatcggtggctctggattcctggggcagcacatggtggagcagttgctggcaagaggatatgctgtcaatgtatttgatatccagcaagggtttgataatccccaggtgcggttctttctgggtgacctctgcagccgacaggtaatggaccatgcagccttgctgatttcccacgagcccacgaagggaaaccacgatacttcccttgctcagaagccagccaatttgtttgaaaaacaattgtttcattgtgaaaattttcaaagttataggaaagaacaccacattcttactgcttagaatgaataaccatcatctctgtcacagatactcagctgtgtcctggtagcacaaaagcagccatggtcagcacttaaatgaacaaatggctgtggctgtatgccagtgaaacttgacttcaaaagccgtccatgggctgtattgttccaactgcaaaacaagtgtgtgctgggccacagggtcttgattttttaattgagatataattcatgtaccacaaatttcacatttttaaagtgtgcaattcagtgattttcagtacatccacaaagctgtgcaactgtctcccatgatctaactccagaatatttgtattaccccaaaatgaaatcttgtagccatcccctctcttcccctcccagcccctggccgccactcatctacttcccatctatggattggcctcttctggacatttcatataaatggaatcatgtaatatttgtacctctgtgcctgacttttttcacttagcatgatgttttcaagcttcatccatgttgtacaggtatgaatatcttgaattttattagatggtgccaaatggctcagcaaagctgctatgtcaattttacctccatatccacaatgtggcacaagccccattgcttcacatctttgccaacactgggcataactagactttttggtgttgccattctgagaagtatgaagtggtgcttcactgatgttcagagtcacatgtcctccctgaccaagtaaccagccactctgccactgggtgatcggctttcaggcttcctcctgtgtgaaatgtttgtctgtgtcctttgcccctttgtctttggggttacctttgcttccttgttgatctagttgggatgccaatcctgtgcccgttgtacttattatggatggcttccctcagcctgtcactgggcccttattcttggctttggtgtcattcgctatatggtttgttgatgaaatattaaggccattgcttccgctgcaaagttacggttgttttctctcccgtgctgcccacacctccaggcctggagatggggtagacatctttcatgctcatcattgctgcctccgaaccgttctccctcatgctgctctaagcctctccagctttgaagaggataccctcagactgtacaaaccccgacaccgttccctccttgtggtggccacccacagccgcctgctccccttcccagtgactccacatcatttctcagtgatttcagctcctttctggcattattattggtgaattcagcgttcatgtagatgaccctaccaatgccctcgcctctctcatccttggcctcctctcacccaatgatgttgccctccactcccctgtcatcaccagtaagcacgtcctctccttcttctcagttgcaggcattctactctgagcactagctcctctctgtccagctcatgccctctagtgcctcagctgtcccgattccttaaccccacccagacatccagccatgcccaccatggctcagcctgttcgtgcctcactgcctttagttccctggtctgcttgttcgcttgcatagtcttcaccccttcccctttctcttctggttgtatgtatccataaagtttctccagagaaacaccagcagggggatgtgtggagaagggcaaggagagagatgggtgggtgagacggagaaagagaggttgagatttaattcacagaattggtttacatgattgtgggggctgactaggcaagtctgaaatttgtagggcagaccagaaactcaggcaggaattgatgctgtggtcccacgttagaatttcttcttacagaaacctcagtttcacttttaaggtctttgaactgagtatatactgcctgtccagagtagcaagggtaatctccttacttaaagtcagctggttgtagatgtcaaccacagctacaaaatacctctacagcaacacctacactgtttaatggagtcaccggggactagagcctggcccaggtggcaaataaatgtggccaccacagtgtacttcacattgtaacccccaccctggttaaatcttgccttgtgcatggccatggccctcaagcagacccttggtaccaccaagcaccatctccacaaacctgcccacatccacgtctctactcagcctcccctgctgttcccgaggacgcctcatccccaccaaagtgcccatcctggtgccagctggaagccacctcctcttccctacccagtcactgccaccagggaccttgaggcaaccatatctggtggttgaatctcagtcctcctctgacttggccctgtagcagcatctgatgctttctttgcttgccttctgagataccacctcactcatttctcctcctgcctcactgattgtctcctgatcactatcatttctaaactttgcagactccagaacttattctcttttcttctccaagtttagacagtgtcacagtgactccatcccatctcatggattaattactgtctagaagctgatgtgctccctgcttgttatctccaacccctagctctctcaggcacgtgtgtgtgtgtgtgtgtgtgtgtgagcgtatgtgtgtgtatgcctgctggacatccctgtttggatacctcatggacacttcaagcttgctacatccaaaattaagctcctggttccctgacgcaagcccctcccccaccacagcaaacctatttctgctaagtcttctctatctccataaatggcctactctgcttttccagttccatcaaccaaaaaccttagattcatccctgcccgattcctttctctctcatgcccttcatcccatccatcaggaaatcttgttggctccactcagaatagatccccaatccaacaacttctcaccccttccattgctgccaccctggtccaagccaccatcactgtctcacctagatgttagagggactcttaatggataaatcagatcacaccgccctctgtacagaagcctccagtggcgtccagtcccatgtcaagcaaacagaggcctctgtaatcacccatgaggccctgcacggcacgtccccactacctgtctggcccacttcctcccacacccgcctcatggctctgccccaggcacactggccaccaaccaagtttctgcctcaggacctttgcacttggtgtcctttctgtcaggaatgctcttcctgaaccacagaacttgctccctagcttcctgtaaatctccagccaccctgtgctaaggaacaggcccccgctggtctcccttactctgctctagtttctgcataacacctgccagtacggacgtcctctagatttacttgtttgtttgcttatttgtcctgattgaaacatgattgaccatgagcggatacagagcagaggaaatctctgaaatttgtcctctctaccatagaatgtaaactccacaaaagcaggaattttgtttttcgatcactgctttgtcccctcaaaggagacgagaatccttagcaagctttcacttctctccaaaaggctcccccgctgccatgctgttgttgctagtatgttatttcagctttccttgagtacagatttcaagggaaccctccagcatgccatgttgttctccagccacactcaactgctcagccgcaagcgtggagaaggggcgagttgcatttaaccagggttggagtttactagacaaatttaataaagggagaggggaacaaggcaaaggtggtgctggtggatcatgaaatctaagctaagtccaaggtcgatgtgatgtgggtgaaagacatggcaggagaggaccttttttattttattttattttattttatttttatttttatttttttagacatagtcttgctctgttgcccagactgtggcacaatctaagctcactgcagcctccgcctcccaggttcaagcgatgctcctgcctcagcctccctaatagctgggattataggtgcccaccgccacacccggctaatttttgtatttttagtagagatagggtttcaccatgttggccaggctggtcttgaactccttgtatcaggtgatccgcccgcctctgcctcccaaagtgctgggattacaggtgtgagccactgcgcccagccgagaaggacttttaaaatgtactttcacctgggtgtggtggtatgcacttgtagtcccccagctatttggaaggccaaggtgggaggatcacttgaggccaggagttcaagactaacctggactacataacaagaccccccccatttctttttttttaaaaatgtgtttttatagtcagtagagagagagagagagagaggagagagacagatatacatacatatagataaagtttatgtatatatagttatatagttttatacacacaatatgtattacataacacttttttttttttttttgagacggagtcttgcgctgtcgcccaggctgtagtgcagtggcgtgatcttgactcactgcaaactctacctcctgggttcaagcaattctcctgcctcagcctcccgagtagctgggattacaggcgcccaccaccacccatgactaatttttatattcttagtagagacagggtttcaccatgttggccaggctagtcttgaactcctgacctcaagtgatccacccgcctcggcctcccaaagtgctcggattacaggcatgagccaccgttgccaccgcgcccggcccatgacacttttaaagtcacctcggtcttgtgcatcttttgttgctgacaggaagtctactctcaagccggtcgttgttcgtttgtaggttgtctggctttccctcttatggtttttaggattttattttttatcatttatagtctatagagaatatatctgggcctgagttttagttttgattttaaatcttaacacctggtaggcctgtgcaatctgaagatgaatgtctttcctcatttctggaaaattcttcaaagattaactctaccccttttctctcttttctctctttctagaagccgtgctggacatatggtggtctttcattgtatcatctgtctcttatcctctctttcttgcattccttctctttctctttttgtactatttcataggagatttcctcctccctgcctctgctcatggccaatcgtgtttcacctatattcctcctcagattatgttgaagtcaatcctagacatcatatcattttatctgcaaatatttcagtatttgtctctaaaagataaggattatttttaaaaacattgacagtagttccttagtatctagccagcgttcagatatccctgaatgtcttataaatgtttttgtattattgtttttccaaataaggaaccaagcaagatcaagactatggatttggttgaaatatttagctctcttttaatttacgattcccttcatttttttaaacttcagtctatttattgaataactgatgtttagtagaaaccatgtttatggtgctgtagtatttcccacagtctgggttttgccgattacatccccattgcgtttaacatgcccttctgtcctccagtattttctgtatactggtagatctgggatggcgctgtccattaaggcagccattagccacgtgcaactattgggcacttaaaatgtggcaagtcagaattgagaagcactgtaagtgtgaagtccacaccagatttcaaaaactacctacagaaaaaaggaatgtaactgtctcattaaagttaatttcacctttttctttttactttttaatgtcattactataaactttaaagtcactgtgacttttattatgtttctactggactaaagacttgatcggactctggttcagtttttccctctggggtattattacttctgatactccaatagtaataagcatgcctagtgctcagatttgggtttctatataccatttcccataaaaagaactagggcttcttgggaaaattgctcattctaggaccctagggcaagggcagtacaaaatgagtctgggacattttcttagcacaaaatgaatggggacctgccaagaagatacaagagccaacttgaagggcttcccctggccaaatttgggacattttgagcattttgagcctctcaaaacataacagtagtggatgacaatgcattttgatttcaaaaagaatccgtgggctgggtgcagggctagcgcctgcaatgccagcactttgggaggccaagacaggtggatcacctgaggtcagaagttcgagaccagccttgccaacatggtgaaaccccatctctactaaaatacaaaaaaattagccgggcatggtggcatacgcctgtaatcccagctactcgggagaatcgcttgagcccgggaggcagaggttgcagtgagctgagatcatgccactgcactccagccttgccgacagagcgagacaatgtctcaaaaaaataaaataaaaaagaatccatgggtccatagaaatactgaaaataacaattggggtcagggagaaggggaagctctacagaggaatgccaactaataaatgtaaaggccatgaattaaaaggctagacttagaatgtcaccattttatacccagtacattgattattgttccaggcaaggactatcaataaatgctgaggttaattggtagaattaacatgctacagattacttatcaattgcaaaggaaaaggtacctttttgatggccggaatctggcagccatcatcatcaccacgtgctccaacttaatatcaccaaaagtgggacagacttgcacctcctgaggtaattccctgagaaggacacaccaccactgatgtggtattcttgccaaaaccattaagcctgaatctaatcttgaggaaacagactaatccaaactgaaggacagtctataaaataacccaaacccttgaaaaatggcagcattaaaataagacagaaaagacgggaatttgtctcagattaaaagagatggaagagacctgaggactaaatactacatgtcatgcgcaattggatcctggaccccaaaacaaaaggctataaaagacattactgggacaattgggggaatttgaatatagactaattattggataagaacatcatatctgttaagtttcttgagtgtgatcattgttttatggttatttaggagaatgcttttgttcttaggagatacctgtgaagcgtttagaggcagcatgatgtctgcaacttacttgactggtttcaaaaaaaaaatcatgtgattgtatgtagagagaggaaattgtggcaaaatattaattggcacataattgtcataattgtcttttggtgacaaacatgaatcatacttagatcatattacttaattaaggtttgacaaaatgatgacatgctattagtcttcatttagtagctccagtctttataccttaatgcagaataaatatttgattctttccctttatttacctgaatttttattcttgcttgtggtcaagctgtcccttctttgcccagtgggaacctcttcaggttggcccttgagtgcttttaacgtgaccccggtagtcttagctagctagcatcctcactctctggtacaaggtgtgcctggttcctcttgtgtgtttcctgtcccagatctgcaatcagccatttctctcaggagctcttgttccttttagcagtaaatcaaacagacctgttttaaaaatccctttcaggttgctgtattgtgtcaagtttcacaggaaggaatatgcctgtgtattggctatttactgtctttaatggtgtggaactttttcatgtgattcataatttctatctgagttcaccttcctggggagttttacctcctaggtgcctgctctgaaccacccaaaaggatgttgcctctgtgtggatcccacaggcttctcatgccccaaaccccttttgactggggactagttagtggggagaaggtgattaaagggacaacttggtttccatcccatgtacttcggtatcattgattcttttatgagaatgtatttccatattgattatagaattataagacaaggaacctacaagccacaggttggagggtgaaaacatgagaatgccattgacctgtcaaagcaggaatgattattttgtctttctttgcttttccaggatctgtacccagctctgaaaggtgtaaacacagttttccactgtgcgtcacccccaccatccagtaacaacaaggagctcttttatagagtgaattacattggcaccaagaatgtcattgaaacttgcaaagaggctggggttcaggtaaggggaaggctggagtgagtgctgtcaggagcacgtgatggccctttctaagggtgcaaggccgtagttcttgcagtctccctgggcctaggcggggttgcttcttaaagtgttgggaagatcttagaaatgaagcccttggagtcactggagatggtgaaggtctgcttgccaaggctgatttgagatgtaatattctaactgcacacaaatagaacatctgaggacctcaagcctattggccttcagttaaagagctgcagaacttagacattgcttatatttttattgtgataaaatatatatcacatacaatttaccatcctaaccatttttaagtgcggagttcagtggcattaagtacactcacaatgttgtatagccattaccaccatccatctctaaacctttttcttcttccctaataaaaactctatacccattaaacagcaactcctcaatcgcccttccctacccagcccctggcaactacccttctactttctgtctctatgggtttgacaactatagggacctcacagaagtggactcatgtagtatttctccttttgtgtctggcttttcaccgagcatgatgtcctcaggggtcatccatgttgtagcatgtgtcggaatgtccttcctttttcaggcagaacaatatttcattgtatggatgggccacattttgtttattcattcagccatggatggacatctgtgttgtcttcaccttttggcaattgtaaacaatagtgttatgaacacaagtgtacaaatatctgttcaagtccctgttttcaattctttcaggcatctacccagaagtagggttgctagatcatatactagttctacgtttaaccttttgaggagccaccacattgttttccagaccttgcttatattttaaaagaaaagcaaactgtgtttacccttagccaatagaaacgtgttataactcaggcctgaggggatacgaattttctgcccatcatagcttgctgcatcgttaccaatcctggttcttagaattgtctttagaggactccagccactggctaaaacggctccctgtcagctcagtatcctgaccctcacagggatgcatgccacaggtactgcataaattaagagaaaaacttgaagcaagccagggggttcctctcccaacaacctgtcctggcactgttggctggtccgcagcatcctcagccggcccagcagggttggagctcttctgggcttgggccctggaaaagatcacttataactgacccctagcagttgacaagatgctttgccctgctgaagttttcacctaattagctcctcgttgggtgaccaggggctaaacgatgtctctttgctagtaaatgggagaggtggggtcaaagcagattctccaagtcccagactctgcactcagccatgctgatgtaactggagccctgggaagggccctgctgctctttgttaaatggaaggttgggggcatacaacaaagatttgtgccccaggtgtggcggctcacacatgtaatcccagcgctttgggaggccaaggcaggaagatcccttgagccaaggagttcaagaccagcctgagcaacatagcaataccccacctctacacgaatttttaaaagccaggtgtggtggtatgcacctgtagcctcaactgtttcgggacgctgaggcaggaggatcgcttgagcccaggattttcaggctgcagtgagctgtgatcccaacactacaccccagcctaggcaacagagcaagaccttgtctcttaaaaaaaaaattaaaaaaacaacaagatttgagaataaaacagcacctctccactcaccacagcatttaagaaacaacattactggcatgtgtaatgtgtgcccatcctcgatgccattgctctcttcttgtagccatggatagcaattctgaatttgggtttatttccatttgctccatgtgtaagcaatataaagtattggattgcatgttataagattttatacaatgatatcttattgaacagatcctcctgcaacttgcttttttccccagtgttatgtttttctttattcatcttggcatatgtaactctggtttatttactgaaggggcagagtggcttagtgggtaagagtgcagaaagtgattgctgtgttgtattgaaggaacattttccaacactgagatcaaaagattatttaatgtactttttttcctcaaaggttttaagtgttgctttccacatttcagtctttaatccaccaggaatttatgtttgcttatggtgtgagatagagatctaactttcttccatgtgtataaccagttcagtgccatttattgcataatccatcctttctgcatcgctgcacaccatctgcagcatgtcttaggtgtttgtgtcttacatgggcctgttcccaggctctcccctctgccccattgacctccctgtctgcccatgcagagaagctctgcctttttaggataagtctcagtgtaccgtagataaatcacgcccccaaccaatttcttcaaacttcacttggctattctgagccctttgttcttctacatatgtttggcttaaccagttccttgctaaagccagctgagactgctgttgtaattgtgttgaacttgtaggtaattttggagagaattgacatctttcccatattgagtgttcctgtccataaatatgggatatgtttctgtttatctcgctctttaatgtcatcaatagagttttatactttacttcgtaaagattttgcatatctcgttaaatttatttgtatgtacttcgttttttgttatttaataactttctattacattttcagttattgctaatatataagacgagttaatttttgtatattgatttttaattcagcaactttgccaaacgctaatattttctacatatttgcctgtgttttctgtgtagatttttctctcatctgtaagcgatggaagttcagtttcttttcaaatcattataaattcgtgtttatcttaccctaccactctggctagagcttctcatacaatgttgaataagaatgggaacgatatgattcatgctaatggtgttcagtgttggatgagcttctcttaaccagcaggctggacgctggggaccctcataagagaatatcttcctttagaatagcatttcttaagaggtcgtgtggtgtgtgtattcctatgtgtgttcacatggccaggtcactatcagaatagccagtgatctttttcagacatcttcctagaagtttgcgggctgcccttcacttacaacagagaatcgctgtcatagtgagataccatgaatgcaagtctattctatctctcaggtgtgatgggatagaaaaaatgtgttatcccttgttttgaaaccaagatctcttgattcttggttagaatgtaatacatagtgtgtctggaatccacatagctgcaaaagatggtgatctttggattattttaagaaggcatgaaaagcaaaggcattgcagcaaataatttcttcagtgcctcgaatgcgagggcaacaaagggatgcccctgattctctttcatacaggatcatgcactgtttgaattgtgataatttgtgacttttattttttctgaccttcctctgtcagaaactcattttaaccagcagtgccagtgtcatctttgagggcgtcgatatcaagaatggaactgaagaccttccctatgccatgaaacccattgactactacacagagactaagatcttacaggagagggtatgtaccttggaactggttgagtgagcagactgaagggtttagaatcctaagaaaaatgtttatgaacttatgaagtttgtattctgaggcctacgtacctgatttgagatgtaaaatttgtgggtgaaattaaatttaaaaatactgtgagaggccgggcacggtggctcacgcttataatcccagcactttgggaggccgaggtgggtggatcacctgaggtcaggagttcgagaccagcctggccaacatggcgaaaccccatctctactaaaaatacaaaaattagcccagcatggtggcaggcgcctgtaatcctagccacttgggaggctgaggtatgagaattgcttgaacctgggaggcggaggttgcagtgagccgagattgtgccattgcactccagcctgggggatagagagagagagacgctgtctcccaaaaaaaaaaaagttactatgagaacagctttatgtggccagacactgttctgagtgttttccaggagtattttccttgtttaaaggtcacaattatcgcatcatcaccagattatagatgaagactgtggtgcacagatgcacagagaggctcagaacctttctaaaactgtgcagctaggaggtggctgaccccaggcagtctgtctacagagcttacagcccaccctcaatgccatgggagcttcctcgcctgctatgggaatttacagcagttgcaagcgtgcagacaggaatcaggctggaggcaccttcctagtggcactctcaccccctcccttacttagaaaaacaaacaacggaaggatcttgctttattttaaggaaaaagtacttttccacttggcaaaacagcttcatcaaagggcacctgattttagtatggttggattcagccacggtcgctaccaagccttcaggctgctggggctgtggggcccctgacaactgctagctgcagatggggattgtcaccctgaggccatcctaagctgcaggccaggagtgctcctgagcctgggatagctcgtcttagctgggtagctgtgagtatacccctcccaggtgtgtgcagtgtatcacacccactgaggttttctcgcaaagccggtacatgctgtactggagctgaacactgacctggctacctgagagccagctgcctcctggctgtttgccgtattttttttttttttcttttttgagatggattctcactctgttgcccaggctggagtgcagtggcacgatctcggctcactgcaacctccacctcccaggttcaagcgattctcctgcctcagcctcctgagtagctgggattacaggcgcgtgccaccatgcccggctaatttttgtatttttagtagagacggggtttcaccgtgttggtcggatggtctcgaactcctgacctcatgatctgcccgccttggcctctcaaagtgctgggattacaggcgtgagccaccatgcccagcctgtctgctgttgcttcagctcagaaagtcctggcagaactggtccacagggagacacaagggccacccagaccaggggtggaggcttgaactttggcaagccacagtcctggctccagactatgctgtcttgctccttggagcactcatgtgctcgaacttggcccaaggagtactaaagcctccctgcgccttgcaggcagttcagtcaccatggagaccctgtgtattctcaacccaatatgcctgatactgattgccaccagagctgagcccatctaggctcaggagcttcaaatgatggccttggcccagaccatcagtgtctcgcttatatcaacttttgggttctcaactggaaataagcaaagcctgcagatgactccagcagtaactcaccggaagcctcctttcagccgaggttgacatccactgttggctttataaccttcctactgatcataaaccaaatgtgatggggagctaggactccttcacctctcttccctttagtagtagagatgagccttggtggaagccatttgagggtttatttagtcatttcctccatcgctgtggggaccagagtcctggcgggaagaggagggccagctctgggaatctgttgagaggcagcttttccattgttgagttgcttaagatcactggggccaaaacatagaccagcactttgctaccatagagtagaagaaacccgaggtgacatgacagcaggaaccgtacttaccaagcatacagacacgcactgaagcaactcacatgggccatctcatgtaattcgcatgcagccccgtcagggtaggtacctttatgatcaccacttttacccacgataaaacaaatcctttggaaagttttgttacttttgaggcgaaacccatttcactgtgctttagactcttgagttctagtttgtccatgaagtcacacagaagtcaccctttccttgcggtggcaacaggagcactggctctggaccaggcactgctctgaggactttacatgtctcggcctcctttgccccccagctgctggcctgtttctccccaggcatggtcttcagacccttcaccttctctgaccctcttctgggcccacttgggtttctcagagccctcccctcggaggtgatactcagaattgcctggaacagacccggcctggtggaaacgtgggcggcacatgcagttcaagtcactggaggctcacggctaacttgtttgccagaacctttggacgttttccacaaactgctgccgaggcatgtcttctggcagtgttggtggattttagcctttgaacgcaaaccagggccttctgatttgatcttaccagtttttgcccagctgtctgtcctgcattttcagattttggtgtgagggtgggtggggtagagaggtagcccagaattataccagccactgatgtaggttgtcagctcaaggcagaccactgctcagtggccacatgccagcagagtgtgtcatctgtctgtcccccacgagtggtgcttctcacccagcgaggcactctcttggcttgggcctaggaatttgcaatggacgtgccccttctcccactctcctccaggcagttctgggcgccaacgatcctgagaagaatttcttaaccacagccatccgccctcatggcattttcggcccaagggacccgcagttggtacccatcctcatcgaggcagccaggaacggcaagatgaagttcgtgattgggtgagtcagcccacagcggctcttccctagtccttcctggtccatgctcgcattcagagagcacttggcaggagccacatggcattgtagctcttttcttatgtgactgtcttggtccatgcaggctgctgtaacaaaatacctaagactgggtaacaaacaacagagagcttggaggctgggaagtccagatcaaggcgttcccagactgggtgtccattgaggccctgttcctcatgagtggcaccttttcaccatgtcctcacatggtggaaggggcaaacaggctcccttgggcctcttttatgaggacactaatcccattcccgagggcagagcccccatgacctaatcaccccctaaaggtccctcttcacagtaccattgcactggaggttaagtttcaacatatgaatgttgcggggatgcaaagattcaggcgatagcagtgaccttgtccgctgtcctctgtattcatttcttgtagttgccataacaacctgccacaaagtaagtgcttaaaacaacaaatggattctgtcacattttgggaggccagaagtcctcagttaagatgttggcagggctagtgtcttctggaggttcgcagggagcgtctgttccaggcctctgccctagcttctgctggcttccagccatccttagcattctgtgcttggagaggcatcactcctgcctctgcgtccctttcacatggctgtgttccttgctttctgtgtccaaatttccctcttataaggacatcattccctggatttaaagcccaccctaccccagtatgagctcagcttaactaattgcatctgccgagcccctatttccaaataaggtcacattcacaaggcccaagtggacagaagctttgggaggatactgttcaatccagtgtaccctctcaggtaggctgggaaggtatttgtgaccctgtttggaaattgaagaaaccgtgactcagagggaaagcaatgggccccgggtcaaaggccagggcttgactgtccttgcatctgggaaggcaggcgggggcattacttttctcctcgggttaagtgcaggtggaggggcctccacaggggacaacagtgtgcctctctcccaaataggctttctcttccttcatttcctccttttctcctctctctcttccttcctttttccctctgccttgccttcctgtttctcactcagcctcactgctaccctgacttgtcaccttgaaggattacagggagactggtcaataaacggaggaccagagcaaggcgttggccccgtgtctcctgggaaggggctgaaaagctgctacccaaatcgggacaggagagacagcaccagtgttggccatgctggaatgggtgggcaggtcccccagctttcagattccactaaccctgaagacccaggagtcccggcccagtgtacatctttaaccagtacaggcatccatgagtgcctgggccggccttgccaagtgaggtggcagccattctgtaggtcacagtctctcaaatgccaagacttgggagtggccctggccttcgtgcaggggctcccagcacgtattccatcatcccttgtgcacctgcagaaatgggaagaacttggtggacttcacctttgtggagaacgtggtccatggacacatcctggcggcagagcagctctcccgagactcgacactgggtgggaaggtaaggcctgctgcaccggtccctgcacaggtgcctttctgcgggtttcttctccttgccattggatttgctggcaagttgctcctgtgatcctgtatcatggaggatctgccttaggaccccctgtgccaagatcaagcccctctgatagagcatgtggtgtcactgcagcgtcacatcacttgggcagccaaatttggagagctgacgagctgggattgaacagacattcaggtcacggtcatctatggtcccctgacctggctgcccacctgttggcatggctccttgtggcaggagcccacgtagattgggcagggtgcttgctcctcaccctttctcccactcattcctcaggtctctccctcccttgctgtttggtcctcttttattctcctgaacctctgccgtttccccactgataaccttcaaataagttgggaatagggtgggtgtggcattttttttttctttttttttttttgagacagtctcactctgtcaccctggctggagtgcagtggcgtgatctcggttcactgcaacctccgtctcactggttcaagcgattctcatgcctgagcctcccgagtagctgggactacaggcacatgccaccacgctcagctaattttttgtacttttagtagagacggggtttcaccatgttggccaggctggtctcctgacctcaggtgatctgcccgcctctgcgtcccaaagtgctggggtgacaggcgtgagccaccgcgcctggcccgggtgtggcttttgatttaaaacaagcagaacaccgtcaagaaatgtaatatgaggaattcattgcatccaaagatatgtagatgagttttatgatgattaacaattatcaaattaacaaatgtgcctttccaagtgcaatctatgcttcatttaaaatcctggcccatagatgaaactttcattgtctgccctttctatgccttagcagttgtgcaattgagggcaggccacgtggaaagctgcagcaattaggcagtgagaatgcgatctgcacgggcttaatagatgcttcaactttgggcaggtgggggtggtgtttctaacttcttgttcttgttctcccgccaggcatttcacatcaccaatgatgagcccatccctttctggacattcctgtctcgcatcctgacaggcctcaattatgaggcccccaagtaccacatcccctactgggtggcctactacctggccctcctgctatccctgctggtgatggtgatcagtcctgtcatccagctgcagcccaccttcacacccatgcgggtcgcactggctggcacattccactactacagctgcgagagagccaaaaaggccatgggctaccagccactagtgaccatggatgatgctatggagaggaccgtgcagagctttcgccacctgcggagggtcaagtgagggacactggaggctgggctctctcgacacgttgctcagccagtcactccttcccctgtggattgatgaaataacatcctttgaatgagtttgctctgagcctgtgactccttctgctaggcagagagcgcaccctactctttccgtgacgatgagggcggcaaaaacagacatttcttccttcatggaactggatttggatttcttgaagcaggcagcttcatattataccgatttgttctctgtc

SEQ ID NO: 2399 - DNA, 38398 bp, Homo sapiens; identical to SEQ ID NO: 2398

SEQ ID NO: 2400 - DNA, 3432 bp, Homo sapiens
gttcaaactgagaaaggttttacttttaagacaaaacaaatagcattaacacacatccaaatgccagtgcaggagttcactgggtttataaaagagaaaactaaactcaagtgtcaaataaaaactggagccgtcaagaatgactgcttgtggcaacacaggtgtaacatgtgcttgtctaaagtcgttctgtgtttgtggatatgtggaaatgcatgacgagggaaacgatgcaaggcaaaatggcaggtgctcaaagctttaagatccttttcttcacgcttgtgtgctcttgttttgcttttgagaattagggtaattcgcaggtcattttacaaagaactgtaatatcaaagaacacttccaaacggctaaaataggctcaaggtcactattaaagtgataaagggaggtccgtgggggaaaagtttgtgttctcaaaagccagatttcacaccatggcaggcactaaatctagttacatgtgcttgcagtagaaaaagaagacactgatcttaatagaggctggtctttttcatgatgcgcaggaactcttgctcactgacctctccatctccatctcgatcagcttcatcaatcatttcctatatgacagtaaagattcaggttaatttataaactaatgccaaaaggtgactaagtaatagacttttttttttttagagatggggtctctatgctgcccacactggtctcaaattcctggccacaagagatcctcctgcctcagcctcccaaagtactgggattatatgcatgatccactgtgcctggcaagcaatagacttttaatctatgtgaatagataatttgtatctatgtgaatagatcattgtagtccacccaatgccagtatgctactcctgataatagcttggtttctgaaaagttatttgaaaaccaactcatactttgtcaaacatatcacctgggagggaccttgaagattgccttgactagagggattcctggaacctaaaatagtaagcaaaattgtgcatatgtgcatttttctggaagcagggttcataggtttgtctgactattaaaggagaattaagttgtctgcagagggacaaagtacactggcttttcttcaaagaggtgctcacactagggaaaatgtaatggaaaagtcacagagggctcaaaggtgggaattttaagttccagtgtgatgcattacaaacctgcagctcctcatcagtcaggttctcacccaactccttggccacgcgtttcagatttttgaacgaaatcttcccagtttcatcatcatcaaagagcttgaaagctttcaggatttcttctttagtatctttctcagacttaacaagtagaacataaaacacatgagtagggggacaccacggttggttactactgtcctgtagccctgccactgcctggtcaggtcaccctttcctttttaacaatgtaactcgagtctagacttgcggcaagtgtcaggaagcccattttggcctcaaagaaacaccaggcaagccaggcactccatccaaggtgacgtttgctacctatcgctatatctctccctatcccatatctatttcctaactgatttggaattctgtgggaagaggtatctgcttggaagtcttgagaaagaagcacaagggcttgttttgggagcccaaagtaacatgatgggagggcaggcctcctgatgcagttgctacctggactgctctgtggtcacatgactgttttaacaggaagacgccatggacctctgcagatgactggggctccataccatgataattgtcttagctacttaccattttctgggtcatcacagttaaaaagtcaccaaagttcatttttcctgtcccttccttatcaatttcacttatcattttcttaatttcttctttcttgggttcaaagcccagggccctcattgccacctataaagaaaacaggatcgtctcaataagcacatctaaagtagcaggagcaaaaataacagtgttgagagcattaagccagcatctgatgtggtcatgttaatatgattggggaacactatgacattgatctaattgatatttgcaatcaattttattgaataatactcaaagtaagtaaagacaggaaaacagcacagtacaacctcccctgttacttactgcagggagaagagggcaaaaggggtagagaggtgatagggagatgacaaggaagaggcagaggaaaggaagggcagtacggcaggaatgcacagagcttgccttcagttctttaacatctatggtgccagttccatccgcatcgaaaagatcaaaagcttcccggatctcctgcttttgctcttcagtaagctcaggcttagggctcattctttttcgctgagaacttgatgccatgtttgccttcttaaagttggaggcctttatatgttatgcaatacacaagcacaataatatatcatacagtccatatttacataacatagttacagacacccatatgtatttttaaagtcatttatataaccaattccaaagctttgcttaaaaagaaagataacagggtttactggcaagaacaatgaatctttccatgaacttctacccctcccttttctttactgttgtttctagaagcagggagatcacttgttcagtaaggacacctcttactgaaaatcatcccaaaagagagccagtcaagaagatgactgtgaataactagagataatcagctcttcccgaacgtggggatcctggttctgaaaacagtcttacgatgcccactcccagtactccccttcccagtaagtactccgacttcccaattacttctagatttggccaaatattagtaagttgttaagatgtatattgtgtcagtaccgagtaataaaactcaatccatctggcaccttcgtgccttctccaagaagctaaagcatcccctgaatgcccctgtatttaaattgtaaaaaacattgtaacagaacacgatacaccttttcccagctgtgtgtggaaattttggcagaatgaggaggccagggggccaaggtctgagagagtcaggggcctgtgagggattcgagtcttttttgcccagggaggttcaccgaggggatcagggaatgcaaggggagcccgaggggcgggtgtgggcctgttgtgggtgaagaggaggcagcagcgaagcgcaggcccagtaggttggttagcgtctgtaccctactctcccgggaaagagctcaaaggaaagactggtgcgctaaagccgagaaaggcgcaggagaggcggcgtggccgagctggggcctgggaagggctcagccgctgggcgtggggcgcgacagagcggcagcactcaccatagccaaaggagtccgctgccggttgttaggcaaccgacgtgtacact

SEQ ID NO: 2401 - DNA, 59041 bp, Homo sapiens
ccagaagccctgctgaatcaagtgagaggagagctgcggagcaatcaccatgagtatctcagctcttggaggccgcaccaaaggtgaggcctgggctccctggtttcccaggctctgtttggggctgtttgcttccaagcctgcccctacaggccacaagcactgtcccagcagcaaagggagagcagcatactgggagaactggaaaggaggtcgagggtcctggggctgcattcctcttctgaggcggttggcttttcccaccacagggaagcctctgccaccaggcgaggaggagcgcaataacgttctcaagcagatgaaagtgcgaaccacgctgaagggggacaagagctggattaccaagcaggatgaatcggagggtcgcaccatgtaaggcaaggaggcggggagggaccgcagcaacgtgggggcgcgcaatccgtgggggaccgaccatacctggggatgcgaaggggcttccaccattcagagctccgccaggccatgtggagggcagagcgtgggaaaggctatccagcaatgtcacagggtgggagagcccctgggtgcctgggaaggagaatgtgtggcagaaatggcaggacttgctgggcagcctctaggatggaggccacaggatggcaggtgacagggagtctcggagccaatccttcaggatgcctctttcccccagagagctgccctcaggccggagtcgcgccacatccttttcatcagctggggaggttccgaagcctaggtaagaggtggtgctcaggtggctggtgggtcagccccagggactctcctgcagcttggggccagccctcaacagggaggggtgggcagtccacaggggacagggatgcagccccagccaagggtctgcaatgagtaatttgaaatctgcaggaaggaggggcttctccactgcaccttccttttgggaaggggagtgtaggagtcacttggtccaggcccttggcctggctgtgtggctgtggggcagctgacttccctgctgggcctccgtggctccagctgttaactgggattgaaattgtctttaagaagaagacgacctcccacccattccctgcagggagtgatactgcctctgagatgctttgggcagcttccagagtcacagtgactcactcctgcaggtcaccctgactgcttgagtgtacttgggactcagcatgcctgtagagaggcacgagtttgctctgactgtctcccaagtttaccgtgacatattttgtcagctgaccaaggagaactggcttctctctcttttgggggcttttccataacagtgtctaggggggctctgaagcgtgggcacaccctgctggcctctggaggaactgctcctgacagagaaagggaactgaaattcaggctcgctccttgctccaaacagccggcaggcggcttctcagggggtggtagaggcagtggcggcctctggaagggagggcctcaagtttacagccagcacacagggctacctttagtaactacggtctctctgtcacccctcgatgactcagcgcccactacctgccaggtcccatgctgggcacagaggatgcaggagtggtcaagacaaaggccctgtctttgggcaactgacgtcccagcaggggactcaggcaggaccctagtaaacagttcaatacaaaagcgagaacccccaagtgtgcctgcaacatggccacctctgggaggctgtcccctgttagagatggagattgtggggttggagactaccggaggctctgtgttgcccttgacccaaaccccgatgctccagcccacatcccctccactgcaggacagaagggtctaccctgaccccttgactcctcccctaactctgaggaggactctttgcaggggcccctaactcctgcccggaggccagaacttccaggctgaccacccctggctgtcagctccctgcccgctcgtcttggctgccccctgagttatctgagccccctcagttgctgccaagcaggaggtcccaagcacccagagcctaatgtttcccagccgctgaacaaggcctggccgcgccctctcgtctcaaacttccaccaagacttggggtgtgggcatgcaaggagctggagcaaagagggccccgagggacaggaagggggacagctggcttcggctggctgctgcctgggctctccccttcaagccctcatgcaccttcctggtggaggctgttgagggagatcaggtcagaccccgggctgaggggaagcctctggctctgactggggagcctccagcttgcactggttcagccccaagcacagaggatgggagggctgtcagctgagagcagtgctccgtcggcgcagcactgggaactggctggccaaggagaagctggactttggagaggccatcaagctgccttcctaggcacctgccatgaggagtcacctggggcacttttcctgggggagcatgagggaaataggcagagcatagcgggcacctgatcaggggcacagggggctggcacccctcgtttctgctgtactgggacacctggagcacttgccagccaatcttatttgctatcgttaagggcaggataaagtaggatgacctcagccctccagcaagcctcgcttcactccaccccttcttctcttcggcaggcctccgagcacaagggctcccactggctacatcatccggtaagtgaccgcaggactctgccggccttcctgtgcccactcacgccaagccctgacttcttacccctccagtccctccagggagctcaccggcatctcctgggctctctttcaggggagtgttcaccaagcccatagacagctcttcccagccccagcagcagttccccaaggccaacgggactccaaaaaggtatgtccatggggtgttggccagtcggccagtggggaggtgtgagggcctggtctgggctcctggcagagacagtgctctgcctatcaggactgtggggccttggaggtgccagctttcatcctgggtagggcaggaccctggagagcagggtggggtgaccagaggagatgggctggggtgggactggcagtcccaagtggatgtgtgggtctctgggaggtcctgggccactaacagtgtccttgtcctggggtcagtcctgactaggcctggctaatgggacagagaggtgcaggagtttgggaggggctgggtgtagagtccccctagcctggcagtgggcacccttgacttgacttgctgatggcattgagaaggctgaagttgcatgcaattcaagcaccttggcatcaggcattgcctgggactccgtcagactggaaaggccaaggggacccggaaacaggaagcaaagacacaggcaagagcccgctgggctgttccctgaagctcggtggggtttgcctacacagctgctctgagtggcgcagttccgggtgtctgtcagggccaaaagcaaagaggaaaggctcccaggcagctcctggtccacctctcatgtgtccactgggctgtgtggccaaatctggaggcaggagggagcctgcaggtagacacatggaaccttctcctctctagtgctgccagtctggtgagaacagctaacgctggtcctccccgcccctcctcctctggctacaagatgaccactgaggattacaagaagctgtgagtatgcaacgccaggctcagcgtggttccctcctccaaggaacaagtccaaactctgggtccactgaaggcagctgactacttgccaccgagcacagcccgggaagtcccgcctgcctgacactccctgccagttgcagctgtggcctggagcccaccagagggtaacaagccccagaaaactggatggctgtgcacattgcacgtctgatccgaggcagagcggagaccgcaggaagcttgtaggaggggccccacggatctggggaaagggtcatgggtcgtgaggctgctgctggctggctgtgcttcctgggcttggccctgcacccggccgagcctcaggtgctctgcctggctgcactgggctgggggcctggggatcctcagggtgctgctgtcagtctgagcattgtgtgcctaaatctgagctgcttcttggatagaaaccttcgggttttcccttagtgctccccttggggtccctttcaaagccccccaccccccactgcatgctcagggaggagggttctctggacagaggtgtgaattgtgtctctagttcccaggggaccacatctttccgttgtttgtcccttgcctccatcatccagggttggggagctgctgggtaacctttctggggaaggggagaggctcgaacagggagggaggggagagctggtctcagggaggaacaagtggcatgacctaaggcccaaaggcagagatattgacttgcctcgtcattgttgttgaaagccaggaagccaagctgctgagggtggcagcctatgacaggaaagcgcctctcccctctcttagggcaccctacaatatcaggcgcagctctacatcaggggacaccgaggaggaggaggaggaggaggtggtgccattctcctcagatgaacagaaacggaggtaatggaatggtgccttttgggcatcccggggggcagggcaggagcctgagtcttcgaagactgctggaatgaattgtactggttggggtgacaaaatgcacaacacgtaggccatcagcggtagcccacggagcatgagaataggtgtcattctctgagtgccagaaccacccactcagtgttggaccagctgaggggcccttgagaaccttctgtggggtagaacctaggtaatgtgggtccggggaaaagcctcctcatgtggaggctcttcagggctctaaatcggtttgttagaaagggccctgagacagttgaacaaaaatattcagggagaagccacctgcacagtgccctctatctgcatgatctgcatgccttgggggttctgaatgccccggaccccaaactgagctccaggcatgcacagcagtgggagtgtgccccatgctgctgaaattctaccctagtctctgcgccaagctgccctcgtccacacaggccagcaaagttccatggacccttgcccctcctcagtcctctgtccatggggactgaccacataccacccagtgctggtgaactatgacaggaagggtttgttaagcaccttttgtatgcctttggcttggggcctgtacagcagttgggccctgaggaaataaagccctcccctccctgggctcagccagccaccaggtccatatctgctgacccatctgtggcgcaggaatcacagcaaagccccattgccaaaggccctggcagattggctatcctcagggaacagttcacagtggcaggggcccccaggcctgggtggagcaaggaaaagagccagaagctaggagctgcctagcattgaatgccagctctgccacctgctaggtgagtgctcttgggcaaataatgaaagcttcttggactcagtttcctcatctgtaaatcacagaggatactagcgtctactttcctggattgagaagagcaataagccaatgcgaggatgttggcatctggcgcagagccgggcacatgccacatgctccataaacatgggctgcccttccttcaggttctacatttcctttgaatagtccttggagcaggtgcaaatctggtttctctcaccccttgcctccctggggtggccctaagtcaccccgagtccatcccaggctaggctggcagagcatgtccagcttggcacccatcagatgctcccccatcccgtgtcaccccaggtcagaggctgcaagcggtgttctgaggaggacagctccccgggagcactcctacgtcctgtcagcggccaagaagagcactgggtgagttgccaccaactggctccaggctctaggacagctctcctctcctcagagctccagccttctctggctgatgaaagggtgggtggagagatcacccccaagggccttcctagctgagccttctcagattctcagatgtactttctagaaaatggagaggtctggcggctaccaccagggacagtgaagtgccgggaatggagagggcccaggaccctctgaggtagagcggtcttgatgtcacctgcccacgggctctgcccaaagcattgcctttctgcttcctttccagcagtcctacccaggagacacaggcaccgtttatcgcgaagaggtaagtgtcatcaagggacaccttggaggcctgttactggccacaggaaggccttccgtcagcaggggtgtagtgtgggagctgtggagaggggatgtggatgtgggggactactgtccctgagcagggggagttgtgaggggctgggggcttctgtctggaggcctggcaagcacctgggtggctgtggtagcatatgtggtcaagctcttccatttgccaatggctaatggggctgggcccctgacccaacgtggagcatttccaaggccctctgggagttgttcccctgcccctgttgcttgcctgatgccttgccttctgctctcatccaggatcaaaacctgggccatcaggagaacttcccctgggaggtgactgtgacattggagatgggccctaaagggtgaacagggcttaacagggaatgatcagaacgtcgggatactccagctgaatgagggaggggtgtcaccattagttgagacagggcaccttctggaggaggaaaatattcgggggaaagcaagaaagaaacttctggaaacttgaatttgagggacttccagttgagtggacagggaaggcctctctctgtgctgaggtggctagctggggactgcaaacccaagagaagacagcatgccaactgccccaggcagagggccccagtgcacaggcccggggtgggactagcttgctgtgttggaagaccaggaagttggcaggaatacagagagcagggatggtggcagcacaaaggaagtgacagagaacggggggcggtgggggggtcttcctggctgcatttggttcctgtggtttctgtaacgcagtaccaaaaactgagtggcttaaaacatcagaaagggattctctcccggttctggagaccagaagtctagatcaaggtgttagcagggtgggttccttctggaggctttgagggagaaaccatcccaggccactctcctggcttctgctggtggttggtgatccttggtgttcctcggcttgtacctgcatcactccagtctgtgcgtctgtcttcacatggccttctcttctctgtgtgtctgtgtccagatttccctcttcttacaaggacagcggtcattggatttaggacccatcctactccagtatgacctcatcttacctgattacatctgcaaagaccctatttccaaataaggttacagtcacaggttccaggggacatgaattttggggggacactattcaacccagtatgctgtccttatcctgagctggagtcactgaacccccagcctgggccacctcttggccgtgatcctgaagggttgggtcagttagacgccactggaagcatgttctttgaggcctccaagctctagggcagccaagaagaccacgagcgctgtttctcttcttgctcaaagggtggaggtggtggaagaggacgggccttctgagaagagccaggacccacctgctctggcaagatccactcctggctcaaacaggtaatccattgcgctcatctctgcctggggctggtggctgccatacctgccactcagtcactgaggaacctcagtcagggcacctccatgctgggcttcgagatcagtgtccccatgtgcccagtgacaagacgggacaaagaaatcagtaagagcccatctggctggatgtcccagggctgaaaggagcaaaacagtccagccccccgggagagagcacctggctctggtctgatgagtacgtatctgtgtcaccttaacccttgcaccactgagcctggtggcaacttgaacaccccaagaaaaagtaccatccttggggtttgagagggccagccaccatggcagtagcatgccattgtcagacttgctccttgcactccaataagttagccacattcagcatgcccagggaggaggctctgacatctccagagcctctcacagccaccttctttgccagtgcggatggaggcaggaccaaagcgtctcgggcaatttggatcgagtgcctgccaagtatgcctagccccgctgggagccaggagctcaggtgggtgccgagagctgactctggcttgtgagtgggtgtgatggcttcccgccagcctggctggctggttctgccagctggggagggtctggcagtggggtgatggggcaaggacaggctgagcactggtgatctcactccaggaagggccgtgatttgtcttgatttctgatccctgagaatctgggcagataatggtgctctcttgtctgtggacaactaataccttcttgtactttgtgcagaatggtgctaagtcctgcagggagagccaccacctgctgttgctgctgtttaaagtgcctgcctggattgagacctttgctcaaatctaggtctcctaagagctgcatctctgtagcacccttggaagacccctgcatccagaaggggagagggcctgtccctaccggtcacttcccaggcccccaagggctgttcaggctctcctaataccatagcaatcccccaatttgagctccacagccatttatagacaggtgaccactgtcctcagggttacttcctcagtctgggagggagacagaaatgctggcagagggagccaggagcatgaggccagctccctccatggccccaggcagcagactgccagggtgcttctccttttcactctctccctctcttgatcttctctggttgtctgactctccccataagaactttggtccatagaagatgtggaaaggaagatttgagaattctttacaaggcaatatctagggcagagctccccagtctttttggcaccagggattggtttcgtgaaagacactttttccacgggacggagcaggggatggtttcaggatgaaactgttccaccttagatcatcaagcaccggattctcataaggagcgcacaatctagatctctcacatgtgcagttcacaatacggttcgcgctctcatgagaatctgctgatctgacaggaggcggagctaaggcagtaatgatctctagcttacctcctactgtgcagcctgattcccagcagaccacagactggtactgatcctcaggctggggttggggacccctgatctaggggacttggcaattgagggatatgggggcaaaggctgccacaacaaagtattgtaccacaccctggggcgcttaaaccacagaaacgtatcatctcccacttctggaggctagaagtgtgagatcaaggtgacggcaaggttggttcctcttgagtctctctccttggctggtagactccatcttctccctgggcccttatatgctcatccctgtctgtgtgtgcctgcgtcctaatcacttctgtttttttgagacagagtctcactccgtcgcccaggctggagtgcagtggcacagtcaccactcactgcagcctcgaccttccaggctcaagagagcctccagccttagcctcctgagtagctggggctacagtcacaggccaccatacccagctagttttttttttttaaatttttgtagagacagggtttcaccatgttgcccaggctggtctggaactctaggactcaaatgatcctcctgccttagcctcccaaagtgctgggattgcaggcatgagccaccgcgcccagaccctaatcacttcttataaggacattggtccaactggattagggcccaccctaacaactgtattttaacttagtcacttctttaaaggccccatctccaaatgcagtaacattctgaggtcatgggggagttaagacctcaacatatgaattttgggtggcacaagtcagcccataacagtatacagttctcatttctccttatttctcttttaaagaaaggcaataaatggtttcaggtgcctttctgtttgttcgtttgtttgttttgtttgtttttgagatggagtctcgctctgtcgcccaggctctgtcgagtacagtggtgtgatctcggctcaccgcagcctccgcctcccgggttcaagcgattcttctgcctcagcctcccgagtagctgggattacaggtgcacgcgaccacgcccggctaatttttgtatttttagtagagacgggtttcaccatattggccaggctggtctcaaactgctgaccttgtgatctgcccacctcaggctcccaaagtgctgggattacaggcgtgagccaccgcgcttggcctcaggtgccttttagaagataatataggaggctgggcatggtggctcatgcccgtaatcccagcactttgggaggccaaggcaggaggatggcttgaagccaggagtttgagaccaacctaggtaacatagcaagaccccatctctacaaaaaaataaaaaataaaaattaaaaattagttgggagcattgatgtacacctgtagtcccagctacttgggaggctgaggtgggaggactgcctgagcccaggagtttgaggctgcaatgagctgtgaccgcacccttacactctagcctgggtgacagagcaagaccctgtctctaaaacaagaaaaaaaagagagaaagaatggaggagaattagattgtgctgtattatagatttaaaaggcactttgacatttattccacaaaattcctttcgatgtttaatccccatcatatggttgtcattgcaaggtggctttttaagtttgctcaggttgccataacaaataaaggctagagattcagggtccggggcaagctcccaacaggaggctcagcttgatgcttctgatagttctttcctccaattctggtcactcaatatttggagctcacccaggcagcttccaggaaagctgctggctgatcctgaccctggagggccgtcttctctgaccctaccacgttaggtgctgcactggaccaagcagccaccatcagtactcccaggcccagctcctatctgcctggtgtctgagaagcccagcccgtgaggaacaatgactcaatcaaactcagggtcctgcagcacttcagaaaaggctggtttgtggcagagtggaagaggagaatgtcacagccttgtccccaggcacagacctatcgaggctaccctctccccaccccctgccctgccctgtttcccttagctacagtgcaaaggtcagctcctcataactcttgccccccttgcaacctgaacccagtttagggaccctctcttggagaaactggttctacacatgcaccccttctcggcccccaggcctggctgctttacccgaagcactggtcaagcttgcctcacctgaccagggcatggcctcctgggtcccggtcctaggctctgcccagcatgctgcctggcagagcgtctggggagcagggagtaggagcacagcttctggcacaggacaaaaccctggctttgcatcagactgactgtgtgaccttgagcaagtctcttcatctctccatgcatcagtttccccgtggataaaatagggagagcagtaatagctacttcccaaggctgtcccaaatgctaaatgagatcgtgcacctgaagtacttaccacagtgcctgggtgctggtatcctcgggggctcccagtcataggcgtgctgagctgcagggcccttattcaaatacaggaagagatcaatatctccacctgctggcatttgagggaaatgtggccaaaggcagtgaaaaggaggtatcccctcgccccacatccccgcctcctcgctctttggcagaatgagtcacacactgtttggcacaggccacagttggtcgcattcccacaggtggctgtgatcagttttgggcttcaggcttcagcagatgcctgcctctcttccttgggtgccttccaagggtgtgcagccttccagcgtggtcctggacttcagcttggactggagctgtctgtggttgagagtctggggagatggtagggtagcgggttgtgggggaggagagacccttgtattagtttactggagctgctgtaacaaggtaccagaaactgagtggcttaaaaccacacgcatttatcctctcacaattctggaggctggaagtctgagatcaaggtgtcggaagggccatgctccctccaaaggctctgggggaaaatctgttccatacctttctcttaccttttgttgcctgcaatccttggtgtttcctggcttgcgcccgcctcactcccatctcggcctctgtcttcgcgcagccgtcttccctctgtgtctgcccacattgccctagtctgacatcagtcactggagcaggctggggtgacactttgttcccatttcctctgtgacagagccagaaacgccagtgagaaaatatgttgtgcttgcctgtgacatccctgttccctggcaccacctgatttaaatgaggcagccaggggttttatactgtcatcataaatgacatcatcctcaacaacgatgtcatcgtcgttatcacgagaggagatggggagaagtcagagctgtctgtgtgtctagggcccctcctggctttcatgatgggagaggccttgtccttggtagcccttccatttccctctggtcactttgagcactccaggccctggccagggtggaagtggagggacagagatgagcagcccgctgacccagccctccatggctcattccttgctttcaccttggccactccatcccctacccctcctgggacccctgagtggcctctttaaagtgccagtctgaacctataaaccccccacctccacttcaagcccatcctgcatcttccctttgccataccagatctagtctgtacattcaggacccctgccagcctctacctcctcctcctcccccgatctcccttcagctggcctgggtcgggctatgcctccatgaagcttgtccactgctcccatggctaaacctgttctgggccctgcagcacagcaaggtcagtttccatgcctctctgcccctgcctgaccctgctgggcccagagcttcaccagggcaggcctggggctcaggcttgtctgcacttccagggcccagggacaaaggcaggagtgactgcaatgtggcttggaattaggctttgctccatggacctaaggaggtctggtttggggtgaagggtccacccccagaaagcctgggagctctatattctctctggccctggccacaccatggccaagcctgctgggcgtcatgccttgcagtacggccagagaatgcatcagacttggagggatgtgtgtccggggtggcctgtggtcatctgggggagggctctgagcgtggctggcaagaggaaagctcaaaggggccctttgtcctcatccccgagtctgcgacatcccctcccactggttttcattccatatttggtctgtgggttttctcagtctctcgtacccctcagtccccaccagtccatgaatgcagaactacccctggcctcacaaatggccactttggataccctggtggggtcacaggctgcggttgcccctgcaaatggttggtagaagcacgggttgggaggtttcatttctacccagaagggcccttgctgtgcctgagggagggctgggctcaggtcaggggtgggagaccggggaaggggcctacaggtcagtggcccgagctcagctgcagcaccaacaaggctcaaggccaaggaggagatgagagcacatcaaaagggggcagtgggtctgggcggcccaccgcactcaccagcccaagaagggggagacttttctcacctgcaacccactgggtctctcctttggcccgcagctcaagaggtgaggaaattgtccgcctgcagatcctgacacccagggcaggactccgcctggtggccccagacgtggaaggcatgaggtatgggggtcctgctgctgtcctggctccctggacaccattctagagatggaagcagcagcctcaggtggcaaatgatgaggcctagggccggctctgccactgtagggccaacaggttgatgggaggcatggtcgacctgggttttctgccccatctcattctttcactcagaaaaccattatggagcaagcgcttagtctgtgtaagggcacaggcccgaccctgggacacagtagtgaacaggaccccctggctggaattgccatctgcctggtgggggaggcagacgccgacatgagcatgaatgaggtcagccagagatgctgtgtgccaggagcccctgggaagtgacagctcaaccctgccaattgctgaagatgggaccagtcagccgtgctggggatgttggtgggggtgggaggaggattgggtctaaggagcccgtgaaggccactgaggccattgccctgcctgtgtgagagggccactgggaatagagtggggtcactgggtcagagtccacagctctccatgccactaggctctgtgctggggaggggtgggtcaaggaggccacaaccagcagggagcacgaggggctcagcctctgccctggggtgggggtcagacagccaggtgacatgcaggcaggattcgggggctggggtggaggctaggagagatccgagcagggagactgggcccctaccttgtgaaggccagggactggggagagaagcgggagtgtacactgaaggtcatcccttaatccctggggtggcaggaacttcgagcagaggcctctcaacagtgtggtgggtgggagtgcttggggagggcttcctggaggaattgacatccaagatgagtcctgagcgatctctaggtccctttaccctcctccttggctcctcccactttaattctgcccccaaggcaccaagtcctgtccactttattttagagatgtttccatccctattgctctgcccctggcccaggcctccactgctactcacccagttgtctgcgaccgtttcctactgtcccatccctggactcccttccacatctacctgggtgatgtttccaaagggcagaagtagttatgccagccccctgcagaaagccctgcaaagcccctcccactatgctctgcagcctgaactcagtacctggccccacctgcaggctcctccctccctgggcctttctctgtgcaggctggaggctctgcctgagatgccctttcccctcttcatctttctgttccacctcaaatgtcctgtcttctgggtcatgtccttctcctgagtttcttccccaggcagcatctgagggcttgtcgattctgcatggcagcatccattctgcatggatgtagatacaatcactatgcccattttacagattaagaaactgagaccctgaatggttaagtaacttgctcaaggtcacatggtccagagcaggcagatccgctcagcctgccctactcccaccttccaccttctgcaccatagctcattgtactagttggggcagggagcagggggacagagaggggtgatggaaagacttggcatttgctgagtgaactcatttgacgagtttattcgtaggcattgaagtcaaaatttccaggagggaggtattttaaggtttgtgattgaggtttgagagagtgattagggctcaagagatttccacgttatatgcagacagaatagagctgaaatcatgagcgtaaactagctttacatggggctcatggtgagccaatggaagctgggcaccgacctcagtatgcaggtggcagccacctggccagccctcctggggacagctgggcgagggcagtctcttctcgccatgttgagagtgggcctcctgagggccagttgggagttagtgggtgtgcaggccagtataaaggagaggcaggaacaagtggagatccctgcttcaagggtggcagttgacaccttgggaggggaggagacagcccagcaagtggtggagcacgccaaagggaggagaaaaaggcggagaccaggaaggtgtgtggccagggaggtaggcaggtggtgttgacaggatcaagggaggaggggtggtgagaaggctggagtggcccactgggtcagcagtactgaatggtggtttgaaataatgatgggactgtctctcctggatttgacaacatggggctccctgaggacctgaaggagaacagaagggggcttaaattaggagattaggatcagggatatagtccagaactcaaatcccagctactcctcttattacctgtgaaatttggggcaaatcacaggggctttgtgtgcctccgtttgctcatctgaaagatgggcatgggtgataacagtgcccatatcctggggttgatttgcagagttaatgcatataaagtcacgagaacaggctcaaatgctcaatcaacagtagctattgccaggcacagtggctcacacctgtaatcccagcacagtagctataaaacaacaacaacaaaaaacaaaaaacagtagctattagtaatgaagttttgataattggccaatctgtcaatcagcagggtttgtttgtttttggttctgttttttaagacagcatcttgctgtgtgtgcccaggctcaagtgcagtggtgccatcacagctcgctgcagcctcaaccttccaggttcaacctcccaagtagctgggaccacaggcacacaccaccactcctgactaactttcaaaaatatttttgtggagatggagtctagctgtgtttctcaggctggtcttgaactcctggctcaagtgatcctcttgcctcggcctctcaaaatgctgggttataggcgtgagccactgcacccggcccagtagcaggttttaagctccgtggagacagctggcgtttgaggatgaggtaacagcccacacctgagtgtgaatggctgctgcatggttaacttccatttctttcctccataggtcttccccaggcaacaaagacaaggaggccccctgctccagagagctccagagggacttggctggtgaggaggctttcagggcccccaacacagatgctgcaaggtaactcagtgcaggaagcagacacttcattcccagaacacggagcccacatacacccagctgaaggacttccatggcctccggtgcaatgtcaatggatgcagctggggccaggaaggtcctgttcccactgttcccccagtacctggggtactgcaggtctttaatgaacatctgttgaaagaaagaaagaatgaatgaatgaggcctggagggaggtaggcccctgccatgattcctcagggagccagttagagagcaggaccaaactccagggcaggctatccccagctcctggcctgtgctgagttccttccattcccctgaagcttccacactcactgtgcttttactgcaggacaaagcagccctgccaatggccagggcaaagcaaggccaccaagctggcagtctgggagagtcagtgaccaaagtatgtgggcccccatagagcatgtagcggagactttcaggatgacccgtggactaagggagacattgtggcaaggggtgaggggtccaggacgggaagttggagccatagcggtggatgatgagtccagatgggatgattgtccccagtcgctgcacagccagcccactgacctgtcctccaagccagaccagtgccaaatgtgtctggtgagcagtggctgcaggctgggcatttcttcagtgagaacctggtagccagttacagctaagaacccacacacccgtcttctcagtgtggatccctggagcccctagctggaaccctgagccctggaaatgaggaaaggaatccctctatggcttattaccagacccacatgtcttgccccttgctctgttggcaatcagctccccccaccaccaacgaactaacctcctcctgactttccaccttgctcccaaccaacccatcaggtttggaaaaaatacagaaatacttcctgttagagtcaacttgggcttggctcagctctggtcagagcagcacagagtagcagccaaaggcctgtgcttctggtcttgaggcccactctcatggcatctgggttagatgagatcaaaacgcaactagagtcagcaaatactccacttctcataacaggtcaagtgcacagttgagtgatggcaatgtgggatccggagccacgggctcccggcctgaaggcttggctgcagtagacatcggctccgagagaggaaggtgagctgcccgggggaggcaggttctctcatgcccctggtgacagaccagggtcaagctgccaggctgcttgggctgctatgggtggggcactggtcacttcctatggctcctgtctactgcttctcccacactcccacattccaccacatcctgtgtccttgggctttccactttttggaatcttgttcatttttctgatccctgccactggccctcaagctcctccagagtaggcactaggcccactcacagctggaggcccagccctcacatggtgctggtcttgggctggtcaaatgaacgtgtagggaatacatgaagggacaaattaatgagtgaatgactgaatgatggaagagtcggcaccttcttacttcttggttaagctctgaggaccagctaggaggccctttgctcctgctttctcccttctctccttttcctgccccatccctaccccaggcagctctgctctgaggttcagggagaggaaaagcggtagccctggagagaccagcgtgtccagctgggctctggcttcttggacctggagggagtcaggggccactttctcaggtgatttgcagagtggcaaggtccctcttgtccctaagtggttccaaaccaagcctgaatcattcttggggcaaaggctaggtatgcagatgttggcataaatagtttagctccaaactatgctagagtccttctggttcagagcagatggctagggaggagtggcaaagccagtgtctgcaaagagctacaaccgcaagatatcatctgcctcctgcatcctactgcagtctggccaaggagggaatcctgtggggaaggccctgctgatgctttcctacttccctcagcacacccagggcccctttccctcactaacttcaatagtttgcaattcatgccatggaaccagagcccgaattctaaatccaggcccacaagtcaacacaggaaggggacagcaggtcctggcctctgaaaccactgtctccgagcaggtccaaggagaggccaccagagactctgttctttaagctgccactaatggggaggactccgctagagccctgtccatgcagcctgcatctttttgccatctgcagaggcattggagggatctttttaaaaataagctagatcacatttctcccctgctaaaaccttctagtggctctccattttccttagaatgaagtccaaaccctttcccatggcccactgggtcctgcatggcagaatctttggccttctatccagtcggggctcctgctactctccccacagtggtgcagcttgactggctctgctgatggctgtcgcggaagagacttctggtctactgtgattgggtggctctggtctcctccatgtcaccccgcctgcttatacaccctcataacatgaagcctgtgctgtccactgtttccttaaaatgaaaccaagcctcaaagttacttgtaaagtcatctgaagaatcttctagattttcatgaattttaacccagtcttttacagttgtcttacctatatagtagtccctaggtatctgtgggggattggttccagaacctcactcatataccaaaatccatgcatgttgaagtccctgatataaaatggtgtagcatttgcatgtaacctatgcacatcctcctgtaccctttaaagcatctctagattattataatacctcatacaatgtaagtggtatgtaaatagttgttatactgtattgtttagggaatgatgacagaaaaaagcctgtacatggtcagtacagatgcagccatcctattttaattatttttcccacatctcatctcatcctctcctctcctctcctctcctttttcagacaggaccttgctctgtcaccagggctggagtgcagtgctgtgatcacagctcacagcagcctcaacctctggggctcaagggatcctcccacatcagcctcccaagtagctgggactacaggcgtggaccaccacgcctggctaacttttgtatttttggtagagacgaggttttaccaggttgcccaggctggtttggaactcctgggctcaagcagtccaccgacctcagcctcccaaagtgctgggattacaggcatgagccactgtacctggtcccaaatattttcaatctgaagttggttgaatccacagatgtggaacccacaacatagagggctgaccacacttagtttgactataattttcaacaaactcctttattgtttttcctttttttttttttttgagacggactcttgctctgtcccccaggctggagtgcactggtgcgatctcggctcactgcaagctccgcctcctgagttcatgccattgtcctgcctcagcctcccaagtagctgggactacaggcgcccgccaccacgcccggctaattttttgtattttttagtagagacggggtttcaccgtgttagccaggatggtctcgatctcctgaactcgtgatccacccgcctcagcctcccaaagtgctgggattacaggcgtgagccatcgcgtcctgccttgtttttccaaaggaaaggttgtttctcatggcaacaaccactctccttttccattcattttcatggatttacttaatcatcgaacttagtgattcttctccattagtggcagctcaaagaactgagttgctgccccaggggcctttccttggatctgctcagagacattggtttcagaggccagggtctgctgtccccttcttgtgcaaatacaactggcataaagaggtctgggaccaaacaagagcacctcttagtgagtgtgctggttagtggagggcacaggcttgtataggcagtgattgttcagcatgccgtgagcatcagtctgcctggtttacagagacacagagaatgtgactccaccctgagaaggttgggtaagacattccccactaaatccatattgagtgggtgaatacaggtggactgggaaggtgcactgcttctataaacagccactgggccctgtggtaacaggaacacattagcacatgttatggcccaggcattattcaaagtacttggcatctatgaactcatttacttttctcagaatacttacgagacagacatgattagcatccctatttcattgatggtaaaactgaggcccagaaaaaaaggtcaggtaacatgcccaatgtcacacagctgggagatagcaaagccatgatttgcaacgccagagggcaaccactatgccacagagccccaggtgtcaggctgccttgagatataaatattgttcctcaagcatccatttgagcagcttcttggtcctcatcatctgtggggggcaggatccactttctcgggagagggtagacatacagacacaaagtcctgaacctggaccaggtctggccttctttcacaggctgtgtgcagctgctagctttgcctctttcctggaagaccaggatgggcacagtgccaactctcagtcctgcaagcctagaccagcagccatcaggtaaggttagggccactgccctagtgccctatcccattgccagacacagcctttggggcccagcctcagctgcagcaccccaggatccccctcgaacttctcagctccatgccactttcacatcaggtgatcacagcaagacagggaactccagggggagctctgaccaggggcagtggaagaagagggatgggtgatatgtctgctcacccagagagcccagcaccaacctacatggacccaagctgaggtggcagagaggagggcatctgaaggcagagcctgggaagagatcctgctaggaggtctcagagaacctctgctgtagggactacagccaggtttagcaagcaggagtcagggagaagattcccaggggcagccagcattagagggctcagttcccaggagcacaggaccggtggctgggatgggcaaaaatggctcctggggcacaaaggtacaatgggaagaagctgtgcattcccatgctgtaagcgtctgccctgtttcacccaccaatccaccagtgggcatggccactttgctgtgggtgtgtggagcatttggcaagtcctagtaaggaacgatctttcttaactcccataaaccctacagaggtgtaggtcaggtaaggatacgtcatgctcagggtcaggttccagccgcagctgagggctaaggggaatgggtggacgtggggcagggagctggaagaacactcgagagatagcaggtaaatgagacatggctttactcagcagcagctctcttacacagctttctcaaactagctttctcattagcagcttactctcacaccgtctgccctgtcttggctgcttagtccggtggcccctacgcacagctgcgtggccagctctcccttgccttcagggtcagcagcttaattctttctctccctgggcacgggcaagccaagctgtgtcctggctcccctctgtcctggctcccctctgtccacctgcaaagacagacagctcttgctctctctctttctctaggttcccgtgcacccgccatgtcaagctatgttgagctgagccaagccccaagagacatgtcccccatacacagcgtcaacagggcagttataccttttacagacaatagtggtttagagccaagtatgaacttacataaacaggttatataagaagtggaggtgtgcacctgtgcaccagactcattgagtcatgcaggcctggatatccccctctgcctattccttgaacaaagcacatccaggtaccttacaggatactagaacccaaaaccaggagacttccccagggaacccaagttggtcaggggcagtgtttgctcttgaactcaggtgctaaggccatgtccaaagctgacatgaggttgtcacacacagtggcatcggtgccacactaatgccaggactgagacaccagcctttactggaagacacagttcctccctttctggtgagaaggcagcctggagggggaagacctgggccccagccttctttggtctgagatctcagcaggcctgtgtttccttcctcagctccagtgccacttcagtctctgctgtccctgctgataggaagagcaacagcacagcagcccaggaggatgcaaaggcagacccaaaggggtaaggcatgagcagacagtgctgaacttctggggtggagagaggcagcttgggctgtgtgtccattggcctttggctgggaaggtgaggccagcaaggtttgtgagctggcctgaggcacatagcaagggcagaagccccaaccagaaccctctggcttctggggccagggagctttccactaaactgttgccttggccaggaaatacatcatagtcagaaagggtctttcagtcagcaaccactctgacagcaactgccttttgctggaggctggagcatgcagacaaatcagaaacacctctgccctccaggaactctcaggcagggggtgggcaaaggctggtccagattagagcaatacatgagcgctagagcaggggaagggggcttcatggggactgtatgtagctggatgtggtcagcgatgagtgtccttgttggggagtgctggaagaggaggctcagtgaactaggtagggcttgattggcctcttgtactgtgatattggagtccactgtgtgcacagccctctactcacagtgtctcatacggttctcctcacagtctctcaaaggtttatgcctaattacaacaaaacccaaaagcctggagcctaggtctctgtgcctcctgggaaggatagtgctccgaagaaaacagccgcagctgagatagagtgatggcagtgaggagggtactacttaggtgggtggaaaaggcaactcaggcgatctcctctaaagaggagaaggagccaactctagaaagaacacggtggagagagctatagataaggaaccacaaaccaactaaccctgaggtgggaacatgcttagcatgttccaaaggacagagtggctggagcttggccagtgaggagggccacagatggagcagggccttggtaagccatggttaagagattggatcttatttcaagttttaagccaaaggggagtctcatgtgatttaggtgtttaaaaggtgaatgcatgtttgcattttcataccacattgctgttgcttttttacttaaaccaagatgctgggggctggggtgggcaatggatatctaaggtatgaggccttattgtgtttcttttctcattcgaattgcactgacaattaacaatcagagtgaaaacaacagctgacaccaatactgtgctgtgctaggtgccttacagccttcccagcaacttgtgagatgggtaaggtgggaaactgaagcatagaaagattaagtgacttagccaaggccttacaagtggcagaactgagttccaagggaagaggctctaagaaaatcctcaggagaaactacgaaaaactagtttatgaaatcttgtctttggagcctagtctcaagacccagaatcagtaacttacagctggttaacatggttaacatgctgtgtgatctcaccttaattttccccaaacgtggaaaaggataaggcttcttattatgcaacttgacagaggagaaaattgagggactcactcctgtaatgaacacacttaggaacagagcccagatccagccaactctagagccaggctcacgctactttcctctgatgtttaaacgtctgcaaaatcagaggtgttttttttttttttttttttttttgagacagagttttgctttgtcgccccagctggggtgcagtggcgcaatctcgactcactgcaacctctgcctcctgggttcaaacgattctcctgcctcagcctcctaagtagctgggattacaggcacatgccaccacgcccagctaatttttatatttttactagggatagggtttcactgtgttggccaggctggtctcaaactcctgacatcaagccatccacccatcttggcctcccaaattgctgggattacaggcgtgagccactgtgcctggccaatacaaactttcttgattacagtgtttcacaactctggctgtacttgagaatcacctaggaagtactgaaatacactgttgatgaaaaaggccatactctgtaaaatatttgaagaaattctgagccaaatgttaggactatgacccgtgacacagcctcaggaggtcctgagagcatgtgcccagggtggttcacttacagcttggttttttatgttctagggagacataagacatcaatcaatacatgtgaggtatacattagttaggtccagaaaggcctaggtatacattagttaggtccagaaaggccggacacctcaaagctgggagtgtggtgggggtgggggtgggggtggggttccaggtcataggtggattcagagattttctgattggcaattggttgaaagagttgttattctctaaagacctggaatcaatagaaaggagtgcctgggttaagataaggggttgtggagaccagagttcttatataggtgaagtctcataagtggccgcccttagaagcaatagatggccaatgtttcttattcagacctttaaaaggtgctagactctcagatcagaaaaagtcctggaaagggaaggagattctctacagaatgtaaatttcccccaggagagacagctttgccaggtcatttcaaaatatgtcaaaaaatatattttggtgtaaaatacttcaatttctttcattacctgctgtctgtcatgtgatgctatactagagtcaggttggaatttggcatattattgcttcaaggagtctgttttgtcagtctgaatatctctctcaatgttaatactggtcagttgggcatgaattccaaagggaggagaatatattgaggcatgtctgaccttcccctttctcatcatgacctgaactagtttttcacgttgtgtccccttggctgagagaagtgtccattcattcagctggggagcttagaattttatttttggtttacaacacaacaaaaacttcccgaagtcccaggtagagatttggattttatttttctggggtgggtctccatcatgtgtctttttcaaagctccccagtttgttctccttccaggctaggtcgagaaccatcgttctcaggtagtggttctgacccaggggcatctcccaaagcttccagcctgctacgatacaatgtctggagccatttttggttgtcaaaactgggagtgggagacactactggcttcttatatgcagagatctgggatgctgccccacatcccccaacacacaccatagaattatggggttcaaaatggtaatagtgctaaggttgacaaaccttgctgtagagccttgacgatctatttgggaagacagcagggacggaaaagaaaaagggatggcacagaaccacacccctcaccttccccgaaatctgggtagcgggcacaggacgtgtgcgcctgcgcgaatgcgcgctcgccaccagcgtacgcgacgcgtgcgcgcctgtgcacctcggcgagcacgcgcccgtagtgagtacgcctgcgtaggccgccatttcttgaagccccgaactcggtcgcagtgcccgccgggaaaatgcgaccgtccacaaagtgaaatggccgcccgggacgagctcggcctcggcggggattctcttgaggccatgcccgtgccggccgccagaggtcgcccgaggatcacgaatgggcccgaggagctggctgccccttcccccgcgtaaggtctgaagccgcggccagagtggctttggggtgaccgcgcgtggaccgtcgccggcgggaggaagcgcggtcccgcgaggggccgaacggggcccctgcggcttgagcttgtttcgcagggagccctggggccatggcctctgggacactggacacgggtcgtcagggctgcccagggggagggggtgtggacgtgcagacagggaaggcagctggaccctccaaccacgctgggccctcgggctgaccggggctggtctgtggggcagtgaggaggggcttcgttccctaggagtttgatgagggagcgccatgggggtggcgtcatcctgacatcccgcagggcagtggagccttactttccctaggttacaacacagttttaactgtcccaaactgtggggactccgccctattccatcttgggccgctccatcacactacagggagaggcggtatagtatagtggttgagagcctggactctggtgctttgggttccagtccaagctctgtcacttacaagcaccgtgaccttgggcatgttactcatcttctctgtgcctcaggttcctcacgtgcggaatagtggtaatcatacctcctaccatatagggttgttgaaatggccaaatcggtttgtatatgtaaagcctgtaggacatttaaacctgcgagctaagtgaagcagcaccagaggaatatctcctcctctcagaggtgttcagggacacctggaaagctaacttaaccagctttattggtttgatttcatttgacatgacacgatatctcatcttcttcctactaaacttttgtcatcaaattttccatctagaacatgctgttttcctcattatgttgcaagcatgggcttctcgtttatattttttctgcatgaggatcaggtgaagtttaggcaccacatttcctcaccactggcaaccgttgttggccagtggaggcagtacaagggtggaagtgtcagctgggtgcagtggctcatacccacctgtaatcctatactttgagaggccgaggcgggaagaccacttgagttccggggattgagatcagcgtgggcaacgtagtgagacctcatctctacaaatattatctatatctatatatgtatatgtatatgtatatcatatatatgatgtatatctcatatatatatgtttttgaaacaatgtttcacttctgtcgccccagactggagtgcaatggggtgatctcggcttactgcaacctctacctcctgggctcaagtgattctcctgccttaacctcccaagtagctgggactacaggcacacaccactgcacctggcttatttttgtagagaggagtttttgccatgttgcgcaggctggtctcaaactcctgacctcaactgatccacccacttctgcctgccaaagtactgaaattacaggcgtgaaccactacgccgggactacaatttccgttttttaaaagaatggaagtgtgtagattatggttgtgttaggagttgacagtggctgtattaggctactggatctttggtccaattacactcagaaggaaaggcttcagagaaattaatccaaaatccaaaatcccgttggtcaccatcccctatgttaccttgcctatctctaaccacttgacttccaggaagttcatgaggagctcggacaggatagctgggaagtaattcccctggatgttacattgtccagcagagcttcctgtgagtgtttgcctaagatttcctttttatgacccacataggtcatatgtcctaaaatcacagtggccctgccacaggcctaggaaagaagaagccttgttcatccatttgtccctgtgtcacaatagagcccaaatttctctttgtggataatcctggctctatccacagacttggtgagggcaacctctactagtgtatttctacagaggacgtgggacaggacgggactctgattaaatccatagtaaagctaactcagggctaccacagtagggagacaagctcttcaggccttgtatgtttgtctttggctcaagcaagcatgtcactgacagagattgaatgggtgtgtcagggcaccctgctggcaaccctgggactggtgttacctgtgcagaccacttttggatctgcatgggctgcagcagaccctaagggtggaagcagcacagagaagcacaggcccagtgggatggttccccacagttactgtgtggcgtcacactcacttgcctgcagttctgcctggtgcagctggaggtggcaattagcttgttgtgcctgctggagaattttagttcccttgacctccacctgaggctgaagaatcatgttgctttcagggcatactttccaaaaagtgtggcctctgttggccttgttattccagcttgaaggcaggaagcctgcctagacaaagttaactcctatatacaaagagtcccagggtagtttgtagcgtgttcttgtctcggggtagcccccaccagctattgaaggtaggctggtgatgttgggaaggttatattcagagtgagctaggatcgaggtgatggcgaagtagattttcattctgaaatgctgggctcactctcttagtagcccaacttggtgtttgcccctggcctagtagactctggaagcagtaccttgcacctcggtgtggggctggtgatgggaggggtgtggaagtggaggatcagctagcagcctctttcccacggtacccagattggagggtgcagtgcaatcatggggtgaggccagggaggacccctgaagagctcgatgcctgagacatctgggggaagccctgtccttcttgctggattcaggggtggcaaaagccaaaaattggagggccaggtgcaatggcacatgcctgtaatccctgcactttgggaggccaaggcaggaggatcgcttgagaccagcctgggcaacatggtgaaaccttgtctctacagaaaaaaaaaaaaatacaaaaattagctgggcgtggtagtgtagacctgtagtctctgctactcagaaggctgagacaggaggatggcttgagcccaggaggcagaggttgcagtgagccgagatgatgccactgcactccagcctgggcgacagagtgagaccctgcctccaaacaacaacaataaaaacatcggaggcttcggcttcatctattacacatggaggcctgttcagtgagaagggagcagcgatgctgggctcctgccaaggaggagactgtctgctccctggaattggggctgtgcctggctcctttctgccccgctttcagggatatgagtccctccaagtccacaggaggtgacagccagcttgcgtcctggggctgaggcagggttagtttcagagcacttttttcataagggtgcttattcttcttcagggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcaggtaagggctgagctgcagtgggctctgcctctggagcccatgtttttgttgaggtctgcgacccacatgggaaccacttccccacaccctgtgccaatacccgacacattgcacacccaggctcctgttctgtgagtgggtcatggtgattccctggtcctagagcagtgtcatcaggcttcttgtggctcaaggagctgggaggggactgtgataggaggatgtgtctgtccccaggtgtgagaagccctggctaattcccaatgcatggggcaggaaggaaggctgtctctcagagtacaggtgctctacaggtgggggtcctgggcagagtgagggctatttgtgtgggtaaaatgccattgtcagagaaggacagagtgtgaaagagcaaaaaaacaggagggtaaaagtgcaaaagtgacagagtgaagcagagagagagaggccagagggagagaaagggagcatgtgtgagcaggcatgagagagtgacacaggatgtgactggccatgtgttggtgtgtgccactgtgcatgagcaagaggacaaacgtgcctgttactggagctgaccatgtggcattggtgtgagagtttcaagtcaggctctcttgaaggcatcttgcctgccagcgcaaacactgcatgtccttgcagctctggacacgtcaacaggccagtgattccaggggtgcaaagcgaacagtttcttacacaagacagaaatgtagaaggagagagctaagactcatattgccccgagagaggagctagtggaatccagcagggcatctgctgtggggagcaggtggagcctggggttccttttgcagggatgaaagaaacacagtcatctgccttctttgttctggggcttcttgtaccacagaggttccataattattaatagttaggttatttttagggcctagctcaactgttagataacaagttttaccttctaagaatatctagcccatctttgattccttggctccaggccctggagggtcccagtccaaaaacagagtgaacaactttggacttgctgtcacattgtgtggcttctagaactagtcagtgttccatgcagaaggggtataaaaagtgaggcttgtggatgaaggaggaggcgagtggttctgggttttgttttcgttttgcgggggagtgtcaggaaaggctttctttacagggagagtgatgttggagctgggtttggaaggctgagggagattttgccagatgtgccagacgtgcttgggaaggcattccgagtggaggctcacaaagtgtatagggaacatccagtcaggtagccatcacaaaggagggttaatccagcctggcttggcaggaagcaccaagtaggggctgggcaggcacctgctcctaggctgaggagtgtgacccacatcctgagggccttgggagccaccgatggttttcctgcaggagagtgccacagccagactcgagtccaaagaagatccctccattgccctgtggaggaccaggccaggggagtatacgacgagacaaggcaggaggccatattggagactgtttgcttacaccaggggcaaggtgatgaggctgcaagtatttttgaattattaaaggtaaaagcgggcttggcgtggtggctcacacctgtcatcccagcactttgggaggccgaggtggcagtatcgcttgagcccaggagtttgagactagcctggggaacacagcaagaccccatttctacaaaaaatttaaaaacattagccaggtgtggtggcacatgcctgtagtaccagctacttgggaggctgaggtgggaggattgtttgagccttgcacgtcgaggatacagggagccatgttcctgccactgtactccagcctgggtaacaaaacaagatcctgtctccaaaataaaaataaaaaaaataaagataacggtgagggaaaagtggtagccaaggttgctccccagatttcagggctaggcaattggatgggtggtgacaggaactagctgagggtaaggagtttgggggcaggcccgctgagagatgcacagagatgagaaggtcactgggccatgccgaatgagaagtgcctgtaggggctccagccagtgatgtccagtaggctactgagtaaacaaatgtggagttgagcaaagatctgacctggggctagagagctgggagttgtcagctcataggaagtcactaaagagaatgcatgaggttgcctggagaatgcctttggaaggcagtgtgtacaaagcatgtattctcggcttttctctgcagacttccagggacagttgtccagccaggcccttggctgggtgggtgagtccacgtggttcagggatgctgagggaagctgcttcatcagctgacatttctctccattttctgctcttcttttgtctcaaaaagaaaaaaagaggggatattaattattgatcccctaaaaccctagctgaatatataaaatgaaaagaagtaaaaatatgagagaagcaaaggcagatggaccataattttggaaaataattccaaaaggtcttaaggaggaagaggagctacagagaggtattgagaaggaaaattttggataaatggaagaatcaggaaagactaccgtcatggaaaccaagccacgctgagctaactttccagtgctctgtagatgctgaaataggcccatcagatttggctatgtagaactcatgactgccttgaggggagtaggttggggcagtgggaaaggctgtagttggattataatggattgaggagggagcggaggataagcaggtgcagttgatggggtacacactctgaaactggctgtgacgtgatggatgtgggaggggtgagcagataattacagctacaagataatggggaaggtttcctataggtgaaagcaacgtgtgcatgttaggtaaaggctgggcagagggtgcctacgtgaccagtccccgataaaatccttggactctgagtctctcatgaattgccctggtcgacagcatttcacacttgttgtcacaactcactgctgaggggaactgagtgaatcctgtgtgacccactgggagaggactctggaagcttgtgcccgggttccctcagaaatttgccttgtgtgcttttccctttgctgattttgcttcgtatcttttcactataataaaccatagccttgagtgtgatgatgtgatgtgtcctgtgagttcttcttgtgaatcaccaagcctagggatggtcttggggacccctgacacagatgggcaggatcagaactttatgccataacaaggactttagattttctttcgagggcaaagaggagccaggaaggtttgaagcaggggagtgatatggcgagagtattgctttgcaatgggatctccagtggcagtgagaagagtgactgaagtgggcagagtggagcagggagaagaggaagtgcttacagcatcctccatgtaagaaatgatggggcctggactaggggactagctgtggagatggagacagaactgtaaaataagtagaagagatcccaaattggatgacaggtaagacttgggagagcagtgacggagagggaagtgacaatttagaaagccacatttctggtcgagtgagtggagtatgtgacccctcctggcttaggtggtggccaaagtatctctaacctgcctctatactgcctgcaactgactgagcaaatgcctggtccgtggagatcccaagctgacaagggcacctgaggcaagcctctggctttcaggtggaggccctacctaggctggcctggctggattgccctggcacactgctgttttgctgaggcagacagcagcactctgcaagtgctcttctcctgttcctcttagtggtctaaatcctgtagcatgctggggtgcgactgtagacaaatcccctttccgggccccctggggttctctatttgcagtctttgggtctggtcactggcatggcatctcagtaggctaggttcatcaggaagggtcaactatgtcatggcacctgatgggcagcatttagagtctgtgggccaggggcttaagggctgcttactgctaatagttctaagtagcaagcattccctcagccctagtctgggcacacgccaggaagaaagccactagatgtgctctcctagtggataactagcctggagttccaagaagggcagagacaggcagagtgagagccttcagagatgtaggcaacgatagtagcagaacttcgagggagagtagatggaaaaattaaaaaaaatccttgtcattatttttaaatgtctgaattgaccagattagaatctttgagagtctagacactagggagatctcatgggtgggccagttattatatcatatggagggagagtacgtatgacccagcacgagaggaccagaggacagtcagtgctaagggtaaaaccttaggccatgggagattgagtttttcatcagttggcaagttttcactttaatactccactgtttccatcatttcagacgactggggatgataaggacaatgtaatttgggggataaaggaagaactcattatatttcttggatgactttactggggaaatggattccttagtcatttgaaagaagcggtagaattccacatgtggggaatacttgttctaacaaaagcttaataacattagtggcaatgatccttttatataagggaaagcttcaagccagtgagaaaaacataaataaactagtaagaacatatttataaccatgagatttgggtgcagaataaaatcaaattggcagttcaggaaaggtcctaaacatctgtatattaacaatattccatcagtgagcaatgtgaatttcccataattgaaatgatgattgataaccttgtattgttcttatctaatataaggcaaagcagcactggggctttgataaagagcaatatctcatgtacactgaggacactgaaaccccgctaggaattctatggaatttctaaaatatttatattaaggacattttacccattatagactaatttagggaaggttctgcattttttttttgatttgacaatgtttccaatgcaatttatacaatattaaataagactaattagtttttgcacctttcttgttacaaggtgaaagaactaatcctttgagattttccagaaggtccctggcaaatcccaaagccagttttaggtataaaatatatttaagttttgattgtgggaaggcaaatgttaagagttgtcaggagttctcgaacatttgattgaatagcattatgggttagcgagaaatactacttggttagctagtgaatcagagttgtaaaaattttcaagtaaacatatgaggtaacatggttgtaaagaatcttcagttcctttaaaattgaaaagactttaaaaaaataactaaggacataataaactgaacatacagatagggcattacagtattttgataagacataaaatctttgcctcttaggcagatgactcagaagaaaaacagaccatttataactttttattagggacagaccaatgatcaagaattttttttttttttttttgagatggagtcttgctctgttgcccaggctggagtgcagtcgcgcgatcaccatgttggccaggctggtctcgaactcctgacctcaggtgaactgcccacctcagcctcccaaagtgctgggattacaggcgtgagccactgcacctagcctaagaaaattttgttattttaacagagaaaccaacattttaattttatacaagtataatatttgatattagttcttttttgaaaatcttataaatacactgaataaaagttttaaccatgacaaataaaattccttttctgtgaacattttctaattttaaagatatttgtttacattttgtctcacacatttttaaattatttgtcattttaatttgggacaaagctattctctttttccttaggaaaagcatatttgcatacaaagttgtttccctttgccatttttgccattattacttttagcagtttatatatatatatacacacacacttatttacttattataattttaaccattaataacttctctttcacagagaaaacaggaggtaggtaattttgaaatatcatataccagcattttgtagcagactagtaaagcttatgaatatacatctcataactttttatagttgttatatactttttatagtaccattttgcaatgtggacaaatgaacacatttaacagatccatatgtagtcacactgtaccataaaaaaagcaaaaagtatataaacttaaatttaggtctagtgactaagtattttatcttctttataaatgatatttaatgaatttagttaacttaattcagcataagtctaaggttttaagttaccaaaaagattttagaaactgcctttaagcttacatattataaaacataattactgttgaaataaagtttgccagaataatgactcagtttggttaaaagcaaatttaaatttttataatcttaaacatgtagtagatataatactagcttattcaacatgtaaacctgtttaagtttaggaggaacatacccaagtagagtaaaaatatatgcttgtattctgttgtattatatgtaatgctgataactcaaagacacataggtgtctattaaactaacaatattaaactagttttgtttgccaaaagtttacataaattctgtgaacttgagttttaaaagcatttgggttagtttttataagaatacttttttgttgtttacactgaaagtattagaagttgtttccttaatttatgagagctttataataatttatataagtacttatttatctctaagtcaattagaatagaggataagggattttgtaaattaatttggtaatgccatctggaggtactgaactattacacatatacaacatacatgtatactaaacatacagacagacacaaatagagatctaatggcgagccctcaatgggtgcagggggcctgaagctctactggctataggcagttgagagggctgagtgggaaggggaaagcctggtgaagagtagataggggtatgtaggaggtagaggcattgaaggggacagatgaaaagattcagggagctgaagggaaggtccaaggtggtgaaaagaagggaagagggatgcggtaggaagatgagaagggggaatcttagatgagcaggtttggggagaccccaggttccctaataaggtcactgaagttccaaattacccttcgtgattactttttttttttttttttgccagttttggaaatactggacagaatgagtgccataggggcagggcatgtagtcagcaagggaggaggaggaggatgaggaggaggaagggcacccagtagattgagagttacctgtgggaagaggcagatcaaatagagaaaggagccaggctggacagtctcattaggaagttctgcacacagtcgtcatctgggagccaaagtttctcttcagtcctcattgaggagctgaagggctttccttgtgcaatctctagacaaggtgtcaagggaaacaatgaggcctcacaaaagagccaggaatttggagtaaatctccactcaaaaggaaccaagaaaacttctatccaggacgattctggctaaaattgaaaaggaccaggaagagtcctgctcaacagagtcaggggttaaatccccactcaaaaagagctaggaagagttctgtctgcgaagattcttgctcaaacagaaaagaactgggaagagctcatttaacagaatcaaagtaactgaatcacagaaccataaaaagtgtccaataaaagcaaataccgtctctgggcagggtgcaatggctcacacctgtaatcccagcacttgagaagctgagggaggaagatcacttgagcccaagggttcgagaccagcctgggtaacatagcgagactcctatatctataaaaattttaaaaattagccaggcatggtggtgtgtgcctatagtcccagctacctgggaggctgaagtagtggaggattgcttgagcccaggagttgaggctgcagtgaactattattgcaccactgcactccagcttgggtgacagagcgagaccctgtctcaaaaacaaaaaacaaatatggatttagatagagacttttattttattttattttattatttttgagacagagcctttctctgtcacccaggctggagtgtaggtgccatctcagctcactgcaaccaccacctcccgggtttaagcaattctcccgcctcagccttctgagtagctggaattacaggcgtgcgccaccatgcccagctaatttttcaatttttaatagagatggggtttcgccatgctggccaggctggtcttgaactcctgaccccaagtgattcacccgccttggcctctcaaagtgctgggattacaggtgtgagccaccgtgcccgaccaatactttatttaaaaagactattgcaatagggacaatgctgcaacctcaggacttgcaaacatcacaaaataatacaaaaaacatcacaaaataataaaaaaaaaaaagcctttttttttcagtagggagtagtaagcacagctagcagctcagctactttcaagggccagtgggcaagcaaaggggaacctgtttggcatgatttgaccagaaatgtgtttccctgtggtcagccggttctcaggagaagctgctaagtggggcatgttctgcattgcagcacttacttaaccaggagcaagcaaaattcaggccctgtggggaggacagaagcctgcctaacattctgtcaaggcaaaggagagggtaaaaagcagacagctgtgaacacttgatcatccttcaggcaataatccattctgggtttctggcttaagactcttgagaaacaaggggaaacaactggtaggagcagcaggctcacctatatgtagttccgtgaggtagccttatggacttctgccaccttccaaaactcagcatgtcccaaaccatctttatcaacacagcttctcaccaaaaacaaccaaataaaacaaattaactaatgtactaattctgtatctccccctgtgttgttcatctcaaaaaactgttatcacctcattgactcagactctcaaccagcgaggtagaagaaatgtttgggggcatgttaaatgtaacacctatgagacatgtaagaggtgaggtgcaggacgcaggtacatggtgataaaagaaaaacctcagccggattaaatttaaaggagtttcattgagcaatgaactatttgtgaatcgggcagcccccagaatcacagcagattcacagagactccagtgcagctacatggtggaagatttatagattaaaaaaaaggtggagggggggaaatgacgtacagaaattggaagtgaggtacagaacggctggattggttacaggttgggggtatgccttatttgaacacagtttgaacactcaccagtgtatgaatggttgaagtatggccgctgggattggccaagagttagctattgttacaggtacacactcctaagttaggttttcaattttgtctgcctctaggttacagtttattgacaaagactcaaatatagaactatggagtccttctcaggccgtatttaatttgctttaacaattccccctttttggtcattttctcaactttgagagattgacaaaaaccttagttattgatatcactattacccttgtaaatgtacttatatggtcttgaaacccactgggaaacaggaggacagtgggttttgtaaggagagaataaggactgagtagaaggtacctctttatgctagaatgttctgtttacaggacaaaaacaaaacctggtctgttttaataactatttgtttccttaaagtcttagtttgattatgttacatttagcatgagcaactccattttgtttggtttggtctgttgggtcctagtgcatgagctcagtacacaacaatggcttgccagaattttgtttaaaaaattccccttggctgggcgtggtggctcatgcctgtaatcccagcacttagggaggctgaggcgggcagatcacgagctcaggagatcgagaccatcatggccaacatggtgaaaccctgtctctactaaaaatacaaaaattagccgggcgcggtggcatgcgcctgtaatcccagctactcgggaggctgaggcaagagaatcacttgaacctggcagtcagaggttgcagtgagccaagatcacgccactgcactccagcctggtgacagagcgagactccacctaaaaaaaaaaaaaaaaaatatttccccttattggccaggttctcacttaggtgagagtgtgaccaaaacttagggccttagcaccacttttagttacctagttaccatcattttaggtttccagtctcagcatgtcattcataggttatgatgtcctcataatcatacatttcaatcagttttgttattccagttgaagagagaccatttgacatttcagagatggctgcatgcaaacatttgaaacctttgagagaatacagtgcactggggagactactatgactaccagtaggataatacccagagtttgaagtatgctgtttacctgaggtccccataaaacaaactgcctaaattaaataaaataaagaatgagctagacgaagagtctactcacttcactaagtgatcttttcattaatcctgtatgactgaatttttataatctgcacttgatatacatattagaattttagaaaccccatataattttggaatatatattaatataattcactaaaaatataccctgaagattaaacattatttttattggccaagcgcggtggcttacacctgtaatcccagcactctcggaggccgaggcaggcggataacctgaggtcaggagttcaagagcagcctggccaacatggtgaaaccctgtctccactaaaaatagaaaaattagccaggcatggtggcatgcacctgtaatcccagctactcgggaggctaagactggagaatcgcctgaacccaggaggtggaggttgcagtgagcagagatcatgccattgcactccagcctgggcaacgagggcaaaactcagtctcaaaacaaaacaaaacagtatttttattttgacaatgcctcccatgatttttataccaaataagccaaatgtcactgttgcattagtgcattatcgatgtcaaacccaattcttaaataaaaccttatagacaaatgtattcaatcttaatcagtttgaacataaggtaagaattttataaaccttttataaccctttacaatttttgttgaagagcagattagtgctctaagaaaacctgttgtgcttttatgtccatgttcaatttatggaaaaacctaataatacccttttaaatttagtattatcatacataaaattttttacaaggttaattttttttttttttttgagacggagtcttgttctgtcgcctaggctgacagtggcatgatctcggctcactgcaacctctgtctccccagttcaagcagttctcctgcctcagcctctggagcagctgggactacaggcgtgtgccaccatgtctggctatttttttttttttgtatgttagtagagagggggtttcatcatgttggccaggctggtctcgaactcccaggtgctcaaaggaaaatttaagacagtccatggaggagaaaggtatagacaaggtcatgcagatattaaaccagaaaggacttatttcctaagccaggaatcgaacccagactgccactgtgaaagggcaaaaccttaactactgagcccagaaggagtctagagtagttaattttgagcttgcaaaggcttttaactagtcaagataatttttagaactaactatgatatgaaccctaaaattcctgttccctggaaggtagagacaaggagaaagtactgccacatggttacaaggtcaagctcccaaggacataaaacaggatggcgaccttgtccagttttttgttggtttcagggacctgcagcaaagtttgtcactgaccagcttgctgggccatcttgagcagcaagcttatgggggcccaagcccatgttttatcctaaggtacccctcgacacagaaaaacgactttatagcacaaaatataccagattgactacagcttaagactagacagcctcagaattcctttttgcattaattaaaattttacagaggagataaacagtgattttacaatcagtttgcacagagagagagaagcctgaaatctgactgggaagagatatttacccttttgctggcatgccaggcttctgggctccctttccctgagtggccctggtgatctggctctctgcaccattgccccgggagccaagccacaacacaaaagaatttttttttaaaatgcacttcagtgtgttgttgttcatttggaatgttccactgtaagttatctttcgtaagatgtcaccatttctgtaagaatttgctgcctcccgggcgtaatgtgtaacccagaaggaactcagttttccagaagcaattaataggttccatggaatgttgatggtaagaaaggaaggaaaaggtgacaagagtgagcgtagacagctctttctaaggagtttggctgctggaaggggaagagaagcagctggggttaggtgggaggaactaagtttagagacgctaaaagtgtatgtagcaggagtcacctgatcaggttgaactgcagcaggaacaaggaagttccattttgactactattagttgcaaattggacccttatgtcaactttttcatctgtaaaaaaaaagggatggccaggcacggtggctcacgcctgtaatcccagcagtttgagaggccgaggcgggcggattgcctgagttcaggagttcacaaccagcctggccaacaaggtgaagccccgtctctactaaaatacaaagaattagccacgcgtggcagcgggcgcctgtagtcccagaatctctggaacccgggaggcggaggttgcagtgagtcgagatcacaccactgcactccagcctgggcgacagaccgaaactccgtctcaaaaaaaaaaaaaggggggcaggggatgaaaatgctattgctttccaggaatagctatgactacttccaataaagaagacaagaaggttccacatgtgaaaactacgcggtcacaacgataagtgggcgggtgcacgcacgcgcgctgagatcgtgcgtgcacaggccggggtgcggccggcgtgagtacgcctgcgcgtgccgccatttcctgcagccgcagactctgcctgcggtgctcgccgggaaatgagacgatcaacaaagaaaatggttgttttgggcgagatcgaccgtggagaggctttttctgcagcagtcccggttcctgccgccagatggcgctcgaggatcacaaatgggtctagggttctcataatggccccgcctaagaaattttggattctcctggcccttcccccctttgtggggtcaacagcggatttgggaatctggtgaccaacacgtgcgcactcccctacccttgcccctaccgagccctccagggtagcttgggggagaagctcctccctagactgccgggtatttgatgagcctggccagcgcacaggtcttgagcaccatggtcagggaagaaggctgaatggcttaggtcttcctagagaggccggaggcgggaaagaactggagaaaggagagatggcagtgggaggatggggacaagaataccagtgtgtttccagccagaagacgatgtcttttaacacctcattgaagtcgtcaggtgactttgcccttgtcagaaaggagcagcactgcgggggtcctactgaggaggagactgactgctccttggggtggggattgtgcctccttcctgtctgccccactcttggggagatgagtccctccaagtccacgagacatgacagccagcctacctgccatgggagaacaaagtctagtctcagggcactcacttcataagggtcttattcttcctcagcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctgagcaattcgtcagacgagagagctgcaccagcaggtacgagccaaactgcactgggaccttacctgctagagccagtgtttttgtccagggcagcaacccaggacaaacccccacacactaggcatgcctgtttatcctctgcaggtgagtgtggttaggagccagagggaaggagagaaaccagcatctcaggggtagatattcatgggtttcagcttggagccatagcatcaaatctgttagactaagtctggcacagaaaggatgcacagagaaccaggttgtctggcagccagttcgaacctggaaacctgggtcaggggagggatataggttgctttttctgttaatggagatggaaactctctgagcaaggtgtgccatggtgtggatgtgattcactgccagaaataacaactgtaccagttggatgagctcttccactgccatcagcactgggatggccatggatttggacagtaatgtagctccacagtgctgactcagggttgctcattgattgcaagaagttggcagcagtagcctgaggaaacaggggctctgaattttctgagagagaccaagaaccaaggaacagccaggtactagggaacagacaacaccagatgcttgtgcttttctgtgagcagctcaggtctcccaaagtggtagtttcctggcttctggcctttgtagatcagtgtggatccacacccaattgtgatgtttgtggtagctgtaagaactttcccaattttgaaatcctaggtgacttgtagcatattttttcacatttgaaaataattgagttttgaaaatgtttttacaggcaatctagtatcagattttatatcatcctgaaacattctgtcaattgtcatttccaaaaatccatggaaaactggagttgttgaactggaaacagtgtggtctcaggaagtgcttcacagccattgcaacatgggcagggcctagagggcaggagagaatgccatgatttgatgacattttacccattcctgccaggtgaacttcatctccctctctgtgacagaattttctggctctcacatccagctttggtcactgggaacccacctattggctcttgcactggcaggacatgtggtagaggcttccagttcgaggcaggactggctgcattttcaagatgtccttatttctggtattttgtggcgatcgtcctgtccacttaactgattttgacccattgccttgctgtgatctctgtgctctctctgtctcccagttccaggtcattcccttgaccagcttccagtctttcctcatcttgtccctgccaatgaagtattctggctctgccttcactctcctgccatgatccattgctttgatagggtggcttcaggaacagggtgaggagagggctgtgctagctttatcttgccaaggaactcagcaaagaaaatttttgctgacctcttgcattcctcagcctggctctggtctctcaaacctaacacatgggatgcatgccagcagccagcctcagtttccctctggtccttttctgtgtgaggccagaggtccttgctttatcactgcctggagctgcagttgatgatggtgaaagaaggtgcacgtgtcttttgagagctccctttgttccccagagatttttttttcccaaagtggccatgagtttgggaataaccaggagccatgggccgccggctagagatgctgcatactaagagcctcctgtgagcagccatgtacacagtgaacacgatggctaaggccccatccagccgccctcaaagagcacatagtccactaaggaataagcatgatcgtaataaccattagcacctgctgtgtgctgagaatgtgcaggcactgttctgcatgccttatgtggactcactcatttaattctcacaccaactcaaggaggtgcttttattatggagaaactgaggcagatggaggttaagtaatttgctggcagttttgcagccaggaagtggcctaaccgagattagaatccagacagagatcagagcctgtactgttcatcgctgtggcatccatactgcccctccatttgtgataagcccaggaaggaaagaaaccaggtgctctgatggagaggggttagagcaaggatggttagggaaagcttttctatcgaggaggagacagttcggctgagacctgaaacatctggaggagcctgccttccaaagaacctggggagaggcattgtggacaaagaagatagggaggagggcctgaacaatgagccctgtgcttggagggtacggggtgaggtgagcagggggcaggagctgggccctgtagggtcttgtaggtgagggagaggaggctattgggagggctcctattgctcacattgcagtcctggggggatgcccagggcattttttcttttttttaagaggcggtgtttcactgtgttacccaggttgtttttgaattcctggcctcaagtgatcttcctgcctcagcttcccaagtagctccagggaatttctgttttaccttgcctcttcagttgcgccgtccccttcagtattctgctgacatggatcacaggataccagacacctggtagttgttcagtcagtaggaggtcttccttccttcctcttagaatcaatccttttctcacttgttggctctgcattttatcccccgtgtatcttttcagatttttgtggggcctcctctcccatccagtccaccttctccagtctctatggtatatttctttgtcatagggtgaagcaggaacaggtacaggatgattgggtacactgaggtgaggtaggagggcaggccctcaggaagggcttcccagaggaggtgatattgtctgcaaaggcatatgagagcctggaagtccaggggaactgcaggctggtctgtacggcttgagtggcacgtgatacagtttgagactatgaggcgagagagctaggcagatgctagaccatgattgttcttccctttccccactcttcaactagttgtaatcttaggcattggattctctggcaaggggacaatacccagtagcctgggccagatggaggcagccatatctggagtatgatctgagccacagcatgttggagaaaagccagaatcagcccagggcagtgtgcacccatagtgctggcctcaggcctttggagggtgagcagacttaagttggaaggtgcaaacaagtggtcagtggtgctgcccaacatcgtgccctgaactgcagttgacagctacggcagctttggtaatgaggctcatagcctgggggcaggcagagtgagagccgatattggcttggccagagaaaagcccttttgggctgccgaggaggttggattccaggccaagggccatatctggcagctgaagtgtggaggttcagaaaaacttcgacaccggtcagtttcccgcctctgctgggaatgaggtgcatctgactttcctcctcaatgatgcctaatttcatttggtcctctgccccttggccttgtgttctctagagagttccctgcagggtggcagaaggagctgatcctagtaagggaccgtcccatccagtgaggaggtgagctgggctgtgtcttccccttctgcaccctcctgactgtcacatccccgggagccccatgattccactctaactgagtgaatcacagaggccaaggcccttggctgcagtcaggagtactgagtggacactggaagattggggtcttgctactgactcacgatgtgacctgggacatgtctcaactcacctagcctgggtttgcttatctgtaaagtgagaagttccatttgttggtcttggaggaagcttcaagagcagtgctcaagggttaggctcagaaaagcctgtttgaccctggaaggtgtcagctcccaggttgacgtgcccacccctccctttatttctttcagggtgaggagcccctcgagctgcatggtcactgttactgtcactgccacatctgagcagcctcacatttatattccagcccccgcaagtgaattggactccagctctaccacgtaagaagggctatctagcaacctgggagatgttcctccgccacttcctccttggcggtaaaggacttggcttttgttccatgttgcttcccatttagtgccttccccagtttctagcaggccattagccaaggggccacacaggacagtgttagtcccctaatataaactcccatctaccgggcctagacattcccacacctcctttttcctatctctgtaagaggctgcagtggtacttcctagtgcactagtggatgtggctctgccattcatgggtccatgcctgggaagccagctccagtccgtgaaggccgggcctgtgagggcattcctgtgttactgtaaaggaatacctgaggctgggacatttataaaggaaagaggtttaattggctcacagtttggcaggctgcacaagcatggcaccagcagctgcttggcttctggcaaaggcctcgggaagcttataatcatggtggaagccgaagtgggagcaggaccatcacatggcacgagcaggaacaagagtgaggaaggggagggcccggactttgaaacaaccagatcttgtgtgaactaactgaatgagaactcacttttcactaaggggatggtgctagctgttcatgagggatccccccatgatcccgtcacctccctccaagccccacctccaacactgggaatcacatttcaacatgaggtttgtctgtctctgtcacatgcccactgcttcacctgcattcctggccacctgtcagggtgcaggaagggatgtcactgcaggaaggctgctcagtgaggtgtgtgtgttgggggcgggaggggggcatatccaagggggcctctgcagacatcaggtcagcaggctggagtgtgcagcatggaaatgggggaaaatttggggccatcctgagcccagcatgatgcagaccttgtttccagtcctgcagaggccagtccaggatgaggcaacctctaggcctctggactctaggagtgagaatggagaggttagatgtgaggtggagattgcacagtagctgagtaccttctgggaagtgctgagtggtaaagactgacagtgtaggattaaggcttggaggatatcttggttgtgggtagaggggaaagacgacgcagccctaaagtaggggtggaaagcccacaggactgaagtgtagaagtatagaagcctggggagaagatggggtcaccgaggtctgcatggaggaggacagcacattgtcattggttgcaggaagcccctttctggggccctcagtccaaacacaacaagagacgctcatggcctgggattgtagtctgagtccacagcagtgccagtgcctttatcctgggccttcccatgagctctttcacttccttcaaaccaggctgggtctccccagccctgaaccactcctgtgggccaggcctggttccctggaatcttctggtgtacctctgatttcttctgtgctccttctacagcaaagggattctcttcgtgaaggagtacgtgaatgctagtgaagtgtcttctgggaagccagtatctgcacgctatagcaagtaagagcgggtcccaaacccttccatgtcggccttctcctgccggctcccatattctcatccctgcatttccagttccttgtccaggacttggctcagagtagcttcggggtaattgtcgagtggatgagtgatgtagttgccctctgatgggattgatgcattttctactgaactgggcacctttgggttctcccttccggtgaattcatcctgcacaccattttcactgccattctgttctgcttgtctttgttattttattttgtaaaatgctgagaacacccctcttgacagagctggcagagccctagggaccaactagctcatcctatttcttttcagatcacagagctcttctcttctgccctcatgttcttttctgtcatgccaggctgcctcatttgaacacacatgtgactgcagttcctgatacatgtgtggctttgctttttaattttaattaattagttaattaattttaattaatttttttttgagatggagtcttgctctgttgcccaggctggagtgcagtggcgccatctcagctcaccacaacctctgcctcctgggttcaggcaattctcctgccttagcctccctagtagctgggattacaggcgcccaccaccatgcccagctagtttttgtattttagtagagatgaagtttcaccatgttggccaggctggtctcgaattcctgacctcaagcaatccacctgcctcggcctccccttttcattgatcatctcttcattttcttgctttgtgatgccatgtggaggggtacttccatgtcacctcggtgtattgctacctaccacactgaggtgaggtcccttagaatgtttcttatgacatgtcatctcactggaggattttagcaacagagaggagcatcctggccttatttcaggattgggcctctggggcttctggactggcttttattggtgctgtggaatgatgagcatggctgtgggggtcaagttcaagccccagctcaggcccccctgttaggatcacttcggacaagatgttcaacctctctgagctttgctttcacatctgtaggcccttagggtggtttttctcaacagcttattgagttataattcaccctttaaagtgtacagtcccgaggttttggtacattcacagagttatgcaaacatcattatccaattctggaacacctttgtctccccaaaaagaaactccaaacccgtctgcaccccctaattctaccccataactcaagcacaggtattataccagaatgatcccttctttcttctcattcccagtatctgatttctgctgagtgggctcctggtgactgtcacattatatcataggtggggaggaaagctctgctgttttcccactggtcagtggggtccccttggcatatacaacctcaggaatcctagccacccagccccgatcatctccctcattgtgaaaggtctcctttgcccccccatagaagggccctgtggcaccaagtcatgaatgacgactggcatcgtagttatgtctcagcttgtggccaaaggttaattagaaaattaactatgatagtgatttggctctcatctctgccctcctctcccctatcaaactccctgcagcgtcagcagcattgaggactcattcgccatggagaagaagcctccatgtggcagcactccatactctgagaggtatgttgactttcttagcacggagcttgcacttctacagaggagaatcagggaagggagagttcctgctgagtctgtttgcttttgtcttctgctttgcagcctccaatccatttgcagaaaggtgaaggacactaccgtagggtggtgcttcccttgttgggatatcacacttgtgacaactaaagcctttgaattgagctaagactagagggtagataccagcggtgactgagaagggaagtggtggcatctgacaacccagaggactcgtgtcagcaggaggggcccttcagattagaacctaatcaatcacttcattaacttgcaaatctaaccagaagtaaaaataaaatgactacaaaagagaggagtgggcagagaaggaagaaaaatgggctgctggcatcaagaagccagaaagacacacaaagccaagaatgcccagtgctgtggagccaccaaattgaaagcaggggcagagaacacctcgttcagcagttttgaaagctgtcactagatgatggcacagtcactagagagtcttaatgacaaagaaatcttatgttcagattcttggaatggggagaagagagtctcagagattgagttcactcaggcttctgtgaagaaaatggaataaatagccttcagtccacagtaagcaaatacggcagacccaggactaaaccccagggccctgactactcccaggttagggatgtttctactctgccatcttgcttctcattgatgggcagatcttaattcatgtggatgacattcagagaccaaagctacattggggaggaaaaggaaggaagtaagagggttaagataaagagaatcctaccgggccccagaggcaaacatataggagcagacaagcatatggggccagggaatctcctccactatagctgaagaagcaggtggttctgagtaactacagattacttggtgaggcacatcagcagatgaagtcttagcagagaagggcaggttggtcagaaacctgagagttaaccacttacataggagcaaatggaatgaggcttccaattctagtggagtgacaaaccagatactctagggacccccctttccattgcacaactactaaatccagaatcagtcattactgatccattgctaggcttggaggaaggaaggggactctctagggacaatctcagtcacttgcacacatgcatatgcacagacacacatgcacgcacacaaagaacagctgtgagctggtgctgctggtggtgaaagaagcaggaggagcagggctgcgctgagggcaaggatttcaagcagcactgctgtccagagtgaaccctgggccagcagcaggatggtgggccacacccaagctgcccgtgacacttctgggtcctccgacagagctaacgtggatctagattgttaatgtccccccgccccttgggcttctgtcagaagcagacccaaatctctggaagaaagtaccctgaattttggcttgtaggatcagatcaagcagttactttgaggaagtgcagtctgaggaagaaaagcagaggtgactctcagaaacaggcatcctggaactggaaagatgctcaacccaggagtcagtatctagaacttcagtgtcggatctgagtaggctctacagacagagcatgaagggtgggtccaggagtataggcaggggcagagctcagttggcccaggcgtgaggagaagggccatcaagacggggccaggcagggcacacaatgacatgtctcctgtaggagaaggcattggtcttcctgctctagagggtagcaggccccagcggataatctaagcagaaggtcagggggaggcaaactgtctggaataagtatcatatcaggacatctacaggagacatgtcattgtgagctggaaaaagatgcatgactagtttttggaaataatgcagaggtctacagcaggctgagaactgatctggcccagggctgtgctgcacaccacagaaaacagtggcatcctggggatcctgacagcaaacctgggcctggctgcaccaaattggaaggtctggctgtgtcacatcagaggtctgtacaccagcctgaccaccgggttattgttcttcatctcacaggacaactggagggatctgtacttactgcaaccgtgagatccgagactgtccaaagattaccctagaacatcttggtatctgctgccatgaatattgctttaaggtaaaaaagaggtggaagacaccttgagctaggcggtaactcctgatcacgtgctgctaagaacgttttgtagagtgcgggagtcttacgggttcagagactgtggaggaggcttgatctccatatacaattgcacatagtcgcagaggctttgcacaactgggagctgaatgagcttccaagtctaagacagtagatgagtgttggtggttctgcatgcttagtactgtagggaagacaaaagaggtcttttcaggaaagactatttctggcagagggccagcaagtgcaaaagccctggggcagaagcactagagtgttctagcttgcgtgggagaatgccaggagtgacagagtgggctagatcatgtaggccttggcgggcacagagtttggattttattctaagtgacattggggtccccattctccacagtgtgtggcactttgtaaccccaggttgttggttccaatccatttagggtgtcacctctgggtgcactgagaaaaacaaccctcccctttgccttgacagaatgttaggcaggcttctgtcctccccacagggcctgaactttgcttgctcctggttaagtaagtgctgcaatgcagaacatgccccacttagcagcttctcctgagaaccggctgaccacagggaaacacatttctggtcaaatcatgccaaacaggttcccctttgcttgcccactggcccttgaaagtagctgagctgctagctgtgcttactactccctactgaaaaaaaaggcttttttttgtattattttgtgatgttttttgtattattttgtgatgtttgcaagtcctgaggtccaggatgtgccacgggctcacagcatctgctcgcccaccttgttcaggcatccccttcccactccactcattcctcttgctttgctttgtgtgttgacctccagcttgcttttcttttcagtgtgggatttgcagtaaaccgatgggcgatctcctggatcagatcttcattcaccgtgacaccattcactgtgggaaatgctatgagaagctcttctaggtgggtgctggcactgcaaaggacaagtggccaagagactcattaaggagtagagatgcaccctggtctctcctggagtctcagccccagacacagctatctttcttggctcttccttatgttcagggggccttgtgtcctcatgtccctatgccttgtgatactttgagatcttaggtggcatggacaaaggccctcaatgaggacacttccaaatcacaccttccgtccagcacctgagccgagccctctagctaccctgggatactcgctcggccgctgttgttagccccattttgcaacaaggaaataaagatatagaaagggaggggacctggagaaacccaggtagaatcaggacctcaccccaggtctttggattcttgtccagggctctctgttcactgtcactcgcatagcttcagatcaggactgcatagccatggtgctcagtgaaacaagcctctgggccacattatgagaactgcctgaagatgtgtgtttgcatgctcatagccagtggaatttatcacggtgtctgagcacagagcagaatatatcccttgaaggcagtagcaaccaggctttccactagctccatgctgatggtcttctctccagaagacacaccttgagctaggtggtaactcctgatgactggagcagtcacccaccctgagggcctctagctgatgtgtttccagtctcatggctacttctgttttcttttagcgaccccccaccgccaggctgatcagaagctgatgactcgtggacaaatttggctgtccccagttttgccccaagttgctgtctccccttccctcacctcctccctccctgtttgatttcttcatgcttttgcccttctcaagttgaagttgcatacatccaatatcgtatcttaatgatgctatgataattgcttgtgtgtgtagcttcttgtagcttagaaagcgctttatgcccatgatgtcatttcaggctcaaccaaagaggatcaaacaggaattccatcttggcttccctaagacagattggctttctaatgagtttaagtgggcagaagtgtagggttcagtgtgtcctgactcccttgaggcttataatgggccaagttgaagactgttgatgatccctggtgggtaaattgcagacatcaaatgctagggattggcataggctagtgtttagcttgtctatttgccatatctattttttttaaatttccatacacttgtaaaagtagttagttgcttttgattgagttatatagcagtttttcatttggtcttccactcacctttcactatatttgagtgttcccttacaggtatgttggcatgtgttggaaaatttacacaattaggtttaaattcagtaggatgtgattttaggatgctactgatcaaagtgatatctgtgtctgttggaatcttgatagctgattaatttgccctcaattctgctccctgaacttcacacataaatcttcccaagtgggttttagggtgtatagatcccagcaggattaaggaggtggaaaagcagctaacatttcttgaggctctaccacatagcaggcactgtcacagagtaatggcattaatccccataataatcctgtgaaggtgatattctcatcccatcttagacatgaggatattggaactcagagaggtggctattgcattgcgcagaacgctacagagcccatgctcttcccagagcagcacccacaaaagcaagcattgattttgtgctcagtgtgtgccaagcactgtgcagagggtacacagttcctgccaggttaacaccctcccttcaggcctcccaaaggcataggcttgcaaagagcagaaggtgtgaaatcacactcttcctctgggcatcctggatccctgaattatccccccccccatgaagtacttcaagggccaagctgcccctttccctcctctccgcccatgaaaatgcctccaaactgagatgctttcagctgagaacagatttgactcacagacattaccaaagaggagcttgtgaatccaggaaaagctccagggggctagctgatctgagcagagagctttcagtgacccattttcctgtctagactctgccttaagctagtggcaactgctggggccccaggtacttgggacatggaaactcgttggatggctgggcagatgtaagcctgtccatgcagtcagccgatcctctgctcaggttcagctggactctgccatctgtgggcccagcatcactctgtaagttccttgaaaggaagaacaaccttagagtatttctgatacaaaatgagggcctctgctcttgatttaattataaaatgtctacgtctttctccagtttctgagccctatgcacattggcttgtgggcttgttcttcctgccaaatgatcagagaggaacattccatttatttgtagtggatttcctctggagggcatgtacccacactaaataccaactgctcttcctcagctgtagtccccaacatcagacttggcacgtggtggacactaacacacaggcactcaatgaatgagtgaaggaaataaaagtcaccccgttggtgagaggtgctatccctgagtctcagtgcaggaccagtggatgaaaggcaaggtaaagaggcccaagataggctggcttcccccgttcaaggtatagtctgcctttaagggagttttagaaccaacatgcaagacattgaaagaaatcttgcaagagccattattgacttagatccaaaacagcctctctcatgtctaaaaaggcacagaattttgcagatctgaggaagagggatgcattacctttttgcttcttttcaattgcttagtgtttctaatcatacttaatccacactaatgtgcgcaattataataaatggtaagatatcacatgtgtca

SEQ ID NO: 2402 - DNA, 59041 bp, Homo sapiens; identical to SEQ ID NO: 2401

SEQ ID NO: 2403 - DNA, 55618 bp, Homo sapiens
tgttccctgaagctcggtggggtttgcctacacagctgctctgagtggcgcagttccgggtgtctgtcagggccaaaagcaaagaggaaaggctcccaggcagctcctggtccacctctcatgtgtccactgggctgtgtggccaaatctggaggcaggagggagcctgcaggtagacacatggaaccttctcctctctagtgctgccagtctggtgagaacagctaacgctggtcctccccgcccctcctcctctggctacaagatgaccactgaggattacaagaagctgtgagtatgcaacgccaggctcagcgtggttccctcctccaaggaacaagtccaaactctgggtccactgaaggcagctgactacttgccaccgagcacagcccgggaagtcccgcctgcctgacactccctgccagttgcagctgtggcctggagcccaccagagggtaacaagccccagaaaactggatggctgtgcacattgcacgtctgatccgaggcagagcggagaccgcaggaagcttgtaggaggggccccacggatctggggaaagggtcatgggtcgtgaggctgctgctggctggctgtgcttcctgggcttggccctgcacccggccgagcctcaggtgctctgcctggctgcactgggctgggggcctggggatcctcagggtgctgctgtcagtctgagcattgtgtgcctaaatctgagctgcttcttggatagaaaccttcgggttttcccttagtgctccccttggggtccctttcaaagccccccaccccccactgcatgctcagggaggagggttctctggacagaggtgtgaattgtgtctctagttcccaggggaccacatctttccgttgtttgtcccttgcctccatcatccagggttggggagctgctgggtaacctttctggggaaggggagaggctcgaacagggagggaggggagagctggtctcagggaggaacaagtggcatgacctaaggcccaaaggcagagatattgacttgcctcgtcattgttgttgaaagccaggaagccaagctgctgagggtggcagcctatgacaggaaagcgcctctcccctctcttagggcaccctacaatatcaggcgcagctctacatcaggggacaccgaggaggaggaggaggaggaggtggtgccattctcctcagatgaacagaaacggaggtaatggaatggtgccttttgggcatcccggggggcagggcaggagcctgagtcttcgaagactgctggaatgaattgtactggttggggtgacaaaatgcacaacacgtaggccatcagcggtagcccacggagcatgagaataggtgtcattctctgagtgccagaaccacccactcagtgttggaccagctgaggggcccttgagaaccttctgtggggtagaacctaggtaatgtgggtccggggaaaagcctcctcatgtggaggctcttcagggctctaaatcggtttgttagaaagggccctgagacagttgaacaaaaatattcagggagaagccacctgcacagtgccctctatctgcatgatctgcatgccttgggggttctgaatgccccggaccccaaactgagctccaggcatgcacagcagtgggagtgtgccccatgctgctgaaattctaccctagtctctgcgccaagctgccctcgtccacacaggccagcaaagttccatggacccttgcccctcctcagtcctctgtccatggggactgaccacataccacccagtgctggtgaactatgacaggaagggtttgttaagcaccttttgtatgcctttggcttggggcctgtacagcagttgggccctgaggaaataaagccctcccctccctgggctcagccagccaccaggtccatatctgctgacccatctgtggcgcaggaatcacagcaaagccccattgccaaaggccctggcagattggctatcctcagggaacagttcacagtggcaggggcccccaggcctgggtggagcaaggaaaagagccagaagctaggagctgcctagcattgaatgccagctctgccacctgctaggtgagtgctcttgggcaaataatgaaagcttcttggactcagtttcctcatctgtaaatcacagaggatactagcgtctactttcctggattgagaagagcaataagccaatgcgaggatgttggcatctggcgcagagccgggcacatgccacatgctccataaacatgggctgcccttccttcaggttctacatttcctttgaatagtccttggagcaggtgcaaatctggtttctctcaccccttgcctccctggggtggccctaagtcaccccgagtccatcccaggctaggctggcagagcatgtccagcttggcacccatcagatgctcccccatcccgtgtcaccccaggtcagaggctgcaagcggtgttctgaggaggacagctccccgggagcactcctacgtcctgtcagcggccaagaagagcactgggtgagttgccaccaactggctccaggctctaggacagctctcctctcctcagagctccagccttctctggctgatgaaagggtgggtggagagatcacccccaagggccttcctagctgagccttctcagattctcagatgtactttctagaaaatggagaggtctggcggctaccaccagggacagtgaagtgccgggaatggagagggcccaggaccctctgaggtagagcggtcttgatgtcacctgcccacgggctctgcccaaagcattgcctttctgcttcctttccagcagtcctacccaggagacacaggcaccgtttatcgcgaagaggtaagtgtcatcaagggacaccttggaggcctgttactggccacaggaaggccttccgtcagcaggggtgtagtgtgggagctgtggagaggggatgtggatgtgggggactactgtccctgagcagggggagttgtgaggggctgggggcttctgtctggaggcctggcaagcacctgggtggctgtggtagcatatgtggtcaagctcttccatttgccaatggctaatggggctgggcccctgacccaacgtggagcatttccaaggccctctgggagttgttcccctgcccctgttgcttgcctgatgccttgccttctgctctcatccaggatcaaaacctgggccatcaggagaacttcccctgggaggtgactgtgacattggagatgggccctaaagggtgaacagggcttaacagggaatgatcagaacgtcgggatactccagctgaatgagggaggggtgtcaccattagttgagacagggcaccttctggaggaggaaaatattcgggggaaagcaagaaagaaacttctggaaacttgaatttgagggacttccagttgagtggacagggaaggcctctctctgtgctgaggtggctagctggggactgcaaacccaagagaagacagcatgccaactgccccaggcagagggccccagtgcacaggcccggggtgggactagcttgctgtgttggaagaccaggaagttggcaggaatacagagagcagggatggtggcagcacaaaggaagtgacagagaacggggggcggtgggggggtcttcctggctgcatttggttcctgtggtttctgtaacgcagtaccaaaaactgagtggcttaaaacatcagaaagggattctctcccggttctggagaccagaagtctagatcaaggtgttagcagggtgggttccttctggaggctttgagggagaaaccatcccaggccactctcctggcttctgctggtggttggtgatccttggtgttcctcggcttgtacctgcatcactccagtctgtgcgtctgtcttcacatggccttctcttctctgtgtgtctgtgtccagatttccctcttcttacaaggacagcggtcattggatttaggacccatcctactccagtatgacctcatcttacctgattacatctgcaaagaccctatttccaaataaggttacagtcacaggttccaggggacatgaattttggggggacactattcaacccagtatgctgtccttatcctgagctggagtcactgaacccccagcctgggccacctcttggccgtgatcctgaagggttgggtcagttagacgccactggaagcatgttctttgaggcctccaagctctagggcagccaagaagaccacgagcgctgtttctcttcttgctcaaagggtggaggtggtggaagaggacgggccttctgagaagagccaggacccacctgctctggcaagatccactcctggctcaaacaggtaatccattgcgctcatctctgcctggggctggtggctgccatacctgccactcagtcactgaggaacctcagtcagggcacctccatgctgggcttcgagatcagtgtccccatgtgcccagtgacaagacgggacaaagaaatcagtaagagcccatctggctggatgtcccagggctgaaaggagcaaaacagtccagccccccgggagagagcacctggctctggtctgatgagtacgtatctgtgtcaccttaacccttgcaccactgagcctggtggcaacttgaacaccccaagaaaaagtaccatccttggggtttgagagggccagccaccatggcagtagcatgccattgtcagacttgctccttgcactccaataagttagccacattcagcatgcccagggaggaggctctgacatctccagagcctctcacagccaccttctttgccagtgcggatggaggcaggaccaaagcgtctcgggcaatttggatcgagtgcctgccaagtatgcctagccccgctgggagccaggagctcaggtgggtgccgagagctgactctggcttgtgagtgggtgtgatggcttcccgccagcctggctggctggttctgccagctggggagggtctggcagtggggtgatggggcaaggacaggctgagcactggtgatctcactccaggaagggccgtgatttgtcttgatttctgatccctgagaatctgggcagataatggtgctctcttgtctgtggacaactaataccttcttgtactttgtgcagaatggtgctaagtcctgcagggagagccaccacctgctgttgctgctgtttaaagtgcctgcctggattgagacctttgctcaaatctaggtctcctaagagctgcatctctgtagcacccttggaagacccctgcatccagaaggggagagggcctgtccctaccggtcacttcccaggcccccaagggctgttcaggctctcctaataccatagcaatcccccaatttgagctccacagccatttatagacaggtgaccactgtcctcagggttacttcctcagtctgggagggagacagaaatgctggcagagggagccaggagcatgaggccagctccctccatggccccaggcagcagactgccagggtgcttctccttttcactctctccctctcttgatcttctctggttgtctgactctccccataagaactttggtccatagaagatgtggaaaggaagatttgagaattctttacaaggcaatatctagggcagagctccccagtctttttggcaccagggattggtttcgtgaaagacactttttccacgggacggagcaggggatggtttcaggatgaaactgttccaccttagatcatcaagcaccggattctcataaggagcgcacaatctagatctctcacatgtgcagttcacaatacggttcgcgctctcatgagaatctgctgatctgacaggaggcggagctaaggcagtaatgatctctagcttacctcctactgtgcagcctgattcccagcagaccacagactggtactgatcctcaggctggggttggggacccctgatctaggggacttggcaattgagggatatgggggcaaaggctgccacaacaaagtattgtaccacaccctggggcgcttaaaccacagaaacgtatcatctcccacttctggaggctagaagtgtgagatcaaggtgacggcaaggttggttcctcttgagtctctctccttggctggtagactccatcttctccctgggcccttatatgctcatccctgtctgtgtgtgcctgcgtcctaatcacttctgtttttttgagacagagtctcactccgtcgcccaggctggagtgcagtggcacagtcaccactcactgcagcctcgaccttccaggctcaagagagcctccagccttagcctcctgagtagctggggctacagtcacaggccaccatacccagctagttttttttttttaaatttttgtagagacagggtttcaccatgttgcccaggctggtctggaactctaggactcaaatgatcctcctgccttagcctcccaaagtgctgggattgcaggcatgagccaccgcgcccagaccctaatcacttcttataaggacattggtccaactggattagggcccaccctaacaactgtattttaacttagtcacttctttaaaggccccatctccaaatgcagtaacattctgaggtcatgggggagttaagacctcaacatatgaattttgggtggcacaagtcagcccataacagtatacagttctcatttctccttatttctcttttaaagaaaggcaataaatggtttcaggtgcctttctgtttgttcgtttgtttgttttgtttgtttttgagatggagtctcgctctgtcgcccaggctctgtcgagtacagtggtgtgatctcggctcaccgcagcctccgcctcccgggttcaagcgattcttctgcctcagcctcccgagtagctgggattacaggtgcacgcgaccacgcccggctaatttttgtatttttagtagagacgggtttcaccatattggccaggctggtctcaaactgctgaccttgtgatctgcccacctcaggctcccaaagtgctgggattacaggcgtgagccaccgcgcttggcctcaggtgccttttagaagataatataggaggctgggcatggtggctcatgcccgtaatcccagcactttgggaggccaaggcaggaggatggcttgaagccaggagtttgagaccaacctaggtaacatagcaagaccccatctctacaaaaaaataaaaaataaaaattaaaaattagttgggagcattgatgtacacctgtagtcccagctacttgggaggctgaggtgggaggactgcctgagcccaggagtttgaggctgcaatgagctgtgaccgcacccttacactctagcctgggtgacagagcaagaccctgtctctaaaacaagaaaaaaaagagagaaagaatggaggagaattagattgtgctgtattatagatttaaaaggcactttgacatttattccacaaaattcctttcgatgtttaatccccatcatatggttgtcattgcaaggtggctttttaagtttgctcaggttgccataacaaataaaggctagagattcagggtccggggcaagctcccaacaggaggctcagcttgatgcttctgatagttctttcctccaattctggtcactcaatatttggagctcacccaggcagcttccaggaaagctgctggctgatcctgaccctggagggccgtcttctctgaccctaccacgttaggtgctgcactggaccaagcagccaccatcagtactcccaggcccagctcctatctgcctggtgtctgagaagcccagcccgtgaggaacaatgactcaatcaaactcagggtcctgcagcacttcagaaaaggctggtttgtggcagagtggaagaggagaatgtcacagccttgtccccaggcacagacctatcgaggctaccctctccccaccccctgccctgccctgtttcccttagctacagtgcaaaggtcagctcctcataactcttgccccccttgcaacctgaacccagtttagggaccctctcttggagaaactggttctacacatgcaccccttctcggcccccaggcctggctgctttacccgaagcactggtcaagcttgcctcacctgaccagggcatggcctcctgggtcccggtcctaggctctgcccagcatgctgcctggcagagcgtctggggagcagggagtaggagcacagcttctggcacaggacaaaaccctggctttgcatcagactgactgtgtgaccttgagcaagtctcttcatctctccatgcatcagtttccccgtggataaaatagggagagcagtaatagctacttcccaaggctgtcccaaatgctaaatgagatcgtgcacctgaagtacttaccacagtgcctgggtgctggtatcctcgggggctcccagtcataggcgtgctgagctgcagggcccttattcaaatacaggaagagatcaatatctccacctgctggcatttgagggaaatgtggccaaaggcagtgaaaaggaggtatcccctcgccccacatccccgcctcctcgctctttggcagaatgagtcacacactgtttggcacaggccacagttggtcgcattcccacaggtggctgtgatcagttttgggcttcaggcttcagcagatgcctgcctctcttccttgggtgccttccaagggtgtgcagccttccagcgtggtcctggacttcagcttggactggagctgtctgtggttgagagtctggggagatggtagggtagcgggttgtgggggaggagagacccttgtattagtttactggagctgctgtaacaaggtaccagaaactgagtggcttaaaaccacacgcatttatcctctcacaattctggaggctggaagtctgagatcaaggtgtcggaagggccatgctccctccaaaggctctgggggaaaatctgttccatacctttctcttaccttttgttgcctgcaatccttggtgtttcctggcttgcgcccgcctcactcccatctcggcctctgtcttcgcgcagccgtcttccctctgtgtctgcccacattgccctagtctgacatcagtcactggagcaggctggggtgacactttgttcccatttcctctgtgacagagccagaaacgccagtgagaaaatatgttgtgcttgcctgtgacatccctgttccctggcaccacctgatttaaatgaggcagccaggggttttatactgtcatcataaatgacatcatcctcaacaacgatgtcatcgtcgttatcacgagaggagatggggagaagtcagagctgtctgtgtgtctagggcccctcctggctttcatgatgggagaggccttgtccttggtagcccttccatttccctctggtcactttgagcactccaggccctggccagggtggaagtggagggacagagatgagcagcccgctgacccagccctccatggctcattccttgctttcaccttggccactccatcccctacccctcctgggacccctgagtggcctctttaaagtgccagtctgaacctataaaccccccacctccacttcaagcccatcctgcatcttccctttgccataccagatctagtctgtacattcaggacccctgccagcctctacctcctcctcctcccccgatctcccttcagctggcctgggtcgggctatgcctccatgaagcttgtccactgctcccatggctaaacctgttctgggccctgcagcacagcaaggtcagtttccatgcctctctgcccctgcctgaccctgctgggcccagagcttcaccagggcaggcctggggctcaggcttgtctgcacttccagggcccagggacaaaggcaggagtgactgcaatgtggcttggaattaggctttgctccatggacctaaggaggtctggtttggggtgaagggtccacccccagaaagcctgggagctctatattctctctggccctggccacaccatggccaagcctgctgggcgtcatgccttgcagtacggccagagaatgcatcagacttggagggatgtgtgtccggggtggcctgtggtcatctgggggagggctctgagcgtggctggcaagaggaaagctcaaaggggccctttgtcctcatccccgagtctgcgacatcccctcccactggttttcattccatatttggtctgtgggttttctcagtctctcgtacccctcagtccccaccagtccatgaatgcagaactacccctggcctcacaaatggccactttggataccctggtggggtcacaggctgcggttgcccctgcaaatggttggtagaagcacgggttgggaggtttcatttctacccagaagggcccttgctgtgcctgagggagggctgggctcaggtcaggggtgggagaccggggaaggggcctacaggtcagtggcccgagctcagctgcagcaccaacaaggctcaaggccaaggaggagatgagagcacatcaaaagggggcagtgggtctgggcggcccaccgcactcaccagcccaagaagggggagacttttctcacctgcaacccactgggtctctcctttggcccgcagctcaagaggtgaggaaattgtccgcctgcagatcctgacacccagggcaggactccgcctggtggccccagacgtggaaggcatgaggtatgggggtcctgctgctgtcctggctccctggacaccattctagagatggaagcagcagcctcaggtggcaaatgatgaggcctagggccggctctgccactgtagggccaacaggttgatgggaggcatggtcgacctgggttttctgccccatctcattctttcactcagaaaaccattatggagcaagcgcttagtctgtgtaagggcacaggcccgaccctgggacacagtagtgaacaggaccccctggctggaattgccatctgcctggtgggggaggcagacgccgacatgagcatgaatgaggtcagccagagatgctgtgtgccaggagcccctgggaagtgacagctcaaccctgccaattgctgaagatgggaccagtcagccgtgctggggatgttggtgggggtgggaggaggattgggtctaaggagcccgtgaaggccactgaggccattgccctgcctgtgtgagagggccactgggaatagagtggggtcactgggtcagagtccacagctctccatgccactaggctctgtgctggggaggggtgggtcaaggaggccacaaccagcagggagcacgaggggctcagcctctgccctggggtgggggtcagacagccaggtgacatgcaggcaggattcgggggctggggtggaggctaggagagatccgagcagggagactgggcccctaccttgtgaaggccagggactggggagagaagcgggagtgtacactgaaggtcatcccttaatccctggggtggcaggaacttcgagcagaggcctctcaacagtgtggtgggtgggagtgcttggggagggcttcctggaggaattgacatccaagatgagtcctgagcgatctctaggtccctttaccctcctccttggctcctcccactttaattctgcccccaaggcaccaagtcctgtccactttattttagagatgtttccatccctattgctctgcccctggcccaggcctccactgctactcacccagttgtctgcgaccgtttcctactgtcccatccctggactcccttccacatctacctgggtgatgtttccaaagggcagaagtagttatgccagccccctgcagaaagccctgcaaagcccctcccactatgctctgcagcctgaactcagtacctggccccacctgcaggctcctccctccctgggcctttctctgtgcaggctggaggctctgcctgagatgccctttcccctcttcatctttctgttccacctcaaatgtcctgtcttctgggtcatgtccttctcctgagtttcttccccaggcagcatctgagggcttgtcgattctgcatggcagcatccattctgcatggatgtagatacaatcactatgcccattttacagattaagaaactgagaccctgaatggttaagtaacttgctcaaggtcacatggtccagagcaggcagatccgctcagcctgccctactcccaccttccaccttctgcaccatagctcattgtactagttggggcagggagcagggggacagagaggggtgatggaaagacttggcatttgctgagtgaactcatttgacgagtttattcgtaggcattgaagtcaaaatttccaggagggaggtattttaaggtttgtgattgaggtttgagagagtgattagggctcaagagatttccacgttatatgcagacagaatagagctgaaatcatgagcgtaaactagctttacatggggctcatggtgagccaatggaagctgggcaccgacctcagtatgcaggtggcagccacctggccagccctcctggggacagctgggcgagggcagtctcttctcgccatgttgagagtgggcctcctgagggccagttgggagttagtgggtgtgcaggccagtataaaggagaggcaggaacaagtggagatccctgcttcaagggtggcagttgacaccttgggaggggaggagacagcccagcaagtggtggagcacgccaaagggaggagaaaaaggcggagaccaggaaggtgtgtggccagggaggtaggcaggtggtgttgacaggatcaagggaggaggggtggtgagaaggctggagtggcccactgggtcagcagtactgaatggtggtttgaaataatgatgggactgtctctcctggatttgacaacatggggctccctgaggacctgaaggagaacagaagggggcttaaattaggagattaggatcagggatatagtccagaactcaaatcccagctactcctcttattacctgtgaaatttggggcaaatcacaggggctttgtgtgcctccgtttgctcatctgaaagatgggcatgggtgataacagtgcccatatcctggggttgatttgcagagttaatgcatataaagtcacgagaacaggctcaaatgctcaatcaacagtagctattgccaggcacagtggctcacacctgtaatcccagcacagtagctataaaacaacaacaacaaaaaacaaaaaacagtagctattagtaatgaagttttgataattggccaatctgtcaatcagcagggtttgtttgtttttggttctgttttttaagacagcatcttgctgtgtgtgcccaggctcaagtgcagtggtgccatcacagctcgctgcagcctcaaccttccaggttcaacctcccaagtagctgggaccacaggcacacaccaccactcctgactaactttcaaaaatatttttgtggagatggagtctagctgtgtttctcaggctggtcttgaactcctggctcaagtgatcctcttgcctcggcctctcaaaatgctgggttataggcgtgagccactgcacccggcccagtagcaggttttaagctccgtggagacagctggcgtttgaggatgaggtaacagcccacacctgagtgtgaatggctgctgcatggttaacttccatttctttcctccataggtcttccccaggcaacaaagacaaggaggccccctgctccagagagctccagagggacttggctggtgaggaggctttcagggcccccaacacagatgctgcaaggtaactcagtgcaggaagcagacacttcattcccagaacacggagcccacatacacccagctgaaggacttccatggcctccggtgcaatgtcaatggatgcagctggggccaggaaggtcctgttcccactgttcccccagtacctggggtactgcaggtctttaatgaacatctgttgaaagaaagaaagaatgaatgaatgaggcctggagggaggtaggcccctgccatgattcctcagggagccagttagagagcaggaccaaactccagggcaggctatccccagctcctggcctgtgctgagttccttccattcccctgaagcttccacactcactgtgcttttactgcaggacaaagcagccctgccaatggccagggcaaagcaaggccaccaagctggcagtctgggagagtcagtgaccaaagtatgtgggcccccatagagcatgtagcggagactttcaggatgacccgtggactaagggagacattgtggcaaggggtgaggggtccaggacgggaagttggagccatagcggtggatgatgagtccagatgggatgattgtccccagtcgctgcacagccagcccactgacctgtcctccaagccagaccagtgccaaatgtgtctggtgagcagtggctgcaggctgggcatttcttcagtgagaacctggtagccagttacagctaagaacccacacacccgtcttctcagtgtggatccctggagcccctagctggaaccctgagccctggaaatgaggaaaggaatccctctatggcttattaccagacccacatgtcttgccccttgctctgttggcaatcagctccccccaccaccaacgaactaacctcctcctgactttccaccttgctcccaaccaacccatcaggtttggaaaaaatacagaaatacttcctgttagagtcaacttgggcttggctcagctctggtcagagcagcacagagtagcagccaaaggcctgtgcttctggtcttgaggcccactctcatggcatctgggttagatgagatcaaaacgcaactagagtcagcaaatactccacttctcataacaggtcaagtgcacagttgagtgatggcaatgtgggatccggagccacgggctcccggcctgaaggcttggctgcagtagacatcggctccgagagaggaaggtgagctgcccgggggaggcaggttctctcatgcccctggtgacagaccagggtcaagctgccaggctgcttgggctgctatgggtggggcactggtcacttcctatggctcctgtctactgcttctcccacactcccacattccaccacatcctgtgtccttgggctttccactttttggaatcttgttcatttttctgatccctgccactggccctcaagctcctccagagtaggcactaggcccactcacagctggaggcccagccctcacatggtgctggtcttgggctggtcaaatgaacgtgtagggaatacatgaagggacaaattaatgagtgaatgactgaatgatggaagagtcggcaccttcttacttcttggttaagctctgaggaccagctaggaggccctttgctcctgctttctcccttctctccttttcctgccccatccctaccccaggcagctctgctctgaggttcagggagaggaaaagcggtagccctggagagaccagcgtgtccagctgggctctggcttcttggacctggagggagtcaggggccactttctcaggtgatttgcagagtggcaaggtccctcttgtccctaagtggttccaaaccaagcctgaatcattcttggggcaaaggctaggtatgcagatgttggcataaatagtttagctccaaactatgctagagtccttctggttcagagcagatggctagggaggagtggcaaagccagtgtctgcaaagagctacaaccgcaagatatcatctgcctcctgcatcctactgcagtctggccaaggagggaatcctgtggggaaggccctgctgatgctttcctacttccctcagcacacccagggcccctttccctcactaacttcaatagtttgcaattcatgccatggaaccagagcccgaattctaaatccaggcccacaagtcaacacaggaaggggacagcaggtcctggcctctgaaaccactgtctccgagcaggtccaaggagaggccaccagagactctgttctttaagctgccactaatggggaggactccgctagagccctgtccatgcagcctgcatctttttgccatctgcagaggcattggagggatctttttaaaaataagctagatcacatttctcccctgctaaaaccttctagtggctctccattttccttagaatgaagtccaaaccctttcccatggcccactgggtcctgcatggcagaatctttggccttctatccagtcggggctcctgctactctccccacagtggtgcagcttgactggctctgctgatggctgtcgcggaagagacttctggtctactgtgattgggtggctctggtctcctccatgtcaccccgcctgcttatacaccctcataacatgaagcctgtgctgtccactgtttccttaaaatgaaaccaagcctcaaagttacttgtaaagtcatctgaagaatcttctagattttcatgaattttaacccagtcttttacagttgtcttacctatatagtagtccctaggtatctgtgggggattggttccagaacctcactcatataccaaaatccatgcatgttgaagtccctgatataaaatggtgtagcatttgcatgtaacctatgcacatcctcctgtaccctttaaagcatctctagattattataatacctcatacaatgtaagtggtatgtaaatagttgttatactgtattgtttagggaatgatgacagaaaaaagcctgtacatggtcagtacagatgcagccatcctattttaattatttttcccacatctcatctcatcctctcctctcctctcctctcctttttcagacaggaccttgctctgtcaccagggctggagtgcagtgctgtgatcacagctcacagcagcctcaacctctggggctcaagggatcctcccacatcagcctcccaagtagctgggactacaggcgtggaccaccacgcctggctaacttttgtatttttggtagagacgaggttttaccaggttgcccaggctggtttggaactcctgggctcaagcagtccaccgacctcagcctcccaaagtgctgggattacaggcatgagccactgtacctggtcccaaatattttcaatctgaagttggttgaatccacagatgtggaacccacaacatagagggctgaccacacttagtttgactataattttcaacaaactcctttattgtttttcctttttttttttttttgagacggactcttgctctgtcccccaggctggagtgcactggtgcgatctcggctcactgcaagctccgcctcctgagttcatgccattgtcctgcctcagcctcccaagtagctgggactacaggcgcccgccaccacgcccggctaattttttgtattttttagtagagacggggtttcaccgtgttagccaggatggtctcgatctcctgaactcgtgatccacccgcctcagcctcccaaagtgctgggattacaggcgtgagccatcgcgtcctgccttgtttttccaaaggaaaggttgtttctcatggcaacaaccactctccttttccattcattttcatggatttacttaatcatcgaacttagtgattcttctccattagtggcagctcaaagaactgagttgctgccccaggggcctttccttggatctgctcagagacattggtttcagaggccagggtctgctgtccccttcttgtgcaaatacaactggcataaagaggtctgggaccaaacaagagcacctcttagtgagtgtgctggttagtggagggcacaggcttgtataggcagtgattgttcagcatgccgtgagcatcagtctgcctggtttacagagacacagagaatgtgactccaccctgagaaggttgggtaagacattccccactaaatccatattgagtgggtgaatacaggtggactgggaaggtgcactgcttctataaacagccactgggccctgtggtaacaggaacacattagcacatgttatggcccaggcattattcaaagtacttggcatctatgaactcatttacttttctcagaatacttacgagacagacatgattagcatccctatttcattgatggtaaaactgaggcccagaaaaaaaggtcaggtaacatgcccaatgtcacacagctgggagatagcaaagccatgatttgcaacgccagagggcaaccactatgccacagagccccaggtgtcaggctgccttgagatataaatattgttcctcaagcatccatttgagcagcttcttggtcctcatcatctgtggggggcaggatccactttctcgggagagggtagacatacagacacaaagtcctgaacctggaccaggtctggccttctttcacaggctgtgtgcagctgctagctttgcctctttcctggaagaccaggatgggcacagtgccaactctcagtcctgcaagcctagaccagcagccatcaggtaaggttagggccactgccctagtgccctatcccattgccagacacagcctttggggcccagcctcagctgcagcaccccaggatccccctcgaacttctcagctccatgccactttcacatcaggtgatcacagcaagacagggaactccagggggagctctgaccaggggcagtggaagaagagggatgggtgatatgtctgctcacccagagagcccagcaccaacctacatggacccaagctgaggtggcagagaggagggcatctgaaggcagagcctgggaagagatcctgctaggaggtctcagagaacctctgctgtagggactacagccaggtttagcaagcaggagtcagggagaagattcccaggggcagccagcattagagggctcagttcccaggagcacaggaccggtggctgggatgggcaaaaatggctcctggggcacaaaggtacaatgggaagaagctgtgcattcccatgctgtaagcgtctgccctgtttcacccaccaatccaccagtgggcatggccactttgctgtgggtgtgtggagcatttggcaagtcctagtaaggaacgatctttcttaactcccataaaccctacagaggtgtaggtcaggtaaggatacgtcatgctcagggtcaggttccagccgcagctgagggctaaggggaatgggtggacgtggggcagggagctggaagaacactcgagagatagcaggtaaatgagacatggctttactcagcagcagctctcttacacagctttctcaaactagctttctcattagcagcttactctcacaccgtctgccctgtcttggctgcttagtccggtggcccctacgcacagctgcgtggccagctctcccttgccttcagggtcagcagcttaattctttctctccctgggcacgggcaagccaagctgtgtcctggctcccctctgtcctggctcccctctgtccacctgcaaagacagacagctcttgctctctctctttctctaggttcccgtgcacccgccatgtcaagctatgttgagctgagccaagccccaagagacatgtcccccatacacagcgtcaacagggcagttataccttttacagacaatagtggtttagagccaagtatgaacttacataaacaggttatataagaagtggaggtgtgcacctgtgcaccagactcattgagtcatgcaggcctggatatccccctctgcctattccttgaacaaagcacatccaggtaccttacaggatactagaacccaaaaccaggagacttccccagggaacccaagttggtcaggggcagtgtttgctcttgaactcaggtgctaaggccatgtccaaagctgacatgaggttgtcacacacagtggcatcggtgccacactaatgccaggactgagacaccagcctttactggaagacacagttcctccctttctggtgagaaggcagcctggagggggaagacctgggccccagccttctttggtctgagatctcagcaggcctgtgtttccttcctcagctccagtgccacttcagtctctgctgtccctgctgataggaagagcaacagcacagcagcccaggaggatgcaaaggcagacccaaaggggtaaggcatgagcagacagtgctgaacttctggggtggagagaggcagcttgggctgtgtgtccattggcctttggctgggaaggtgaggccagcaaggtttgtgagctggcctgaggcacatagcaagggcagaagccccaaccagaaccctctggcttctggggccagggagctttccactaaactgttgccttggccaggaaatacatcatagtcagaaagggtctttcagtcagcaaccactctgacagcaactgccttttgctggaggctggagcatgcagacaaatcagaaacacctctgccctccaggaactctcaggcagggggtgggcaaaggctggtccagattagagcaatacatgagcgctagagcaggggaagggggcttcatggggactgtatgtagctggatgtggtcagcgatgagtgtccttgttggggagtgctggaagaggaggctcagtgaactaggtagggcttgattggcctcttgtactgtgatattggagtccactgtgtgcacagccctctactcacagtgtctcatacggttctcctcacagtctctcaaaggtttatgcctaattacaacaaaacccaaaagcctggagcctaggtctctgtgcctcctgggaaggatagtgctccgaagaaaacagccgcagctgagatagagtgatggcagtgaggagggtactacttaggtgggtggaaaaggcaactcaggcgatctcctctaaagaggagaaggagccaactctagaaagaacacggtggagagagctatagataaggaaccacaaaccaactaaccctgaggtgggaacatgcttagcatgttccaaaggacagagtggctggagcttggccagtgaggagggccacagatggagcagggccttggtaagccatggttaagagattggatcttatttcaagttttaagccaaaggggagtctcatgtgatttaggtgtttaaaaggtgaatgcatgtttgcattttcataccacattgctgttgcttttttacttaaaccaagatgctgggggctggggtgggcaatggatatctaaggtatgaggccttattgtgtttcttttctcattcgaattgcactgacaattaacaatcagagtgaaaacaacagctgacaccaatactgtgctgtgctaggtgccttacagccttcccagcaacttgtgagatgggtaaggtgggaaactgaagcatagaaagattaagtgacttagccaaggccttacaagtggcagaactgagttccaagggaagaggctctaagaaaatcctcaggagaaactacgaaaaactagtttatgaaatcttgtctttggagcctagtctcaagacccagaatcagtaacttacagctggttaacatggttaacatgctgtgtgatctcaccttaattttccccaaacgtggaaaaggataaggcttcttattatgcaacttgacagaggagaaaattgagggactcactcctgtaatgaacacacttaggaacagagcccagatccagccaactctagagccaggctcacgctactttcctctgatgtttaaacgtctgcaaaatcagaggtgttttttttttttttttttttttttgagacagagttttgctttgtcgccccagctggggtgcagtggcgcaatctcgactcactgcaacctctgcctcctgggttcaaacgattctcctgcctcagcctcctaagtagctgggattacaggcacatgccaccacgcccagctaatttttatatttttactagggatagggtttcactgtgttggccaggctggtctcaaactcctgacatcaagccatccacccatcttggcctcccaaattgctgggattacaggcgtgagccactgtgcctggccaatacaaactttcttgattacagtgtttcacaactctggctgtacttgagaatcacctaggaagtactgaaatacactgttgatgaaaaaggccatactctgtaaaatatttgaagaaattctgagccaaatgttaggactatgacccgtgacacagcctcaggaggtcctgagagcatgtgcccagggtggttcacttacagcttggttttttatgttctagggagacataagacatcaatcaatacatgtgaggtatacattagttaggtccagaaaggcctaggtatacattagttaggtccagaaaggccggacacctcaaagctgggagtgtggtgggggtgggggtgggggtggggttccaggtcataggtggattcagagattttctgattggcaattggttgaaagagttgttattctctaaagacctggaatcaatagaaaggagtgcctgggttaagataaggggttgtggagaccagagttcttatataggtgaagtctcataagtggccgcccttagaagcaatagatggccaatgtttcttattcagacctttaaaaggtgctagactctcagatcagaaaaagtcctggaaagggaaggagattctctacagaatgtaaatttcccccaggagagacagctttgccaggtcatttcaaaatatgtcaaaaaatatattttggtgtaaaatacttcaatttctttcattacctgctgtctgtcatgtgatgctatactagagtcaggttggaatttggcatattattgcttcaaggagtctgttttgtcagtctgaatatctctctcaatgttaatactggtcagttgggcatgaattccaaagggaggagaatatattgaggcatgtctgaccttcccctttctcatcatgacctgaactagtttttcacgttgtgtccccttggctgagagaagtgtccattcattcagctggggagcttagaattttatttttggtttacaacacaacaaaaacttcccgaagtcccaggtagagatttggattttatttttctggggtgggtctccatcatgtgtctttttcaaagctccccagtttgttctccttccaggctaggtcgagaaccatcgttctcaggtagtggttctgacccaggggcatctcccaaagcttccagcctgctacgatacaatgtctggagccatttttggttgtcaaaactgggagtgggagacactactggcttcttatatgcagagatctgggatgctgccccacatcccccaacacacaccatagaattatggggttcaaaatggtaatagtgctaaggttgacaaaccttgctgtagagccttgacgatctatttgggaagacagcagggacggaaaagaaaaagggatggcacagaaccacacccctcaccttccccgaaatctgggtagcgggcacaggacgtgtgcgcctgcgcgaatgcgcgctcgccaccagcgtacgcgacgcgtgcgcgcctgtgcacctcggcgagcacgcgcccgtagtgagtacgcctgcgtaggccgccatttcttgaagccccgaactcggtcgcagtgcccgccgggaaaatgcgaccgtccacaaagtgaaatggccgcccgggacgagctcggcctcggcggggattctcttgaggccatgcccgtgccggccgccagaggtcgcccgaggatcacgaatgggcccgaggagctggctgccccttcccccgcgtaaggtctgaagccgcggccagagtggctttggggtgaccgcgcgtggaccgtcgccggcgggaggaagcgcggtcccgcgaggggccgaacggggcccctgcggcttgagcttgtttcgcagggagccctggggccatggcctctgggacactggacacgggtcgtcagggctgcccagggggagggggtgtggacgtgcagacagggaaggcagctggaccctccaaccacgctgggccctcgggctgaccggggctggtctgtggggcagtgaggaggggcttcgttccctaggagtttgatgagggagcgccatgggggtggcgtcatcctgacatcccgcagggcagtggagccttactttccctaggttacaacacagttttaactgtcccaaactgtggggactccgccctattccatcttgggccgctccatcacactacagggagaggcggtatagtatagtggttgagagcctggactctggtgctttgggttccagtccaagctctgtcacttacaagcaccgtgaccttgggcatgttactcatcttctctgtgcctcaggttcctcacgtgcggaatagtggtaatcatacctcctaccatatagggttgttgaaatggccaaatcggtttgtatatgtaaagcctgtaggacatttaaacctgcgagctaagtgaagcagcaccagaggaatatctcctcctctcagaggtgttcagggacacctggaaagctaacttaaccagctttattggtttgatttcatttgacatgacacgatatctcatcttcttcctactaaacttttgtcatcaaattttccatctagaacatgctgttttcctcattatgttgcaagcatgggcttctcgtttatattttttctgcatgaggatcaggtgaagtttaggcaccacatttcctcaccactggcaaccgttgttggccagtggaggcagtacaagggtggaagtgtcagctgggtgcagtggctcatacccacctgtaatcctatactttgagaggccgaggcgggaagaccacttgagttccggggattgagatcagcgtgggcaacgtagtgagacctcatctctacaaatattatctatatctatatatgtatatgtatatgtatatcatatatatgatgtatatctcatatatatatgtttttgaaacaatgtttcacttctgtcgccccagactggagtgcaatggggtgatctcggcttactgcaacctctacctcctgggctcaagtgattctcctgccttaacctcccaagtagctgggactacaggcacacaccactgcacctggcttatttttgtagagaggagtttttgccatgttgcgcaggctggtctcaaactcctgacctcaactgatccacccacttctgcctgccaaagtactgaaattacaggcgtgaaccactacgccgggactacaatttccgttttttaaaagaatggaagtgtgtagattatggttgtgttaggagttgacagtggctgtattaggctactggatctttggtccaattacactcagaaggaaaggcttcagagaaattaatccaaaatccaaaatcccgttggtcaccatcccctatgttaccttgcctatctctaaccacttgacttccaggaagttcatgaggagctcggacaggatagctgggaagtaattcccctggatgttacattgtccagcagagcttcctgtgagtgtttgcctaagatttcctttttatgacccacataggtcatatgtcctaaaatcacagtggccctgccacaggcctaggaaagaagaagccttgttcatccatttgtccctgtgtcacaatagagcccaaatttctctttgtggataatcctggctctatccacagacttggtgagggcaacctctactagtgtatttctacagaggacgtgggacaggacgggactctgattaaatccatagtaaagctaactcagggctaccacagtagggagacaagctcttcaggccttgtatgtttgtctttggctcaagcaagcatgtcactgacagagattgaatgggtgtgtcagggcaccctgctggcaaccctgggactggtgttacctgtgcagaccacttttggatctgcatgggctgcagcagaccctaagggtggaagcagcacagagaagcacaggcccagtgggatggttccccacagttactgtgtggcgtcacactcacttgcctgcagttctgcctggtgcagctggaggtggcaattagcttgttgtgcctgctggagaattttagttcccttgacctccacctgaggctgaagaatcatgttgctttcagggcatactttccaaaaagtgtggcctctgttggccttgttattccagcttgaaggcaggaagcctgcctagacaaagttaactcctatatacaaagagtcccagggtagtttgtagcgtgttcttgtctcggggtagcccccaccagctattgaaggtaggctggtgatgttgggaaggttatattcagagtgagctaggatcgaggtgatggcgaagtagattttcattctgaaatgctgggctcactctcttagtagcccaacttggtgtttgcccctggcctagtagactctggaagcagtaccttgcacctcggtgtggggctggtgatgggaggggtgtggaagtggaggatcagctagcagcctctttcccacggtacccagattggagggtgcagtgcaatcatggggtgaggccagggaggacccctgaagagctcgatgcctgagacatctgggggaagccctgtccttcttgctggattcaggggtggcaaaagccaaaaattggagggccaggtgcaatggcacatgcctgtaatccctgcactttgggaggccaaggcaggaggatcgcttgagaccagcctgggcaacatggtgaaaccttgtctctacagaaaaaaaaaaaaatacaaaaattagctgggcgtggtagtgtagacctgtagtctctgctactcagaaggctgagacaggaggatggcttgagcccaggaggcagaggttgcagtgagccgagatgatgccactgcactccagcctgggcgacagagtgagaccctgcctccaaacaacaacaataaaaacatcggaggcttcggcttcatctattacacatggaggcctgttcagtgagaagggagcagcgatgctgggctcctgccaaggaggagactgtctgctccctggaattggggctgtgcctggctcctttctgccccgctttcagggatatgagtccctccaagtccacaggaggtgacagccagcttgcgtcctggggctgaggcagggttagtttcagagcacttttttcataagggtgcttattcttcttcagggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcaggtaagggctgagctgcagtgggctctgcctctggagcccatgtttttgttgaggtctgcgacccacatgggaaccacttccccacaccctgtgccaatacccgacacattgcacacccaggctcctgttctgtgagtgggtcatggtgattccctggtcctagagcagtgtcatcaggcttcttgtggctcaaggagctgggaggggactgtgataggaggatgtgtctgtccccaggtgtgagaagccctggctaattcccaatgcatggggcaggaaggaaggctgtctctcagagtacaggtgctctacaggtgggggtcctgggcagagtgagggctatttgtgtgggtaaaatgccattgtcagagaaggacagagtgtgaaagagcaaaaaaacaggagggtaaaagtgcaaaagtgacagagtgaagcagagagagagaggccagagggagagaaagggagcatgtgtgagcaggcatgagagagtgacacaggatgtgactggccatgtgttggtgtgtgccactgtgcatgagcaagaggacaaacgtgcctgttactggagctgaccatgtggcattggtgtgagagtttcaagtcaggctctcttgaaggcatcttgcctgccagcgcaaacactgcatgtccttgcagctctggacacgtcaacaggccagtgattccaggggtgcaaagcgaacagtttcttacacaagacagaaatgtagaaggagagagctaagactcatattgccccgagagaggagctagtggaatccagcagggcatctgctgtggggagcaggtggagcctggggttccttttgcagggatgaaagaaacacagtcatctgccttctttgttctggggcttcttgtaccacagaggttccataattattaatagttaggttatttttagggcctagctcaactgttagataacaagttttaccttctaagaatatctagcccatctttgattccttggctccaggccctggagggtcccagtccaaaaacagagtgaacaactttggacttgctgtcacattgtgtggcttctagaactagtcagtgttccatgcagaaggggtataaaaagtgaggcttgtggatgaaggaggaggcgagtggttctgggttttgttttcgttttgcgggggagtgtcaggaaaggctttctttacagggagagtgatgttggagctgggtttggaaggctgagggagattttgccagatgtgccagacgtgcttgggaaggcattccgagtggaggctcacaaagtgtatagggaacatccagtcaggtagccatcacaaaggagggttaatccagcctggcttggcaggaagcaccaagtaggggctgggcaggcacctgctcctaggctgaggagtgtgacccacatcctgagggccttgggagccaccgatggttttcctgcaggagagtgccacagccagactcgagtccaaagaagatccctccattgccctgtggaggaccaggccaggggagtatacgacgagacaaggcaggaggccatattggagactgtttgcttacaccaggggcaaggtgatgaggctgcaagtatttttgaattattaaaggtaaaagcgggcttggcgtggtggctcacacctgtcatcccagcactttgggaggccgaggtggcagtatcgcttgagcccaggagtttgagactagcctggggaacacagcaagaccccatttctacaaaaaatttaaaaacattagccaggtgtggtggcacatgcctgtagtaccagctacttgggaggctgaggtgggaggattgtttgagccttgcacgtcgaggatacagggagccatgttcctgccactgtactccagcctgggtaacaaaacaagatcctgtctccaaaataaaaataaaaaaaataaagataacggtgagggaaaagtggtagccaaggttgctccccagatttcagggctaggcaattggatgggtggtgacaggaactagctgagggtaaggagtttgggggcaggcccgctgagagatgcacagagatgagaaggtcactgggccatgccgaatgagaagtgcctgtaggggctccagccagtgatgtccagtaggctactgagtaaacaaatgtggagttgagcaaagatctgacctggggctagagagctgggagttgtcagctcataggaagtcactaaagagaatgcatgaggttgcctggagaatgcctttggaaggcagtgtgtacaaagcatgtattctcggcttttctctgcagacttccagggacagttgtccagccaggcccttggctgggtgggtgagtccacgtggttcagggatgctgagggaagctgcttcatcagctgacatttctctccattttctgctcttcttttgtctcaaaaagaaaaaaagaggggatattaattattgatcccctaaaaccctagctgaatatataaaatgaaaagaagtaaaaatatgagagaagcaaaggcagatggaccataattttggaaaataattccaaaaggtcttaaggaggaagaggagctacagagaggtattgagaaggaaaattttggataaatggaagaatcaggaaagactaccgtcatggaaaccaagccacgctgagctaactttccagtgctctgtagatgctgaaataggcccatcagatttggctatgtagaactcatgactgccttgaggggagtaggttggggcagtgggaaaggctgtagttggattataatggattgaggagggagcggaggataagcaggtgcagttgatggggtacacactctgaaactggctgtgacgtgatggatgtgggaggggtgagcagataattacagctacaagataatggggaaggtttcctataggtgaaagcaacgtgtgcatgttaggtaaaggctgggcagagggtgcctacgtgaccagtccccgataaaatccttggactctgagtctctcatgaattgccctggtcgacagcatttcacacttgttgtcacaactcactgctgaggggaactgagtgaatcctgtgtgacccactgggagaggactctggaagcttgtgcccgggttccctcagaaatttgccttgtgtgcttttccctttgctgattttgcttcgtatcttttcactataataaaccatagccttgagtgtgatgatgtgatgtgtcctgtgagttcttcttgtgaatcaccaagcctagggatggtcttggggacccctgacacagatgggcaggatcagaactttatgccataacaaggactttagattttctttcgagggcaaagaggagccaggaaggtttgaagcaggggagtgatatggcgagagtattgctttgcaatgggatctccagtggcagtgagaagagtgactgaagtgggcagagtggagcagggagaagaggaagtgcttacagcatcctccatgtaagaaatgatggggcctggactaggggactagctgtggagatggagacagaactgtaaaataagtagaagagatcccaaattggatgacaggtaagacttgggagagcagtgacggagagggaagtgacaatttagaaagccacatttctggtcgagtgagtggagtatgtgacccctcctggcttaggtggtggccaaagtatctctaacctgcctctatactgcctgcaactgactgagcaaatgcctggtccgtggagatcccaagctgacaagggcacctgaggcaagcctctggctttcaggtggaggccctacctaggctggcctggctggattgccctggcacactgctgttttgctgaggcagacagcagcactctgcaagtgctcttctcctgttcctcttagtggtctaaatcctgtagcatgctggggtgcgactgtagacaaatcccctttccgggccccctggggttctctatttgcagtctttgggtctggtcactggcatggcatctcagtaggctaggttcatcaggaagggtcaactatgtcatggcacctgatgggcagcatttagagtctgtgggccaggggcttaagggctgcttactgctaatagttctaagtagcaagcattccctcagccctagtctgggcacacgccaggaagaaagccactagatgtgctctcctagtggataactagcctggagttccaagaagggcagagacaggcagagtgagagccttcagagatgtaggcaacgatagtagcagaacttcgagggagagtagatggaaaaattaaaaaaaatccttgtcattatttttaaatgtctgaattgaccagattagaatctttgagagtctagacactagggagatctcatgggtgggccagttattatatcatatggagggagagtacgtatgacccagcacgagaggaccagaggacagtcagtgctaagggtaaaaccttaggccatgggagattgagtttttcatcagttggcaagttttcactttaatactccactgtttccatcatttcagacgactggggatgataaggacaatgtaatttgggggataaaggaagaactcattatatttcttggatgactttactggggaaatggattccttagtcatttgaaagaagcggtagaattccacatgtggggaatacttgttctaacaaaagcttaataacattagtggcaatgatccttttatataagggaaagcttcaagccagtgagaaaaacataaataaactagtaagaacatatttataaccatgagatttgggtgcagaataaaatcaaattggcagttcaggaaaggtcctaaacatctgtatattaacaatattccatcagtgagcaatgtgaatttcccataattgaaatgatgattgataaccttgtattgttcttatctaatataaggcaaagcagcactggggctttgataaagagcaatatctcatgtacactgaggacactgaaaccccgctaggaattctatggaatttctaaaatatttatattaaggacattttacccattatagactaatttagggaaggttctgcattttttttttgatttgacaatgtttccaatgcaatttatacaatattaaataagactaattagtttttgcacctttcttgttacaaggtgaaagaactaatcctttgagattttccagaaggtccctggcaaatcccaaagccagttttaggtataaaatatatttaagttttgattgtgggaaggcaaatgttaagagttgtcaggagttctcgaacatttgattgaatagcattatgggttagcgagaaatactacttggttagctagtgaatcagagttgtaaaaattttcaagtaaacatatgaggtaacatggttgtaaagaatcttcagttcctttaaaattgaaaagactttaaaaaaataactaaggacataataaactgaacatacagatagggcattacagtattttgataagacataaaatctttgcctcttaggcagatgactcagaagaaaaacagaccatttataactttttattagggacagaccaatgatcaagaattttttttttttttttttgagatggagtcttgctctgttgcccaggctggagtgcagtcgcgcgatcaccatgttggccaggctggtctcgaactcctgacctcaggtgaactgcccacctcagcctcccaaagtgctgggattacaggcgtgagccactgcacctagcctaagaaaattttgttattttaacagagaaaccaacattttaattttatacaagtataatatttgatattagttcttttttgaaaatcttataaatacactgaataaaagttttaaccatgacaaataaaattccttttctgtgaacattttctaattttaaagatatttgtttacattttgtctcacacatttttaaattatttgtcattttaatttgggacaaagctattctctttttccttaggaaaagcatatttgcatacaaagttgtttccctttgccatttttgccattattacttttagcagtttatatatatatatacacacacacttatttacttattataattttaaccattaataacttctctttcacagagaaaacaggaggtaggtaattttgaaatatcatataccagcattttgtagcagactagtaaagcttatgaatatacatctcataactttttatagttgttatatactttttatagtaccattttgcaatgtggacaaatgaacacatttaacagatccatatgtagtcacactgtaccataaaaaaagcaaaaagtatataaacttaaatttaggtctagtgactaagtattttatcttctttataaatgatatttaatgaatttagttaacttaattcagcataagtctaaggttttaagttaccaaaaagattttagaaactgcctttaagcttacatattataaaacataattactgttgaaataaagtttgccagaataatgactcagtttggttaaaagcaaatttaaatttttataatcttaaacatgtagtagatataatactagcttattcaacatgtaaacctgtttaagtttaggaggaacatacccaagtagagtaaaaatatatgcttgtattctgttgtattatatgtaatgctgataactcaaagacacataggtgtctattaaactaacaatattaaactagttttgtttgccaaaagtttacataaattctgtgaacttgagttttaaaagcatttgggttagtttttataagaatacttttttgttgtttacactgaaagtattagaagttgtttccttaatttatgagagctttataataatttatataagtacttatttatctctaagtcaattagaatagaggataagggattttgtaaattaatttggtaatgccatctggaggtactgaactattacacatatacaacatacatgtatactaaacatacagacagacacaaatagagatctaatggcgagccctcaatgggtgcagggggcctgaagctctactggctataggcagttgagagggctgagtgggaaggggaaagcctggtgaagagtagataggggtatgtaggaggtagaggcattgaaggggacagatgaaaagattcagggagctgaagggaaggtccaaggtggtgaaaagaagggaagagggatgcggtaggaagatgagaagggggaatcttagatgagcaggtttggggagaccccaggttccctaataaggtcactgaagttccaaattacccttcgtgattactttttttttttttttttgccagttttggaaatactggacagaatgagtgccataggggcagggcatgtagtcagcaagggaggaggaggaggatgaggaggaggaagggcacccagtagattgagagttacctgtgggaagaggcagatcaaatagagaaaggagccaggctggacagtctcattaggaagttctgcacacagtcgtcatctgggagccaaagtttctcttcagtcctcattgaggagctgaagggctttccttgtgcaatctctagacaaggtgtcaagggaaacaatgaggcctcacaaaagagccaggaatttggagtaaatctccactcaaaaggaaccaagaaaacttctatccaggacgattctggctaaaattgaaaaggaccaggaagagtcctgctcaacagagtcaggggttaaatccccactcaaaaagagctaggaagagttctgtctgcgaagattcttgctcaaacagaaaagaactgggaagagctcatttaacagaatcaaagtaactgaatcacagaaccataaaaagtgtccaataaaagcaaataccgtctctgggcagggtgcaatggctcacacctgtaatcccagcacttgagaagctgagggaggaagatcacttgagcccaagggttcgagaccagcctgggtaacatagcgagactcctatatctataaaaattttaaaaattagccaggcatggtggtgtgtgcctatagtcccagctacctgggaggctgaagtagtggaggattgcttgagcccaggagttgaggctgcagtgaactattattgcaccactgcactccagcttgggtgacagagcgagaccctgtctcaaaaacaaaaaacaaatatggatttagatagagacttttattttattttattttattatttttgagacagagcctttctctgtcacccaggctggagtgtaggtgccatctcagctcactgcaaccaccacctcccgggtttaagcaattctcccgcctcagccttctgagtagctggaattacaggcgtgcgccaccatgcccagctaatttttcaatttttaatagagatggggtttcgccatgctggccaggctggtcttgaactcctgaccccaagtgattcacccgccttggcctctcaaagtgctgggattacaggtgtgagccaccgtgcccgaccaatactttatttaaaaagactattgcaatagggacaatgctgcaacctcaggacttgcaaacatcacaaaataatacaaaaaacatcacaaaataataaaaaaaaaaaagcctttttttttcagtagggagtagtaagcacagctagcagctcagctactttcaagggccagtgggcaagcaaaggggaacctgtttggcatgatttgaccagaaatgtgtttccctgtggtcagccggttctcaggagaagctgctaagtggggcatgttctgcattgcagcacttacttaaccaggagcaagcaaaattcaggccctgtggggaggacagaagcctgcctaacattctgtcaaggcaaaggagagggtaaaaagcagacagctgtgaacacttgatcatccttcaggcaataatccattctgggtttctggcttaagactcttgagaaacaaggggaaacaactggtaggagcagcaggctcacctatatgtagttccgtgaggtagccttatggacttctgccaccttccaaaactcagcatgtcccaaaccatctttatcaacacagcttctcaccaaaaacaaccaaataaaacaaattaactaatgtactaattctgtatctccccctgtgttgttcatctcaaaaaactgttatcacctcattgactcagactctcaaccagcgaggtagaagaaatgtttgggggcatgttaaatgtaacacctatgagacatgtaagaggtgaggtgcaggacgcaggtacatggtgataaaagaaaaacctcagccggattaaatttaaaggagtttcattgagcaatgaactatttgtgaatcgggcagcccccagaatcacagcagattcacagagactccagtgcagctacatggtggaagatttatagattaaaaaaaaggtggagggggggaaatgacgtacagaaattggaagtgaggtacagaacggctggattggttacaggttgggggtatgccttatttgaacacagtttgaacactcaccagtgtatgaatggttgaagtatggccgctgggattggccaagagttagctattgttacaggtacacactcctaagttaggttttcaattttgtctgcctctaggttacagtttattgacaaagactcaaatatagaactatggagtccttctcaggccgtatttaatttgctttaacaattccccctttttggtcattttctcaactttgagagattgacaaaaaccttagttattgatatcactattacccttgtaaatgtacttatatggtcttgaaacccactgggaaacaggaggacagtgggttttgtaaggagagaataaggactgagtagaaggtacctctttatgctagaatgttctgtttacaggacaaaaacaaaacctggtctgttttaataactatttgtttccttaaagtcttagtttgattatgttacatttagcatgagcaactccattttgtttggtttggtctgttgggtcctagtgcatgagctcagtacacaacaatggcttgccagaattttgtttaaaaaattccccttggctgggcgtggtggctcatgcctgtaatcccagcacttagggaggctgaggcgggcagatcacgagctcaggagatcgagaccatcatggccaacatggtgaaaccctgtctctactaaaaatacaaaaattagccgggcgcggtggcatgcgcctgtaatcccagctactcgggaggctgaggcaagagaatcacttgaacctggcagtcagaggttgcagtgagccaagatcacgccactgcactccagcctggtgacagagcgagactccacctaaaaaaaaaaaaaaaaaatatttccccttattggccaggttctcacttaggtgagagtgtgaccaaaacttagggccttagcaccacttttagttacctagttaccatcattttaggtttccagtctcagcatgtcattcataggttatgatgtcctcataatcatacatttcaatcagttttgttattccagttgaagagagaccatttgacatttcagagatggctgcatgcaaacatttgaaacctttgagagaatacagtgcactggggagactactatgactaccagtaggataatacccagagtttgaagtatgctgtttacctgaggtccccataaaacaaactgcctaaattaaataaaataaagaatgagctagacgaagagtctactcacttcactaagtgatcttttcattaatcctgtatgactgaatttttataatctgcacttgatatacatattagaattttagaaaccccatataattttggaatatatattaatataattcactaaaaatataccctgaagattaaacattatttttattggccaagcgcggtggcttacacctgtaatcccagcactctcggaggccgaggcaggcggataacctgaggtcaggagttcaagagcagcctggccaacatggtgaaaccctgtctccactaaaaatagaaaaattagccaggcatggtggcatgcacctgtaatcccagctactcgggaggctaagactggagaatcgcctgaacccaggaggtggaggttgcagtgagcagagatcatgccattgcactccagcctgggcaacgagggcaaaactcagtctcaaaacaaaacaaaacagtatttttattttgacaatgcctcccatgatttttataccaaataagccaaatgtcactgttgcattagtgcattatcgatgtcaaacccaattcttaaataaaaccttatagacaaatgtattcaatcttaatcagtttgaacataaggtaagaattttataaaccttttataaccctttacaatttttgttgaagagcagattagtgctctaagaaaacctgttgtgcttttatgtccatgttcaatttatggaaaaacctaataatacccttttaaatttagtattatcatacataaaattttttacaaggttaattttttttttttttttgagacggagtcttgttctgtcgcctaggctgacagtggcatgatctcggctcactgcaacctctgtctccccagttcaagcagttctcctgcctcagcctctggagcagctgggactacaggcgtgtgccaccatgtctggctatttttttttttttgtatgttagtagagagggggtttcatcatgttggccaggctggtctcgaactcccaggtgctcaaaggaaaatttaagacagtccatggaggagaaaggtatagacaaggtcatgcagatattaaaccagaaaggacttatttcctaagccaggaatcgaacccagactgccactgtgaaagggcaaaaccttaactactgagcccagaaggagtctagagtagttaattttgagcttgcaaaggcttttaactagtcaagataatttttagaactaactatgatatgaaccctaaaattcctgttccctggaaggtagagacaaggagaaagtactgccacatggttacaaggtcaagctcccaaggacataaaacaggatggcgaccttgtccagttttttgttggtttcagggacctgcagcaaagtttgtcactgaccagcttgctgggccatcttgagcagcaagcttatgggggcccaagcccatgttttatcctaaggtacccctcgacacagaaaaacgactttatagcacaaaatataccagattgactacagcttaagactagacagcctcagaattcctttttgcattaattaaaattttacagaggagataaacagtgattttacaatcagtttgcacagagagagagaagcctgaaatctgactgggaagagatatttacccttttgctggcatgccaggcttctgggctccctttccctgagtggccctggtgatctggctctctgcaccattgccccgggagccaagccacaacacaaaagaatttttttttaaaatgcacttcagtgtgttgttgttcatttggaatgttccactgtaagttatctttcgtaagatgtcaccatttctgtaagaatttgctgcctcccgggcgtaatgtgtaacccagaaggaactcagttttccagaagcaattaataggttccatggaatgttgatggtaagaaaggaaggaaaaggtgacaagagtgagcgtagacagctctttctaaggagtttggctgctggaaggggaagagaagcagctggggttaggtgggaggaactaagtttagagacgctaaaagtgtatgtagcaggagtcacctgatcaggttgaactgcagcaggaacaaggaagttccattttgactactattagttgcaaattggacccttatgtcaactttttcatctgtaaaaaaaaagggatggccaggcacggtggctcacgcctgtaatcccagcagtttgagaggccgaggcgggcggattgcctgagttcaggagttcacaaccagcctggccaacaaggtgaagccccgtctctactaaaatacaaagaattagccacgcgtggcagcgggcgcctgtagtcccagaatctctggaacccgggaggcggaggttgcagtgagtcgagatcacaccactgcactccagcctgggcgacagaccgaaactccgtctcaaaaaaaaaaaaaggggggcaggggatgaaaatgctattgctttccaggaatagctatgactacttccaataaagaagacaagaaggttccacatgtgaaaactacgcggtcacaacgataagtgggcgggtgcacgcacgcgcgctgagatcgtgcgtgcacaggccggggtgcggccggcgtgagtacgcctgcgcgtgccgccatttcctgcagccgcagactctgcctgcggtgctcgccgggaaatgagacgatcaacaaagaaaatggttgttttgggcgagatcgaccgtggagaggctttttctgcagcagtcccggttcctgccgccagatggcgctcgaggatcacaaatgggtctagggttctcataatggccccgcctaagaaattttggattctcctggcccttcccccctttgtggggtcaacagcggatttgggaatctggtgaccaacacgtgcgcactcccctacccttgcccctaccgagccctccagggtagcttgggggagaagctcctccctagactgccgggtatttgatgagcctggccagcgcacaggtcttgagcaccatggtcagggaagaaggctgaatggcttaggtcttcctagagaggccggaggcgggaaagaactggagaaaggagagatggcagtgggaggatggggacaagaataccagtgtgtttccagccagaagacgatgtcttttaacacctcattgaagtcgtcaggtgactttgcccttgtcagaaaggagcagcactgcgggggtcctactgaggaggagactgactgctccttggggtggggattgtgcctccttcctgtctgccccactcttggggagatgagtccctccaagtccacgagacatgacagccagcctacctgccatgggagaacaaagtctagtctcagggcactcacttcataagggtcttattcttcctcagcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctgagcaattcgtcagacgagagagctgcaccagcaggtacgagccaaactgcactgggaccttacctgctagagccagtgtttttgtccagggcagcaacccaggacaaacccccacacactaggcatgcctgtttatcctctgcaggtgagtgtggttaggagccagagggaaggagagaaaccagcatctcaggggtagatattcatgggtttcagcttggagccatagcatcaaatctgttagactaagtctggcacagaaaggatgcacagagaaccaggttgtctggcagccagttcgaacctggaaacctgggtcaggggagggatataggttgctttttctgttaatggagatggaaactctctgagcaaggtgtgccatggtgtggatgtgattcactgccagaaataacaactgtaccagttggatgagctcttccactgccatcagcactgggatggccatggatttggacagtaatgtagctccacagtgctgactcagggttgctcattgattgcaagaagttggcagcagtagcctgaggaaacaggggctctgaattttctgagagagaccaagaaccaaggaacagccaggtactagggaacagacaacaccagatgcttgtgcttttctgtgagcagctcaggtctcccaaagtggtagtttcctggcttctggcctttgtagatcagtgtggatccacacccaattgtgatgtttgtggtagctgtaagaactttcccaattttgaaatcctaggtgacttgtagcatattttttcacatttgaaaataattgagttttgaaaatgtttttacaggcaatctagtatcagattttatatcatcctgaaacattctgtcaattgtcatttccaaaaatccatggaaaactggagttgttgaactggaaacagtgtggtctcaggaagtgcttcacagccattgcaacatgggcagggcctagagggcaggagagaatgccatgatttgatgacattttacccattcctgccaggtgaacttcatctccctctctgtgacagaattttctggctctcacatccagctttggtcactgggaacccacctattggctcttgcactggcaggacatgtggtagaggcttccagttcgaggcaggactggctgcattttcaagatgtccttatttctggtattttgtggcgatcgtcctgtccacttaactgattttgacccattgccttgctgtgatctctgtgctctctctgtctcccagttccaggtcattcccttgaccagcttccagtctttcctcatcttgtccctgccaatgaagtattctggctctgccttcactctcctgccatgatccattgctttgatagggtggcttcaggaacagggtgaggagagggctgtgctagctttatcttgccaaggaactcagcaaagaaaatttttgctgacctcttgcattcctcagcctggctctggtctctcaaacctaacacatgggatgcatgccagcagccagcctcagtttccctctggtccttttctgtgtgaggccagaggtccttgctttatcactgcctggagctgcagttgatgatggtgaaagaaggtgcacgtgtcttttgagagctccctttgttccccagagatttttttttcccaaagtggccatgagtttgggaataaccaggagccatgggccgccggctagagatgctgcatactaagagcctcctgtgagcagccatgtacacagtgaacacgatggctaaggccccatccagccgccctcaaagagcacatagtccactaaggaataagcatgatcgtaataaccattagcacctgctgtgtgctgagaatgtgcaggcactgttctgcatgccttatgtggactcactcatttaattctcacaccaactcaaggaggtgcttttattatggagaaactgaggcagatggaggttaagtaatttgctggcagttttgcagccaggaagtggcctaaccgagattagaatccagacagagatcagagcctgtactgttcatcgctgtggcatccatactgcccctccatttgtgataagcccaggaaggaaagaaaccaggtgctctgatggagaggggttagagcaaggatggttagggaaagcttttctatcgaggaggagacagttcggctgagacctgaaacatctggaggagcctgccttccaaagaacctggggagaggcattgtggacaaagaagatagggaggagggcctgaacaatgagccctgtgcttggagggtacggggtgaggtgagcagggggcaggagctgggccctgtagggtcttgtaggtgagggagaggaggctattgggagggctcctattgctcacattgcagtcctggggggatgcccagggcattttttcttttttttaagaggcggtgtttcactgtgttacccaggttgtttttgaattcctggcctcaagtgatcttcctgcctcagcttcccaagtagctccagggaatttctgttttaccttgcctcttcagttgcgccgtccccttcagtattctgctgacatggatcacaggataccagacacctggtagttgttcagtcagtaggaggtcttccttccttcctcttagaatcaatccttttctcacttgttggctctgcattttatcccccgtgtatcttttcagatttttgtggggcctcctctcccatccagtccaccttctccagtctctatggtatatttctttgtcatagggtgaagcaggaacaggtacaggatgattgggtacactgaggtgaggtaggagggcaggccctcaggaagggcttcccagaggaggtgatattgtctgcaaaggcatatgagagcctggaagtccaggggaactgcaggctggtctgtacggcttgagtggcacgtgatacagtttgagactatgaggcgagagagctaggcagatgctagaccatgattgttcttccctttccccactcttcaactagttgtaatcttaggcattggattctctggcaaggggacaatacccagtagcctgggccagatggaggcagccatatctggagtatgatctgagccacagcatgttggagaaaagccagaatcagcccagggcagtgtgcacccatagtgctggcctcaggcctttggagggtgagcagacttaagttggaaggtgcaaacaagtggtcagtggtgctgcccaacatcgtgccctgaactgcagttgacagctacggcagctttggtaatgaggctcatagcctgggggcaggcagagtgagagccgatattggcttggccagagaaaagcccttttgggctgccgaggaggttggattccaggccaagggccatatctggcagctgaagtgtggaggttcagaaaaacttcgacaccggtcagtttcccgcctctgctgggaatgaggtgcatctgactttcctcctcaatgatgcctaatttcatttggtcctctgccccttggccttgtgttctctagagagttccctgcagggtggcagaaggagctgatcctagtaagggaccgtcccatccagtgaggaggtgagctgggctgtgtcttccccttctgcaccctcctgactgtcacatccccgggagccccatgattccactctaactgagtgaatcacagaggccaaggcccttggctgcagtcaggagtactgagtggacactggaagattggggtcttgctactgactcacgatgtgacctgggacatgtctcaactcacctagcctgggtttgcttatctgtaaagtgagaagttccatttgttggtcttggaggaagcttcaagagcagtgctcaagggttaggctcagaaaagcctgtttgaccctggaaggtgtcagctcccaggttgacgtgcccacccctccctttatttctttcagggtgaggagcccctcgagctgcatggtcactgttactgtcactgccacatctgagcagcctcacatttatattccagcccccgcaagtgaattggactccagctctaccacgtaagaagggctatctagcaacctgggagatgttcctccgccacttcctccttggcggtaaaggacttggcttttgttccatgttgcttcccatttagtgccttccccagtttctagcaggccattagccaaggggccacacaggacagtgttagtcccctaatataaactcccatctaccgggcctagacattcccacacctcctttttcctatctctgtaagaggctgcagtggtacttcctagtgcactagtggatgtggctctgccattcatgggtccatgcctgggaagccagctccagtccgtgaaggccgggcctgtgagggcattcctgtgttactgtaaaggaatacctgaggctgggacatttataaaggaaagaggtttaattggctcacagtttggcaggctgcacaagcatggcaccagcagctgcttggcttctggcaaaggcctcgggaagcttataatcatggtggaagccgaagtgggagcaggaccatcacatggcacgagcaggaacaagagtgaggaaggggagggcccggactttgaaacaaccagatcttgtgtgaactaactgaatgagaactcacttttcactaaggggatggtgctagctgttcatgagggatccccccatgatcccgtcacctccctccaagccccacctccaacactgggaatcacatttcaacatgaggtttgtctgtctctgtcacatgcccactgcttcacctgcattcctggccacctgtcagggtgcaggaagggatgtcactgcaggaaggctgctcagtgaggtgtgtgtgttgggggcgggaggggggcatatccaagggggcctctgcagacatcaggtcagcaggctggagtgtgcagcatggaaatgggggaaaatttggggccatcctgagcccagcatgatgcagaccttgtttccagtcctgcagaggccagtccaggatgaggcaacctctaggcctctggactctaggagtgagaatggagaggttagatgtgaggtggagattgcacagtagctgagtaccttctgggaagtgctgagtggtaaagactgacagtgtaggattaaggcttggaggatatcttggttgtgggtagaggggaaagacgacgcagccctaaagtaggggtggaaagcccacaggactgaagtgtagaagtatagaagcctggggagaagatggggtcaccgaggtctgcatggaggaggacagcacattgtcattggttgcaggaagcccctttctggggccctcagtccaaacacaacaagagacgctcatggcctgggattgtagtctgagtccacagcagtgccagtgcctttatcctgggccttcccatgagctctttcacttccttcaaaccaggctgggtctccccagccctgaaccactcctgtgggccaggcctggttccctggaatcttctggtgtacctctgatttcttctgtgctccttctacagcaaagggattctcttcgtgaaggagtacgtgaatgctagtgaagtgtcttctgggaagccagtatctgcacgctatagcaagtaagagcgggtcccaaacccttccatgtcggccttctcctgccggctcccatattctcatccctgcatttccagttccttgtccaggacttggctcagagtagcttcggggtaattgtcgagtggatgagtgatgtagttgccctctgatgggattgatgcattttctactgaactgggcacctttgggttctcccttccggtgaattcatcctgcacaccattttcactgccattctgttctgcttgtctttgttattttattttgtaaaatgctgagaacacccctcttgacagagctggcagagccctagggaccaactagctcatcctatttcttttcagatcacagagctcttctcttctgccctcatgttcttttctgtcatgccaggctgcctcatttgaacacacatgtgactgcagttcctgatacatgtgtggctttgctttttaattttaattaattagttaattaattttaattaatttttttttgagatggagtcttgctctgttgcccaggctggagtgcagtggcgccatctcagctcaccacaacctctgcctcctgggttcaggcaattctcctgccttagcctccctagtagctgggattacaggcgcccaccaccatgcccagctagtttttgtattttagtagagatgaagtttcaccatgttggccaggctggtctcgaattcctgacctcaagcaatccacctgcctcggcctccccttttcattgatcatctcttcattttcttgctttgtgatgccatgtggaggggtacttccatgtcacctcggtgtattgctacctaccacactgaggtgaggtcccttagaatgtttcttatgacatgtcatctcactggaggattttagcaacagagaggagcatcctggccttatttcaggattgggcctctggggcttctggactggcttttattggtgctgtggaatgatgagcatggctgtgggggtcaagttcaagccccagctcaggcccccctgttaggatcacttcggacaagatgttcaacctctctgagctttgctttcacatctgtaggcccttagggtggtttttctcaacagcttattgagttataattcaccctttaaagtgtacagtcccgaggttttggtacattcacagagttatgcaaacatcattatccaattctggaacacctttgtctccccaaaaagaaactccaaacccgtctgcaccccctaattctaccccataactcaagcacaggtattataccagaatgatcccttctttcttctcattcccagtatctgatttctgctgagtgggctcctggtgactgtcacattatatcataggtggggaggaaagctctgctgttttcccactggtcagtggggtccccttggcatatacaacctcaggaatcctagccacccagccccgatcatctccctcattgtgaaaggtctcctttgcccccccatagaagggccctgtggcaccaagtcatgaatgacgactggcatcgtagttatgtctcagcttgtggccaaaggttaattagaaaattaactatgatagtgatttggctctcatctctgccctcctctcccctatcaaactccctgcagcgtcagcagcattgaggactcattcgccatggagaagaagcctccatgtggcagcactccatactctgagaggtatgttgactttcttagcacggagcttgcacttctacagaggagaatcagggaagggagagttcctgctgagtctgtttgcttttgtcttctgctttgcagcctccaatccatttgcagaaaggtgaaggacactaccgtagggtggtgcttcccttgttgggatatcacacttgtgacaactaaagcctttgaattgagctaagactagagggtagataccagcggtgactgagaagggaagtggtggcatctgacaacccagaggactcgtgtcagcaggaggggcccttcagattagaacctaatcaatcacttcattaacttgcaaatctaaccagaagtaaaaataaaatgactacaaaagagaggagtgggcagagaaggaagaaaaatgggctgctggcatcaagaagccagaaagacacacaaagccaagaatgcccagtgctgtggagccaccaaattgaaagcaggggcagagaacacctcgttcagcagttttgaaagctgtcactagatgatggcacagtcactagagagtcttaatgacaaagaaatcttatgttcagattcttggaatggggagaagagagtctcagagattgagttcactcaggcttctgtgaagaaaatggaataaatagccttcagtccacagtaagcaaatacggcagacccaggactaaaccccagggccctgactactcccaggttagggatgtttctactctgccatcttgcttctcattgatgggcagatcttaattcatgtggatgacattcagagaccaaagctacattggggaggaaaaggaaggaagtaagagggttaagataaagagaatcctaccgggccccagaggcaaacatataggagcagacaagcatatggggccagggaatctcctccactatagctgaagaagcaggtggttctgagtaactacagattacttggtgaggcacatcagcagatgaagtcttagcagagaagggcaggttggtcagaaacctgagagttaaccacttacataggagcaaatggaatgaggcttccaattctagtggagtgacaaaccagatactctagggacccccctttccattgcacaactactaaatccagaatcagtcattactgatccattgctaggcttggaggaaggaaggggactctctagggacaatctcagtcacttgcacacatgcatatgcacagacacacatgcacgcacacaaagaacagctgtgagctggtgctgctggtggtgaaagaagcaggaggagcagggctgcgctgagggcaaggatttcaagcagcactgctgtccagagtgaaccctgggccagcagcaggatggtgggccacacccaagctgcccgtgacacttctgggtcctccgacagagctaacgtggatctagattgttaatgtccccccgccccttgggcttctgtcagaagcagacccaaatctctggaagaaagtaccctgaattttggcttgtaggatcagatcaagcagttactttgaggaagtgcagtctgaggaagaaaagcagaggtgactctcagaaacaggcatcctggaactggaaagatgctcaacccaggagtcagtatctagaacttcagtgtcggatctgagtaggctctacagacagagcatgaagggtgggtccaggagtataggcaggggcagagctcagttggcccaggcgtgaggagaagggccatcaagacggggccaggcagggcacacaatgacatgtctcctgtaggagaaggcattggtcttcctgctctagagggtagcaggccccagcggataatctaagcagaaggtcagggggaggcaaactgtctggaataagtatcatatcaggacatctacaggagacatgtcattgtgagctggaaaaagatgcatgactagtttttggaaataatgcagaggtctacagcaggctgagaactgatctggcccagggctgtgctgcacaccacagaaaacagtggcatcctggggatcctgacagcaaacctgggcctggctgcaccaaattggaaggtctggctgtgtcacatcagaggtctgtacaccagcctgaccaccgggttattgttcttcatctcacaggacaactggagggatctgtacttactgcaaccgtgagatccgagactgtccaaagattaccctagaacatcttggtatctgctgccatgaatattgctttaaggtaaaaaagaggtggaagacaccttgagctaggcggtaactcctgatcacgtgctgctaagaacgttttgtagagtgcgggagtcttacgggttcagagactgtggaggaggcttgatctccatatacaattgcacatagtcgcagaggctttgcacaactgggagctgaatgagcttccaagtctaagacagtagatgagtgttggtggttctgcatgcttagtactgtagggaagacaaaagaggtcttttcaggaaagactatttctggcagagggccagcaagtgcaaaagccctggggcagaagcactagagtgttctagcttgcgtgggagaatgccaggagtgacagagtgggctagatcatgtaggccttggcgggcacagagtttggattttattctaagtgacattggggtccccattctccacagtgtgtggcactttgtaaccccaggttgttggttccaatccatttagggtgtcacctctgggtgcactgagaaaaacaaccctcccctttgccttgacagaatgttaggcaggcttctgtcctccccacagggcctgaactttgcttgctcctggttaagtaagtgctgcaatgcagaacatgccccacttagcagcttctcctgagaaccggctgaccacagggaaacacatttctggtcaaatcatgccaaacaggttcccctttgcttgcccactggcccttgaaagtagctgagctgctagctgtgcttactactccctactgaaaaaaaaggcttttttttgtattattttgtgatgttttttgtattattttgtgatgtttgcaagtcctgaggtccaggatgtgccacgggctcacagcatctgctcgcccaccttgttcaggcatccccttcccactccactcattcctcttgctttgctttgtgtgttgacctccagcttgcttttcttttcagtgtgggatttgcagtaaaccgatgggcgatctcctggatcagatcttcattcaccgtgacaccattcactgtgggaaatgctatgagaagctcttctaggtgggtgctggcactgcaaaggacaagtggccaagagactcattaaggagtagagatgcaccctggtctctcctggagtctcagccccagacacagctatctttcttggctcttccttatgttcagggggccttgtgtcctcatgtccctatgccttgtgatactttgagatcttaggtggcatggacaaaggccctcaatgaggacacttccaaatcacaccttccgtccagcacctgagccgagccctctagctaccctgggatactcgctcggccgctgttgttagccccattttgcaacaaggaaataaagatatagaaagggaggggacctggagaaacccaggtagaatcaggacctcaccccaggtctttggattcttgtccagggctctctgttcactgtcactcgcatagcttcagatcaggactgcatagccatggtgctcagtgaaacaagcctctgggccacattatgagaactgcctgaagatgtgtgtttgcatgctcatagccagtggaatttatcacggtgtctgagcacagagcagaatatatcccttgaaggcagtagcaaccaggctttccactagctccatgctgatggtcttctctccagaagacacaccttgagctaggtggtaactcctgatgactggagcagtcacccaccctgagggcctctagctgatgtgtttccagtctcatggctacttctgttttcttttagcgaccccccaccgccaggctgatcagaagctgatgactcgtggacaaatttggctgtccccagttttgccccaagttgctgtctccccttccctcacctcctccctccctgtttgatttcttcatgcttttgcccttctcaagttgaagttgcatacatccaatatcgtatcttaatgatgctatgataattgcttgtgtgtgtagcttcttgtagcttagaaagcgctttatgcccatgatgtcatttcaggctcaaccaaagaggatcaaacaggaattccatcttggcttccctaagacagattggctttctaatgagtttaagtgggcagaagtgtagggttcagtgtgtcctgactcccttgaggcttataatgggccaagttgaagactgttgatgatccctggtgggtaaattgcagacatcaaatgctagggattggcataggctagtgtttagcttgtctatttgccatatctattttttttaaatttccatacacttgtaaaagtagttagttgcttttgattgagttatatagcagtttttcatttggtcttccactcacctttcactatatttgagtgttcccttacaggtatgttggcatgtgttggaaaatttacacaattaggtttaaattcagtaggatgtgattttaggatgctactgatcaaagtgatatctgtgtctgttggaatcttgatagctgattaatttgccctcaattctgctccctgaacttcacacataaatcttcccaagtgggttttagggtgtatagatcccagcaggattaaggaggtggaaaagcagctaacatttcttgaggctctaccacatagcaggcactgtcacagagtaatggcattaatccccataataatcctgtgaaggtgatattctcatcccatcttagacatgaggatattggaactcagagaggtggctattgcattgcgcagaacgctacagagcccatgctcttcccagagcagcacccacaaaagcaagcattgattttgtgctcagtgtgtgccaagcactgtgcagagggtacacagttcctgccaggttaacaccctcccttcaggcctcccaaaggcataggcttgcaaagagcagaaggtgtgaaatcacactcttcctctgggcatcctggatccctgaattatccccccccccatgaagtacttcaagggccaagctgcccctttccctcctctccgcccatgaaaatgcctccaaactgagatgctttcagctgagaacagatttgactcacagacattaccaaagaggagcttgtgaatccaggaaaagctccagggggctagctgatctgagcagagagctttcagtgacccattttcctgtctagactctgccttaagctagtggcaactgctggggccccaggtacttgggacatggaaactcgttggatggctgggcagatgtaagcctgtccatgcagtcagccgatcctctgctcaggttcagctggactctgccatctgtgggcccagcatcactctgtaagttccttgaaaggaagaacaaccttagagtatttctgatacaaaatgagggcctctgctcttgatttaattataaaatgtctacgtctttctccagtttctgagccctatgcacattggcttgtgggcttgttcttcctgccaaatgatcagagaggaacattccatttatttgtagtggatttcctctggagggcatgtacccacactaaataccaactgctcttcctcagctgtagtccccaacatcagacttggcacgtggtggacactaacacacaggcactcaatgaatgagtgaaggaaataaaagtcaccccgttggtgagaggtgctatccctgagtctcagtgcaggaccagtggatgaaaggcaaggtaaagaggcccaagataggctggcttcccccgttcaaggtatagtctgcctttaagggagttttagaaccaacatgcaagacattgaaagaaatcttgcaagagccattattgacttagatccaaaacagcctctctcatgtctaaaaaggcacagaattttgcagatctgaggaagagggatgcattacctttttgcttcttttcaattgcttagtgtttctaatcatacttaatccacactaatgtgcgcaattataataaatggtaagatatcacatgtgtca

SEQ ID NO: 2404 - DNA, 59041 bp, Homo sapiens; identical to SEQ ID NO: 2401

SEQ ID NO: 2405 - DNA, 59041 bp, Homo sapiens; identical to SEQ ID NO: 2401

SEQ ID NO: 2406 - DNA, 59041 bp, Homo sapiens; identical to SEQ ID NO: 2401

SEQ ID NO: 2407 - DNA, 59041 bp, Homo sapiens; identical to SEQ ID NO: 2401

SEQ ID NO: 2408 - DNA, 1114033 bp, Homo sapiens
atgtgatagtgttggaatttaatcacaggtttacttaacttggattccattgtcttttatagagaaaaagcatatttatgaaattagtattttaatattgtttgcaactaatactgtatgagtttatggtttctggcatatcaagatgaacaaatataacaaaagtacatttaatggctacatctttaagtgtatgaatatagaggtctttaatgactagttaaatccagaaaaaagagagtcaacattcttcctctataatataaggatgggtcttcccttcaaatgcagccttctttactttcccacttaagcacgaaatggtgccgcatataatttttaaaatcaataaatcacagttgtattaagaaatattttattaacaaaacagtaaattccacttgcttagcatttccaataatggataaattggccttgcaacagaaaaacaaacaaacaaaaaaagaagaagaaaacccctttgatacccaatcacacaaagcactagaagggtagggttatgtggcctttctttgatgtcttagggattgaccacttcacacgttattgtagtatttgttcttttaaaaaaggcaacacattacatggataaaaaagaagcataatcaatcagaaaagttacagtctagagatgtaatcaaatttatgccaagtcgtgtgaaatcctcaatcaactgcaaactatgcagggaaccctgatatgtttggtatgaagatacttgggattcaagtcattttctctttctaactctgttcctctcttttctttttccattgaggaaaaaataatttttgctagagtttgtgtaagccaataatattagaaataattttgctgataataaactatatcaatcattgcatgtaactttaaaatttacgctggggagaaacattgaaatcaatcccaaacaacacatttcatagatatactgcttaaaattaccattattcaatttattttctattatattttagaatctttccagatggaaactggttcaagcttaatagataaaatagaaaagcaatcttaaaaaaaaaaacccttcaagctgtaaattagtagttttacacttcccttcttatttaactggctttccctgagtaagactgaatgagacgggggaaaagaaaagactcgtgaattatttaatgtggcaaattaaaaaaaatgaaaatctagaaaagaagcaatggatattaaattttcattttataccttctactttctgggtcataaaaagccactaaatttctttgtacacaacaattacttggcaaccatagatagtggtgatttgctatgaattatacatatttctaaggtgctgtatgtctgaaatccaggccacttcttggcttttttttcatcaactaaagtatcacaaaagatgttttgcattttttgcctttgctgattaaagctaattggaaagatattcttctcttctacaaaattttttatcgttcttttagaaggtattcaagtaatgcaaccaatttttcctgaaacatcaacttgcaatgtaataatgcattttttgcactaccttctcatattagtaatttattgctgtgaacatcattgaataatatgcaaaacaagtgtataatctatacttttccactacttaatgtgttaaactaaaactatatttaatgatatatatgtaaaaccagaaaagttaaaacatagtcaataattaacagagaatgattttttaagtgggtagtaatacagaatcaaaaattactgaaaaatactttcttagtcgagagaaagtgtttactttccagaaatgttcatcatgcacatcagattcagagatatatatattattttattagaaagaaagttttcaattgcagcagccagagttaaggtgtagattaaccaattttgcttccataacctgcccacataatggttcttattcatgcagcagtatatcagtgatattctatttgataaggaaaggttcatttctttagggactaaaatcttcttaaggttacctgggagcaagatctcaatgaagcaaatcaccccatttgtcatcaataccttggcacaaccctcttccttcctgcttttcaatttgtcaataaatatttgctactgtatgcacgtttggatcttccagcatatctgatggattgctgtggattcgtgtgtgtgtgtgtgtgtgtgtgtgtgtgtgtgtgtgtgtgtgtgtgaaaatagtgaatgtatgtgggaatgtgagtatttcagggagaaaagattataagatacatatgtatatatgtgactttctaattcacacctttcatacaagtactaaaacttaattgcaacagaatgaaggctgtacatataagaaaagaagtagctgagtctttgtatatacattcatacatatcttccttagaataaacactacactgtaatttctttaaaaaataaaagtaattgtggcaatttataatggtggcaaaaaaaaagaaaaacccaactgaaataattgttgctctgatgtcataaaactccctatacttagcaacacttataacattgaatttaccaaaaatggctgaagagcagagatatattttgcattttctatacaacaggctataaaacgtcacttatcacagtccagaaagcacacagagatggattttatataaacatatgtaataacataataagcgtgcatgaaaatttcccaatgattgcatctatgccctcttgtttttgttttgaaattttgtgtgaaaacgtgccttatatttcacatttttgaaaataaggcctccatacttttttttcctctctcacaaccagaaaggggctttttgaatgtgttcctacacaagtcttcaaaaaagccagcactttgtttcaaatgcaagttccaaccactgctccagttgcaccaggcggcaaactcttaaaggtttgcaggttgagtcactcaaaaggacagtcttctctggcaattggactgacttctcaggaaagcgctagcactttggctaaatccaggatcataggtagcttcttttttgtgttatgttttgtgttggtttttgtgttgtgccttgatgctgtagtactcctttgctttatgaatgcgtgcggtcatcactgtcttttagaaatgttccagcaacataaagacaagcagagtaaatgaaaacactgtggatgttagggaatttattggcccctgttttttgttttttgtttttcttttttgagaaacaagagcatgagatacttgtttttattttttaaaaagtctttccttcctgattgcattccctgtcttcttttgtatgtgcttcataaaaaggaaagtaaataagtttatattatgtctcagataaaatgaagactatttctatacaagtgtccatttaagatcttgggatcagacataatactctttatccttgtttttcttatttttgttggagcttttcgcactgctgggttgtttctcctttacaacagccccattggactgtgctgagttactgatgtagtttcgactctcgtccacatggtatgagccttcatcccggtttctgtacttgtacatggcatagaggaggataaggatgcacagggcggcagcggctactatcccaacgaccatacccgtggtgctgctggactcccggatcacttctgctgagcctggatacggctctctgccgcctgctcgggttgggttggctatagaaaagaggatgagaacaaacacaaagtgatcattgagttcactgaataccagagagctatattaacatttattatctaattctaacagcacctatgctttaggaaaggtatgctattgataaatgtagccatccctttgcctcatggttactaaaaactagggactgtgatttaaagttctctgggagatttgttgctgtgtcttctttcttcacaaatcaattttgttcacagagtttggtaagcattgtcccaaataaactccaattagctctaaagggccatgtgggtgacttaagtaaaaaaaacccacaaacccagcataaagaaaagcagaacagccctaccctataatactagagggaatcataagaatcaaataggtgttgctctagaacataggtctaactctagactgaatcaggacaactaaatttaggattactttagaaatcatattccccttgtattttaaagaatacagtattgaacaataagataatccatacattttaactgtctgctttttaaagtataactttagttacatttttataaataaaaatagactaatttccattttgttggagattcatttgtttacataagtatgtgtgtattttattaattgattggggagctcccaagatgaactttggaggagaaagtaataaaatattctttctcagttttaaatacagtctagattgattttttggtcaaaactctgaactacctaatagattagataataatagaaggctggctagtctagttttattcaactgacaaaacccttcttcagtcttcccaaagtataaataaggctctttcttggatgagaccaatggattttggggtgcctacgtcttcttgaaggcctggtcaggcactgaaattgatgattgatggggaagaatggacctgagatttaattggtagatatgaggagaaggggcagctcttttcccctatatataataaacttttttgatataaaaggatagaaactgtagcgagagaagaagattctatcctactctgactgtaggtcattttttccttgtgaattgtgttttctgtttttccctgaatctctatcctctcgcttgtcttacataaaaatattacttttcagatgtaatgtattaaaaatgctacaactttcaaaacactattctttgccaattatgtataatgaacaaataatctcatgattccatatatattagataagaatgtgtgtgtatgagtgtgtgttcatgtatatgtaagaactgaaaactcaagaagactaaaattgtgcttttatttcgctactactaaacatcatttagtaattaattttaatatttctgcaaaagttcttgttaattactgggaatcattttaccaaacatatggctctatactgctttgtaattccattttcaaatatcaccaatatttcttttgcctaaacgtgtgtgtgtgtgtgtttttctgtgattttcttttccttcctcaaataaagccttaacaaatacagccatttccaaagtagtagctcttagtctcaaagtagcaataagctatgttctggtgctacaaaatgtagcaggtaaaactttttatgctgaatgtgtcattgcttgttttacaaaagcccacggagtgtggctgaataaaaagctttggtgttgcttctgtggacaaggtgaaaggagacaaagactataatccacagtatttgattacaggaattaatttcctctcatgaagaatagaatctactgcagtaactctgtcactacctgacaaaccaaaggcagcactttttcttttaaatacagtcatctttgccaaagtgtgccaattaactcagctgctttcactaaatgaaaactttcattttacagagcattcttttactatggtgtctcaagagctaaaaagggaattttgtttaaatgttacctaaatcattttttccagcctgatggaatgctttcattttaaacacattttcacaattacctcacttttactctgtctgccagaaaggaatagggagaatggagataacatttgaatcatttagcttatgacagtaaaatttgagaattttaatggagtggagggtttatattttgtatactaagaatagacatgtatttttttcaataaggaattgatatcgtaaatggactatcttatcaaaaaaattttatttttatctgctaaaatatttctgagaggttttcaaaacaactatgcacatagcatgataacagcaactttgtgttaaaataagaatgaggtcacaaagaccataacaaagcctgaaacacttcaactgtgccatatgcatttgaaaacatctcctgtttaaggaaaacactttcttttttgcaacactagccaaattgttgcttaagtcatatgaggcctaaaaatatctctacacaaaacccagatgtaaatcccagatgtaaaaattctaaatatcatgtttcttaaaaatataacctagaaaatctctaccaaaattaaaatctaaacccaataaacatgttatctttcttttccccagattcacattaaaattttaataaccatcatagcagatattattataggtatgttcggaataggtagttactccaatatctaactgattaattaatattctttttctatttatgcttcaaatctgaaggctaagtgaaatttttcttaacttttcttctgagactagaaatatttatgtgttggtcgggtgtggtggctcacatctgtaatcccagcactttgggaggccgaggcgagtggatcacgaggtcaagagatgcagaccattttggccaacatggtgaaaccctgaaatacaaaaattagctgggcatggtggcatgcacctgtagtcccagttacttgggggattgaggcaggagaattgcttgaacccgggaggcagaggttgcagtgagctgcgatcgcacactacactccagcctggcaacagagcgagacactgcctcaaccaaaaaaaaaaaaaaaaagaaagaaagaaatatttatgtattaatgggacatctctcccagatatgcaataacaggccaaagagatttaaatatattcatgaattataaatgtggcttctcttattgtcgctaatgctttattttgatgatcactgagaaatctctgatgaaattttatattaatgtaaatgtagagaatagtatcaatgactaatatggttaaatgtctttttatataatttgttcaaaatttatataaaaggtaaatgcagtcatctcatccatttactaaaatgtgaaaaaaagagaaacataattaatttgtatatttcatggatttaagaattttgcattccctctacactatataataaactaaaataagacatttttaaaaaattaaagcaatctgcaacatgtttttctcttagcagtgctgaaatgtgaataatgtaattaattaaaatttactttcatccttttctttctttgtcccagcacgtgacaaagaaacaagtgaaagagaataacttgttaaaaaagatttaacttgttaaaaaaagcaagtaaaagagaataagggagggggagctaaaataatggcatacacacaaataagcttaagtctttaagtcttgaatcttcaaagattaactccgacgtgtaggtaaaattaagccgatgtagccagttcattatattgggcccaggggcataaggaactcggttcaatggaaaacttcagtaggactgacagtggtctactacaagcaaggagagcaagaatgcacaccttcatcacaatacaaaggcttttgacttttgctggcatttttaacctataaatgatttggaagctaatgattattctagcaaggaaatagagcagtacaacagttatgacccatttcatatttatattcacttctttctcacttctgagattcatttagccaaatggctatagaaaaatccctgggactcttgcacttataaagcatgttaccttaaaggaccactgaaaagtagtttttaatccttcctctctcttctagcatttggtaagatacggtggtctctagaagttttccacatggtctgctttgtccctgtagatttatcaagaatcctatgaatcttcttgttttttgttgtctaatatgtattgtggtaacttcggtaaacacgagctatcaaatgtttggacagttagtaacctatttctgcactatgctctaaatcaatttgttcatatctgatgataattcagatgataattcattgtggaaaatgaacagttactactaaaggcatattctagtgccttgtcacatagaaaaaataaatgcaactgttgctctccattaaaaagtaaaaaaaaatctttaagattttaatttgtcttttgctgagatagttattttaaacaacaacaggaaaggaaatcgccctatgtattatttatttatttttgatagtctttgatacagtatctgtgaaagaacatcatttcctcaaattagaacaaatttagatccaattaagaaacacatggggaaaatatgtttgagacacattagacttcagtacagaccagagagggctgtcagtgcaggcttcatctcttaccagcttcttgcaccctctgttgcttcctccattctcctctgtatttctcctcccacttacccttctttattgcctctgtgccttgctcttccagctcctgaattatccttgtaggggccctccccacccccaggtaaatgaagaaggtcaggccagcaggggccaggactttttgcctcatgggttagcatattactcaggaaggtgttcaataaaccacaaaatttattttcaagttctgaatttcaaaacacaatgtaaaataattcttactggcacaaatgtctaagtgtgactatttcaccagaacaggttttgtgtttcatattggcatgattacttttaaatataactttctaaatttgtttgcaaataaaattgtatggtttggcaaaacaaataatatttgatcactaatttaaaagacttttgtgatgcatctggtgatatgatgggggcacattaagccattaaactttgcattgtatttatcagtttgcattgtttgattatatctaatcacaccttagcatatgcaaacagaagttaaagcttgcaattacttagtacaatgattcacaactgaagtgctaaaataactaagcaatttgaaagatagatacatttttgaatgttaataaatttttccaaggagatttccctttgcaatggtgacatccttcatttttctttttgaaattggaaacagcaatcaattattgtcattaaagaaaactgctcttgatctatgtttttgcaactctgcatgataaatggtgtttaaaatcctaattcctgatatagaatggggtttggtgggtggtgggaccttatctttctattgacaagttcaccaaggcattagcatgccatcagatggtctttttatcactcaaattgtcatttttatgaaattattttgtatacttgaatgagctgttcttccactgtaatcttatatatatattttggttccaaagttaactttcaaggtaagtttgtagtttctaggtaatttttcgggctggttttatttcttcagtatagactgttaatgtatgtgtatgtcgtcaactatgaacctggcacaccaaggataaagtaagagtatcattataacctgatgacaatggaaattcagcttttgagctttgagaaaaagattgtaagaaactaccaatcttaggaaataataaagaaaaaaacatgctagtggttaaaaaaaaaaacataggctatatatttaagatcaggaggggaccataagggatcattaaactccataatgcccagcacgcatcattctgctaaccagaattgttagatgtcctgtcttgcaatgatccttaaaaaaaaaaaaaactcttggcaagatgcatttactgaatttcttctcactaagagtttctgaccagtctttctggttttctcataaattaagcttaaagtaatagattttaaatttctgtctccaccccacctaggaaagagttgcctaaaatgatctcattagaccagagttctatactgtgtctaatagatgtggaagttattataattctaggctagacttgaaagtgattttggatttatagggggaagatttgacttttccaatactcagtttcattaatactgtgaaaagaaaattggaattgtagcctcctggggtgtttgtgaattgagattagcacacttttttcccccatttgaaaaaaaacaactcaaagtttattactttttcccatttttttgcttcaatacagtgtaggccagaagaaacaattatgatgcaatcattcacaagaagccatgtttaaatactacatttgtaggaaagcagggacacaatgatttatatgacatgcattaatttcgactcatgcggtggttttgtaagaagtgagggatgctgactgtttcaaattccttcccttctccctcccaccaattccacccatgcctgcacattctgaagtacacttacggaggtcagacaagtcttgagagaggacatgtctgacacatcttagcccttccccaatacatcggagatttagaaagaacttggaaatcaataaacctttgctacctgcctggctgctgtctccgatattttcctctgcttctttcaaaaccaccaaagcatgcatttgaagggcagttaaggggccaccactctgatattgagacgttcattatcttctccagagatctaggtattgaatgggaagggatgctagacacggaaaaactcatcatgtgcctgcatgatggagaaacccaactaggacaggctgctacctcatatggtaccacatcgaacagaagagacaatggatgtccacactctgtatgaccttggtgacactgaagacaaataaacagaggaacatgcacaatctccctcatctccaggggaagccataggatcatggtatttacaaatcttattcttcaattattcactatgttgtaaactatatgtccacagcttagtcatctataagcttcatagactttttacatagtcattgtatccttgtggtttgcatctattatggtgcttactccagcaccatggtccttactgttcccatggccattcatagtctgttcacagctacctactccaatttgtcttccatatttgtcaaaggaagttagagccataatattattgctgtccccaactcctcacataccaaaaagagttcaacctttatgccttgctcatataaccttttatctcctgcctgtttaaatagtacttatttctcgaagcttggctcaaatgtcccatcttttatgattttttttctctaagaaaatcccctccttctatcaacgagtatataatgagctatagttaacattccagggactatatgaggtcctgagggtataggagataacgaaacaaacttgatgtatatgtcctcatggaccttaaaatatagtgaggcagagaggcatacaagaaggaatcacacagttaaagtaacagctgggatatgcatgatgaaggaaaactgtaggtaccatgcaggagtaggacaaaggtttctgattgcaactgcagaatcagatctttctgaattagtgacacttatgataaaaatgagtagagagtcgtcaagtgaaagtgggtagagaagtctacgaaaaacatgtcgaatgaccttgaggaaacaaagtttacttttcaggaattaaacaacagttagagtggttgtagcacagtgagatttaagggagagtgagaagaaatttcaaggtggacatgaaatttatcacagagactgtagactatggaataaagtcataataaaaagatgagcgtatttaaccccataaataacaattttatgtggcaaaagccataatatcattaacaaaatgaaaatgacaaaggagggaaatatctgtagtacatatgacggaccaagagtaaatacctctaaaatacagagtgtgtgtcaactgataggaaaaaagacaaacaacctaacagaagtatggagaaaactacacacaagcaagtggagaagagatctcaatgctggtgagaatattcttaataattatttgattgttattagaaagtaatccaataacatctattaaattttttaaaataaataaattctctcaaccgtatatcacatcacaaattttaacattaattctatactattgtaaaatctcacttaaatgtttcatccaatagttttgtcttttttcaactagactgttggtcctttgacagtttcctgtgactctgtttctctttcttattagttctctcaccttccaaactctaatgaagattgaacacactggctgaaaactgcatgttttatgtatagttagatgaaagcttttgtaacttgataaattttcaagggtaaactaggttgaatctaatcattaagaaagtgtgaaagtgtgaaagccaagaactgtgtggctcacacctgcagtcgcagcactttgagaggctgaagccaggtgttcaagaccagcctgggaaaaagaacaagatactgtctctagaaaaaattaaaacaaatattagttgggcatagtggtgcacacctgtagtcctagctactcgagtccgaggtgggaggaccatttgagcccaggagtttaagaatagagtgagccacgatcatgtcactgccctccagcctgggagacagagcaagaaagtgagagacctttgattttaaagttttgagtaaaggtgctaagcaagggggttgaacactgacattaacatctcatatttctttaactcactacttctctaaccctcaacctttgtaatatctgcagtaaaaacgataaatgtaatatttacttcattaaatcagaaatcacttcttctgtgctttggagaattgggatcaatatacaataatgaaaatactgcatttgctttccctatgcttcaaggtaatatgtcacttaatcccaatgactaaagtcactaagctatttaaagttaactgagtcatcagtttgattcatttggatgccttatttacatcaacatcatctgacacccacagtactgcaaatagttgacagctaacttgagctcttttttcaattcagagtagttgtagaaatttctagggtgcttttcagtcctgttgctattggaattgaaaagggtctctttactcaggcccaactttccataattgtcaagcagaagaaagccatataggcaataattgagaaaatcagtttcaaaactagggaccccagagagtctgtatatgtttttcctcaaaatgtattacattccagaaaaatgcaagaagagttatattttgaaatgtggatgatactccttattaactgatttcaactcaactgagcttcttgataccaaaatagcttctcttcctgggagctcattgactacaacacccaaaaatatatacatccagaaatcacttttcttaagatccatttccttttttatatatagataattgaataatctatctttacaaaataatgagatttattccacagaattcttaaggcctgaaactagaaatttttggaaaacctggtttatagtaagacaaaaatggcaacattatagctagagtaatgaggagtatgtgtgtgcatgtgtgtgaatgtgtgtgcatgtgaatattgcagcattccttccaattctctctcagaagttgctgagtttgctgggcatggtaattcatgcctgtaatcccagtgctttgggaggctgagagaggagtattgcttgaagccaagagttccagactagcctgggcaacaaagggaggagactctgtctctacagaaaatgtaaaaaaattagcctggcatggtggcgcatgcctgtagtctcagcttctggggaggctgaggtgggaggatcacttgagcccagcagtttgggggtgcagtgagccataactgcagcactacactcctgctgggcaatagagaacccaattaaagaaaatgctgaagtcattcttcttatcctttcctttccttttcgctttccttttccttttcccctttcacctttctttctcctttctcctttcctttccttcctcctttccaaattaataggtaaagccaagctattaaatagttccaggaaacctttagcaataacttgggggtaaacttacttaactaagtaatcaaaaccctcatcaaaaccttctttcttacattcttccatatattttaacattactcaattgtcaacttatgcttaacagagctactatgacttccctgtaacatctatattttgtttcttattttatgtagttaacagctattatttttactattattatatggtaattgctgtgctatacattttacacataaatttcatctaatttatttctcataacactatgtggtgtaggtattatcattacaggaaagaaaactaagtctcaaagagcttagcctatttagactttataaatggcacagccaaaattcaaactcaggtctgtctatggctactaatattttatatactcagtgtgtctgcatttatcactgtggatcaatttgttattgcttctgattttattcctgtgttaagtgtaaaaacacttagcactttaggtgtattttctttttttgtttgtttatttttgtttttgtttttgtttgagacagagtcttgctctgtcgcccaggctggagcacagtggcgcggtctcagctcactgcaagctctgcctcccagattcacgccattctcctgcctcagcctcccaagtagctgggactacacgcacctgccaccacgcccggctaattttttgaatttttggtagagaaggggtttcaccgtgttagccaggatggtctcgatctcctgatctcatgatccgcccgcctcggcctcccaaagtgctgggattacaggtgtgagccactgcacccgggctttaggtatattttctaagcagttgcccagttctagcccttccagccacattcctcttcacctgctgccaactctctgtcctttgctgtgggagttaacattcccacagaatcttagaaaagcagtgaagagtggtaaaaagaatatcgaattatgcattaggttctagtctaggtcctgtccttaactttttgagtgacagtttgcagttcattatcctctgctaacattcctttatcagaaaccatgataatgacacataaattatttatatcccaggggttactgtgggcatcagatcaggtagggcattcagtatgaaagtatctgaggaggatgaggactttgtaaaaacagtgattatctgattgttttctctacatcttccacacagaaggtactgaatcagcagctgtcccaacaattatacagttttgcaatatgcactgcacacagtgtctcaatcagctgtggcagtgaccatcaaggacattatctccccgggagtagttgtatttgaggacttccctttcatgaaaagaggccttgtgaattcaggtggcaaaaatggtcctttgcattgtagggcatgttgtttcaggccattaactgtggtgctgcatgtggagcttgtttctgtttttctgtgagacattctatctttaatggatcagtgctctctggctcctatggttggagtgaattacatttctctctctttcaaaattttattatgatattttatgttttaggtgtcataaaatcaatcatctaagactattctttggtaataaatagctgacagcaaggcttattatgttggtaaaaactcctttgattaggtttcattgtttctttctaaaattgttaagtcaattttcccccacttccttccctgctctggaattgcacagtgtactccggatgaaatccaaaggagactttccactgcagaggtgcatgctgggtcctaggtgcacccacccctccaccagggtgcccgcacagcatctatataaacctgagtcattctgtgtaatggggcagtgtacaattttcctgatttagaattgggtctctttgctttgggtgatcatctttatattgctgtcatgaggctatttctgtctcaattttcttttgttgggaaaaagatcagattctttttggtgaaaatgcaatagctaaggtgaaagattagataacttcccctctgagcccattagagggaagtgtgtcaagtctagcattaggaaatacgaaagacaaggcatccatcatggtggggaggctgtgtgggtaggtgtgcctggtaagtcatgctgctgggagtattcctgagtgtcttaggaaggaagcaggaaagttaatcatttcttctctcgaaagcactctccctttctctctctctctctttttgtttagtataaaaagcccaatttttttccctccaaaaataaagtaagaagagcagatgatacgtgccctcctcctaccataggaacctaaatttatccagctaaagcactgctcctgtcttagtggtcactgagaaaagttttatgctgatagaatttagaaatactttgaaaaacttgctagatgctgaagtatccatcattaacatttccctttcttgtttggggatatttccatttatgatatggtttactatttagttagtttgctactactactaataaaagctaatttatgttatcaaagctttcctgtggtagactatgttaagtgctttagatgcattgtctcatttttatcagtacagcaatgtcatgagtattgaacattattcctttcattttgcagatgtaaaaagctgagtacacagagattcaatgacttgcctctaattacacagtaggtggccaaattgagatttgaacacaggcattgggatttctcaagtttactcaataaaacaaaatattttagtgtgctcttagatgtgacaacgtcagtatttttctttctcctatttttttttaatgtaattaatggcctctggctatactggcatctttaatacaccatttttaacctggaaatgtaaagtattctggtctttgctattatattgccagtgtcaggcttcttataacattttgtttatgagtaaggagtaactcatgatgagagtgatctaatcgacaagttactgtgttgagatgagagctgaaggctaaagccaaatgtagcatttgctgccccttggagcatatgtgccaacaatgaaagcatattggctcctcatggaggcagcatgtcctctagattggaattcagaatatgcttgctggcttacctctgatatcatctgagcaaatgtaattaatgaggtaccaagagaacgccacaggaagccaatttcattatcaaaacaggtatttgacacaaattacaagacaacgtgactttatccttcctggatttcatgttttcataagaggtaaacttaccttatatttttctaaacctgtgctacattcctcccttcaaggtggttaaatatttcagagcatggatgtgcatcttgttatcttcttccaaagctcaacaggacatgtgccatactgttaaaaggctattatattttagcatcttccaataaaaaattgtgatgtgaaaccgattattaatgctctaaggctggatacatacaggctgcctaaaaacttatgctgtactcactactgaacagagttttctgttgcttattgtaggaggtttctgtatcagcagccatctattttttacagacttcaagtaaatgcttaatctcacttagcaaactcacttatatgctaagtaattattataagtggccaatcatatgttagttaaaacattttaacagaacccactctgtctaatacctaaagagactgtgctgattttttactcagatcaaatgcataatgccttatgagcgacctcactacaaggcagaataatgcctccattggcacataaccagtgctagtagcagtgggtcctccacctgtcattggatgtgtgataattatttgttaaacccttagtatgtggtatgttccagacactctgccaagcattgtgtatgaatcctctttttccaatctcataattaaccgtattctccccattttacagactaggaaactgagcatcaaaactactaagtaaatttcccaagaccaggaaagggctgcgtctcaaattagttctatataattccaaagtccttgccataactaatattcatttctggtggcatgtcacagttcttttaaaatgttgttaagagcttttctaaagtgtagcaaccattatattgttaaaaaaaaaaaaaagttcaaacctcagaaaagggtcaaaatagttcaattaaatacaaattgctatattctaaaaaacaaaacaaaaaacatatgtacacacacacacacacacacacacatatgaaataccttttgcttgtgattttgttttctgctgaactcctagtagaaactaattttgttgaataaaaactggttgctgggaaagttgatgtcaagttgaccaaacaaagataggcttcttcctgcctctgggcccctggccttccatttcttagggcatttgtaatttcaaatactttatctgtccctttgatgtgtaaatatggaggacttgggagccatctcttcgtaatataaacatcagagaagatagcgcccctatctcctaatttctgtggaaagggtgggagcctaactttagtgggctccatgctccaaactgtaaaactatccccctgtcatgaaaacatgagatagtttgtttacatttcctttgggtgaagcccatttgcaagcacagttggtcccaaatccatccatcccagcacttaaataccctccagccttttttgtttgtttgttttcagtgagttgccctcgggctgaaatctggcccacctctcctattgcaatagccttgactaaatcttccttgcctgtttaactttgttcaatataatttttattctgacattactgccttcagaaaagcaggggaaaagtgagtaaaaatgatgtgtgataaatctcttctactttaaccatgtactacttatttttattccagtgttctggacaattaaatttatatggaaaaaacatttcctacaccagcacgttgcacactgaaacccagctagcacatcagtttccaactccagctgccccatcccgcacctgaatgatgagctgggccctcagcgctgattctagcctggtacacaggagatgctctcgatgttccctcaaatggaacactcattgctactgtttttctggctgcagctcaaaatcctccattttgacagcaatgtgttggctattacggactaattaaagtcacttttgaataattacataataaataacacacatttaaatgtagaacaaaattattttctaatcaagctctaaaaatatgacccagcaagacagtccttgaaatgattgtgatgacttatttaatgaaaaggtgcaccttgttcaatatacatatctttattcctaatgtgtttaatggtatcaattgaatagaaatcccttgaccttttctcaaaatagcacactgaaaaaccactgaaaattgcatggtaattgcaacaaatttagcttaatagtaatacatgtaaagaatatgacatgaaattatttaaatgaacttttgaaaaatcgattctatatttgtgaggtgcctgaattttagaggaaaaaccttctgtgttccaagaaactataagcccaccttttctaaactagagaatacaccagctctctcatattacatgacataacttaatctctctgaatctctttagctatgaaaatgcttcatagtttcataaaataatgagatagaataatgtttgtaaaggactaagaacaatgatggagcgcagaataaatcttcaccaaatactagttattattgctatttatcattgcttatgtaatctgaaccttgatcaacatgattcctctgataggcaatcaacagttgtcttttgagtggttgtactgatgacctcacctcctgtgttccagctaaagagatgccacaaaaatgggtgatccttttcttcccccaatgactaatgagatattttattattcaatggaactcttcttttcctagttttacaaaagtttaattgatttgagagtggcctaatatcccattagctatccatcccctaaccactcacagagaattgacgtattattcttagcactgtaaatctaacaggaaattgtccttcctaaacagggctccagaaaacaggaggcaggtctggttccctttgtaacaaatgataaattagagttatttattagggagctactacagcaaagagggtctttatcttcatttaggatcttgaatatcaacataaaactcacctttttaaaacttcttcaggagttttcagaaagggttctatttggaagagggcccccaaactaagagatactgacatgattaaagaccttcttggaacttaagtggttttgcagtgttgccattttgtcaatttactaagtggatctaaaatgtaaaatttcaaagacattttataaaaacttatatttgtgtgaaaaacaaagtcttggaaaatatgtgcgtgtgtgtataaaaataacaaatactaataacaggaaacactcatatagcacttattttgagcaaaacattttttctataacatacttttcatatattaactccagcaatcacatagcaataactatgctggagcaataactccagcaatcacaatttttttctctaggctgagaaaaatcacggaagctgtaaacgttttttgagaaaaattatgaaaaaaatgttatctatctctcatgtgtctacgcttcttaaactgggcactttaggacaacactggcctgtaacattgttaccaatagctggttcaggtttctacctgttcactaagagctggggttcaattagccctcctccatcacatagccaacattttgtattctgaagccatccttttgtattctgaaactgatcatatcaatgtgaagttatcatccaatgctaactgtgcaggacagtgtggctaaaatcaagtataattgagttccatgtgttcccacccaggatgttgaccctgatctagttttaacatgcacagttcccatcaggaggcctgagtggtttcatcagttgcccaccaattttcagccaggaaaagtaacagcattatgtaaaagggaaaatagcttggaatattctttttgtataactgaattgggggaaaaagccaccatttatgttctacattatgccagacattgcaataaatgtcttcaatatattaattaatatagaactgaaggtataaactttctatttttgctcccagagcttagcagagcagtaggtatatagtgacactcaatacctgatcaatgttgaagctgataacccaccaaatatataacttccctgttcattaagagttctgaatggaaccacaggtaattccaatttatcaaacatttgataaaaggaataatttactagtactcaagatgatgctagatttttcctgtttcttccattaacagctttaggaaggtacctaaataaggaacataggacattttcagagaaaaagccattttttgaaggtgggggagggtcagagtgattagaaaactcatgagtaaatacttagggagagtgaggtactcagaagatttgggcaacgcatctataaaggtaatggtgcatctccttacaaagatttgctctcacttgcccaaggactagcaaatgtgcatagaagatacatctgtttcagaatatttacctcaatatgttagttttataaaaagccagtatcccaaaatatagcctaatatgtgaaataatttttatttaagtatttctaacatctaatagcagcagctagaattatccaatgtctaataacagcagcagctacaattattgttatattattttatgtttgcattcaagatggattgcaagcaggaaaaagaaatttaagaaaaccagtacattaggaaacaatgacctgcaggaggggcagcccatgatgaaacattattcagacttaaacaggattcaaaacaaaaacaaacagaaaaacacaacccatattccaagaaaaaagttggaaaataggaaaacatcatataaactaagaatttcattagaagctatcacataaataaaaccaatttctgcccaaagagccaccttcatatgaagcattaaagacaggcttgagaaaaaaagtaatagggaggtggacagaaaaagctaatgtagaaagagatttaacatcagaaatcgaaagtgaaacaatttatggcatatattatcaagaccgggggagataagatcagaggacaggtttacagtgaatgatcccattaacacaaaataatctgaagttcttgttttaacaggaattgatgaattgaaaactgaagagtgaggagggacaaactgaaagagaggagaaaaagttaaactaggcttggtacaagagtgttaaagtagctgtcgttagatagaatcagtagctggtgtgttttgtattttgggtaacagactttggtgcagtagaacagaactaaaattgacagaacaagtccatgcaggcagcaagaaaaacagggttcctgcttcatggaatttaccttgtggggagattcaagctatacattaatgaatgaaaaacaaatacgtaaacatgattgtttcagatagtgatagtgtggtaaagaaaacaaaggtagaaagattccctggagtatggcaattaataagctgctactcacttttcattgtgctatgatatttaacaaagcagacaaaaatcgggtgaacaagcagaagacgatggcaaaagggttaccccatccgccttttctctcctctcctctaccttcttcctccaccatcttgttcttaggtctagtgtcaccagagcaaaagacagacagtaaactagtccataaggaatggttaatcagacctataagcaatggctcgaagaactggatcattcagctgagctcacgaagaaaaagtgacaattttaagtgcaattagttactgtgattcactaggtactcaaggtaaggattctgcaacaagagtatgatagcctatacttagacagtaaaagagggattcagcaagtcctgtaattagtaagaacttcaacagttttcatcgctgtattaatactgtgtaaaatactgaaaaatggattaccctgaagaaaacactaattgagaaaacaaaatcaactataaataacacacaccccaatatacaaagaccagactttgttacatggataactcatgctagaggatgtcagagaagatgagatagaaaaaagaatgtcctggtgcaaaagattaacaccaggaaggttgggcatgtgagcgtagaagaaatggggaagggaaatttgagggtgggaaaatgcagagatgggactgatataatgacagaaaagcaatagcaatgactttttttgttgttgttgttgctaactaacagattaagcataccaatgaaaaccaaggcaagatcttagtaaaggggcctaggatagtgccatgatgtgactttatctgtcacgacaaccaagagggaatgattgcagaggccaatgagctgggagaatggaatggatgatcgtgacagagctgatcattgtgaatgatagatgtttctgggagctgagagtcctgactggcactgtggagccaagaggaaagaggaccagagcatacccagcctggtctcccacgccctgtcctgttgcgaggtgactgccgagctcttccccctccctggcactcagcagctgctctctaagcgctacagtcagtggttacaatcagtgggggaagtgatattcaaatattcaaaacgagatgcacgacatacatcccgatttgctctaaagagcggatttactctaaaatggtattcttcacaagaatgcaaattcattactttcttgtgacatgaaattctcctgggattctaggtgatgtcaatagacaccactagcagatagtggttagtccatatccacctcactcattttgttaatgcaaacaatattattattattattattattattttattattattttgagacaaaatcccactctgtcacccaggctgaagtgcagtggcgtgatcttggctgactgcaacctctgcctccaagattcaagtgattctcctgcctcagcctcctgagtagctgggattacaggtgcacagcaccacacctggctgatttttctatttttggcagggacagggttttggcatgttggccagggtggtctcaaactcctgaccgcaagtgatctgcctgactcaggttcccaaagtgctggaattacaggcgtgagccactatgaccagcaaagaacattattgaatttaaatactgctttaccaaaaaccaaaccaaaccaaaacaaaactaatggaaatgagcctaacacttgaagttatgaatatttggaatcaaatctaggctatgaattcattcatttttcaggggtctacagccaccacttaatggtataagggctgtatggtaacagtatttacgttagtcacatcagaagatgcaaacatatcataaagaagtaaaatgtttcagcttgaattttagggaaacatggcaagactcaaatatttctctattaaagatatcaacgagtctacctgctgtttgttttactactgctataatactctcacttccgaaattcagaaatatatcacttaaggtaatttgctggcagagtgagtggtggggactttttgtcagtagaaaggtcaaataattttgcacaatgtgctgcaaatttttagctttataattttactataagtgacccaagggaaagctcattatattgttacacacaaaaattatgttgtgagctaatggaaagtgaacagtaaggtagaagccctgtgtgctatacccactgctttttctgaaatacataatcttggcatgttttgtttttaattttttcaataaatgtggaaaaatttatgtaaaaaataagagtcctcatctcacaatcaacgatggtataggagggtagccttctatacatgaatataaggcccttctaaggaatataacatgcaacaaagatttacagtaaagccaaggaagtaagaaaaaaagttgactaacctaacccacctgagctcggctcacaggggtcaatgtcctcatcatcgctgggacactctgctgaggccacaaggatgtcatctgtggtctgcaaaagaatcacattcagtagattaatttaaagggtcctaacagattctctcatctttgtctcattgacaagtgaaatacaatttgtttatcaagaaaccaaattcactatttccctttctaaagacacagagcttacattttagatccttcatagaagtaactgcctatttgtgaaaacttgattacactttagtttacatgaggacgcagaaatggtgacagccaacttgtagatacccatccactcaaatgcagatagaagctgcacacagtatcatacagaggtttaaaacaacctggcagaaacagatgatttgaaatttattacagcctggagtgctacaatgtatgcatcagtgggctttatgtagtacttgtgcttggcttcctaaaagcagaaaagccataaccttttacactcacgactatgtagagtttgatgaatctttgagatatagcttgttattggaggaaacacagattaagtagagaattagatagctctttcattggtgcaaaaaggcaaggaaatacaatccatttaagacactttcattttcattatgatttcacacttgaagctcatttttgtaatgttcagatagcaggtattgcttcctcatcatccctttcatcattatggtttcataataaatgaaaagtgtattcaaagtgggggaggggaagaggtggcagttttctctgtgacattctagttgcttcattgcgcttacagcaaaaaagatacctatctctgtaataaaaagcagagtccataaatcctagcagttagtcacataatcaacacactgataagcacgaaaagttgttctttattgccactgacaagctgcagtaaattcagcatagatattgcatggaatctgtaaaggcttccatcagagttggctctgctaaggtaaaacagagaatccaatgtatacaaataaataaaaatatctcattacatctactaaggactaaagagattagaattgttcaaacaattctcagaattgcaacattgatacagttctcatttaaaagtggaattaaaataacataggtcttacttcaaagaaaaagcaaaaatacgatatgagcacctaatattaaaggagcacctaatattgtcacagattaaagtataactaaatttttaagaaagttgtggcattttgaaaaatggagacgaggggtgatgaacttttatagaaagtattaggcttaaaaatctttcaagtgcagagtctttaagaacaaagaatttgttcagatgcgaatgctttacaatataactttaaataaacacaaacctttaaatagcattggagatggtttcatgttactctgctcttacttcttctgagacaattgggagagtttctggattcatgcattttgctgctgctattttagaaagggaaggtgaaaatattggtttgcctggaagtgtaagtctttttttttaactgttgaatttattgacaaagttattcataatattctcactttttattcttcaatgtttgtggcatttgtagtgctaactcccctttcattcctggtatttgataatttgtgggggttttctctttttttttttttattatacttttagttccaggatacatgtgcagcatatgcaggttacatatgtatacacgtgccatggtggtttgctgcacccatcaacctgtcatctacattaggtatttctcctaatgctatacctcccctagacccccaccctccaacaggcccaagtgtgtgatgttcccctgcctgtgtccatgtgttctcattgttcaactcccacttatgagtgagaatatgcagtgtttgattttcagttcctctgatagtttgctgagaatggtggtttccagcttcatccatgtccctacaagggacatgaactcatccttttttatggctgcatagtattccatggtgtatatgtgccacattttctatatccagtctatcattgatgagcatttgggttggttccaagtctttgctattgtgaatagtgtggcaagaaatatacatgtacatgtgtctttatagtaaaatgatttataatcctttgggtatatacccagtaatgggattgctgggtcaaatggtatttctggttctagatccttgaggaatcaccacactgtcttccacaatggttgaactaatttacactcccaccaacagtgtaaaagcattcctattctccacatcctccagcatctgttgcttcctgactttttaatgattgccattctaactggcatgagatggtatctcattgtggttttgatttgcattgctctgatgaccagtgatgatgagctttttttcatatgtgtgttggccgtataaatgtcttcttttgaaaagtgtatgttcatatacttcacccactttttgatggggttgttttgtttttttcttgtaaatttgtttaagttccttgtagactctggatattagacctttgtcagacagatagattgcaaaaatttcctcccattctgtaggttgcctgtccattctgatgatagtttcttttgctgggcagaagctctttaattagatcccatttgtcaattttggcttttgttgccactgctttttgtgttttagtcatcaagtctttgcccatgcctgtgtcctaaatggtattgcctaggttttcttctagggttttttatggttttaggtcttacgtttaagtctttaatccatcttgagttaatttttgtataaggtgtaaggaaggggtccggtttcagtttcctgcatatgtctagccagttttcccaacaccatttattaaatagggaatcctttcctcattccttgtttttgtcaggtttgtcaaagatcagctggtcttcaaagaactagaaaaaactactttatatttcatatggaaccaaaaaagagcccatatagccaagccaatcctaagcaaaaagaacaaggctggaggcatcatgctacctgacttaaaactatgctacaaggctacagtaaccaaaacagcctggtaccagtaccaaaacagatatatagaccaatggaatagaacagaggcctcaatgtaactcttaatgtcagtgaagatcgttagcaattggcacgataatcatgtaggtatctttttaaaaagaaagctttaaaagcaaagacccattctccttttggcacaactacatcttgctgggtaatatacaaacagacttgataatgacgtgttattgaattatgtagtcttgccggtcagttgctccaattccctccagaggagataatcagctttttgtttttttccccccggaccaacatctagcggaaagctacttttattctcaatttcaaattaatttcaaggttacagataatttctcattttctttgaggaatgttaaatatattgatgaaatcaatatagtgttgttcctattggtgttttattcttgttagagggaggaggatataaataaattctttaaaccaatggctctcacatcagcagtgatattgccaccttttccttcctccacctggaggcacgtttggtaatatgtggaaatatttgaggtcacaattggaattctgaggtctgctactatcattgtctctttttgactgctaaacattcttttctttcctcttcctctcttctccttctccttttttctttcttttttttttctttttttttttttttttgtagagataaggttccagctcagtctcactgtgttacccaggctgatctagaactcttggcctcaagcaatactcctacctgagcctcccgaagtgctgggattacaggaatgagctaccacacaatgcctaaatattataaaatacacatgacagcttgaagacaacaaagaatgatctaacctgaaatgttaataatgccaaagttgagaacccctgctcaaaacatttaaaaacagttctgtcttattgttctcctaaaaatatggacagcataatagtatctattgttacaaggatgaaattagtacatgaaaagtacctagaaggggacaacactgtaaatgtttattaaaactttcaatattattatcaacttttttcaatatttcatgaatgtaataccaatttaatttttgcactataattacaaataatataattatagatattaaaccgaaacttgtacatatgaattattcttgaggtctcatgttaaaatttgtatcaaaatacagtagctacattggtattttgttgaactaagtaccatcttttactgtccaactttgaccttttaaaaggcaaacatcaaatataaacttaaaaaactgcttcttaaaaaaattcatgggctacaactgtgtgactcagtgggtagtgtttcatgcagactaaattatttacgcaatacaagttaagctttgttttaaaagctgacctattttcttttggaacaattctacactaaccagaacgtgtgagaatgttctcagtgttaccttctgcaaaacacaattcctaaaataacaaaagatgtcatacaatggtacttcctatagccctcttacagtagaaaaaaataactacaaatgcgacccttttgtaaaactatattttactttttaatgtaatttccctggtataatgaaatacgttcttgattttcatatatgtttttcctccagaaattaaaaaccagcaacaatcttgagaataaaagacctcaaatcaatagatggcttggcaaaaatcatcatcgcagtatgaaaaatcaggaagtggctcaagtgtaggggaagaaaatcaaatttcactttagaagctgaattaactgcacaattttctagccaaagctgtgtaatttaaatttaattcactgtgtttggagctgctgctatgacttgctgttgagagagtggtagaaagaaactcaaatatgtcacattaatcaattctattctttagtatacttttccctgatgtttataacctttttgagaaaagagacaacctgctgaaaaagacagaagcgtgatcaagcagaagcattagctttacataacagtccatttagatgagtgtctctaactgtgcatttaaccacccacaggtgaaattgctatgctgatcttccttaattcagactggtctgtacatgcacatcgtaagcatctcttcttgttgaaaatgtgcactaaaatctaagtctctatacttttaggaagaaaatgatttgaacagaattcaagaaataaaggctgtaaaacttaatccatccttttctatatttgaacaccaatattttgtagggtttgagaaatatgtcaggacgggggcaaaagaatgttcttaatgaatggtaagaaggtagaccaagtgatttaatacccagggatattaaaaagagggagcatttggttggggggaatttagagaaacacagatgtatgtttgttattttttctcacttataggaagccttttatttttcaacatcattaatggtggaattttctgtatatgcatttgctgtcactttaaaaaatatagcttaactgcatatctgtgtggtaaaaatatacaaggaaagcacgaataaacccagtatgtaatattatatccctgctaagaataacattccaagactttattccttatgataaacagctttcctgaagactaatatattccaatgaagacgcttacagaaaactatactattaagacaaatctgttttgtaaggaaaagagcaatttccaattgtaaaataggatattcattgtcagtatatgatacccacaaataaacccgatttattctaaaattttaattgaaagtttatttctaaacagcaacagtgtatcctgctatacctctaaatacgaagccaaaagaattgtctcagacaatgacatgagcattgtataacattatttagcctaatatttaactgttgtgactgatatttagactgaattgatagcaacagttagtgggtcgaggacagtgctggctgaaatatgatatctttggttaactgatgggcacttgttcttgctgatacttttctgtatgcaaagctgctttggaagagagagcgctctcaagtgtggttttcatgaatgaatctaatagtttctccagaaaatatttatcactaggtgaggttccttgaaaaaaaaaaattttaacaggattcaggattagtatcacaaattcccaagtaaggtccaacccagtgtcctgataacctatggagcaagaagtttctaggaggtaagggaagtcataattctcaccagaaggaaaaactgcagaaaataatccacttgtaatgtgtatataggtatatgattcccaaattgcggtctatttgattaaagcaaatcagtaaagaaatagatcaaattggcaatttcagttaatgaacaatcctattaaggtgcaagaggaatttagaggctgtctagatcttattcttgtttccactgtctcaatgaagttgcctcaattgacataaagatgtcaatttcatggctcactatttaataaacataaaaataataagctgagatccagtatgtggaggatgaattttacctccagcacatgaataagaaagacagtgaggcccaattactcaacaatgaatacaaagcacctcatctatgcgtagcattttctgataggcataaaatattctcagtacacatgaaggtataaattgtggttccgatatgcaaataatttactgttctctctctgttctgaggcaaatgaacaaataactctttaatacaaataacaatgaagtaaattcaaatagcttatttttctcggaatgtaacaatgttcccatatccattacttcatttacaattcaccaatagcatccttatctggaatgcagatggaggtactgttattcagagtgttatagttaagtgtctgctaaaaaaaatactcatctgtacactcatctacccaatttgaatgtgtgaacactggctttcatgaatatgtagggcaaagctcaaataccccttaaaacagccactttcacatttctttaatgttctttcccaattgatgccctaggctattacaaaaagtgaccataaatcagctgtctgcttgggaaaaaggcagacttgaaagccattcaattttcttcgaatttttttcagctgtttaaaaagtatgcaatggttccagaaccactaaagtgggtttgagtagaagaactctgccgtggtaaagaaatcacatcttactcagtctaacgttcatttttatgtacatttgatactggttctcctaacaggcaaaactcaaaggaaaatataggaatatggaaataatgtcacagaaatgcactttaattaagttatggggaaaagaataaaactgaatttttgagtaatcaaaaaataacatattttagcaaacttattcaaaatagaaaacctacaaataaggaacctgctgtcagggaacttgaaattaaatttatgtttaaaaaatatgttttttattatttctttatgctactgatgacctctatgctcatattgcatttccatttttagccaaggcaatgtagaaggactggcaaaataaattaatatgaaatttaaactttcaggaagccatggaacaacctatttttctgaattctcactaattagaatttgagaatgtcagacctccaaagactgctggtaatggagtagaggtactgaatgagtgatcaactgtgtttcccgtctctttgtttcgcttttggacaaagcactttctgaaataattttggccatttccaaattaaataaatattgaaagatgtttacaaatgtaaatttaggcttctagctgtatcagtatgaatatctagtcctattatggattagtcacacaggttgaaatgaaaagtagggttctaagctgtatcaacatgagtatctagtcctattaatggattggtggactaattaatagattaattagtcacacacattgaaatcaaaatccctttcggtaaaaggccaaaataaaaccagactttatgattgcaaaatgcctatgatggataatttcaactagcatgactccaaatccaagctttcattgttgccatgttagggaatgaaaacatgttttagttaagcagtcatatatcttcttgtactgagtcagatcttagagatcattaatctaagctcttcattttacatattgggaaactgaagctagaaaattttaattggccacagttataatgctagttaatggcaaatctatgagattatccgactcccagtagattatgtttttctattatcccagatgacttctacctatccattcatctatccatccatcccaaaccatcttgttctctaatgaattttatgtgatttacgaagatacatgataagataaacttaaaataagtgaaaaggttgcaaaggtagagtactggattttagataagtaaccactaaaattgtcctgaagaaatacacacagacaggaggtgcatattcacagcttctgcaccatttgatatggcagcacatcatgtaacactaaaaggggagcacaattaatgctagagttcaacttttaaaaatccaattacagaaattcaaatattgacataattacagttattttgaaatggagttaacccagagagttctttatttacttgtgaaaatcttttctgaaattattgttttaaagaccttacataccatgccctcagtctctgtacctaaatgcataactaattttttggtgacaaaaagaaaatgcaaattattgaatctctttctgtctttttatctctttgacttagaacactgcaggctatgctggctacaaaattaaatcaatgaactccctgctctcttctcattaagccactgattaaaatccttccaacttccaaggtctctctcttactaactactgtcttcacaatgtaagtgccaatgagatattcatctttgtttctctcacacaactatcattagagttctgtcagattatttcttattacatcttgggaataaatacatggaagtgatcatttattagccatattggtagtttctccagaaacaatttaaacatgtattgatcaactcagtcttattgacacaatgaccttcgaagtgaaggttcaagatcaaagatgtagaaggagccacatttacctttggacaagcagccagttataaaaaacatttctctgctactgggtagtactatgaccaatgtcacctgataaactttaacttggggatagatgagaacttccattccacacgatgcttggagtatagaacagcaagaaatatggatgtggctggaaataatcacttagttaacagaaggtgtattttctgattttgagttgattcatgagttgaatatatgcaagactcaggactgcatgcccccaaataagccagtatctgagtagcatctctatgcttgtatctatccagtggtgattgagaataaacattatctggctcagatgtcacaatgttatcttgttcatgtgctaagaggatccagtgtcttctagttctagttaaactggaactccaagcttctacacttgactacttcattccttctggtgcacattggttctttaatacatatttacgatgttgtactgctgaaacacctcagtttaatttatactatgctgaccaataatgcaaaataaatactactccagaattcaagtctcacttttagttttcatgagcagtacacatcatcttggactggtttctgtgttctaaacatgacatatgaatatatacatattatacatttaaatacatatatttatatatgtaattaattgtgtctcacaggatgttaagggagtcaaatttcatatgtgtgaagacattttggaaagtgtaaaagtgcccacgatgcagtgtttgtataaattattattatagaaaacacatggacaccgggagggcaacatcacacaccacagcctgtcagggtgtgggggacaaggggagggagagccttaggacaaatacctacttcacgcggggtttaaaacctagatgacaggttgatgggtgcagcaaaccaccaaggcacatgtatacctatgtaacaagcctgcatattctgcatatgtatcccagaacttaagaaaaaataaaaaaattattattataactaataatttttgttcctcacatgatgctacaaaggagagctccggatagtgcttgaagaggacaacccaatgtccatttacctgaatacattttattttaatgtcctgaaatcctcttgtccctcagttgaataggatctgtatctctcacttacactagcccctcacacagatgctgttcttgggctgcttcctattatgccagcattgaattcattttggcattccttatttagggcatatgtgtggatctcactggtaacttacaaggtaggtagcaccaatctatgtctggcattatgattacctttcctccgaccagatctcctggagagcttagtgcacagactcagggatacttgagctctctctaaattctaagttctactcattagattgtgagaacctgatttattttatcactgcatccagaatttaccactctgttaaaactacagcatataaatgaacagatgaacagggaaaaacagaccacttagcaaacaatgctaattaaaggagagaaagagagagaaaaagggagagggagagagaaagactgaatctctaagtgtaattcatgcatgacaatgctccttacaataggagtggttgtatttgtagttataatatgactttacctatggtttgtcttctatacggattaataatatgcttatcaactcctgttaagacaatgagctatcttttcttagtgcattagaatagtgggagtacttgccttttgaaatcatcttgaaatctaaaagtatgaagactgcttagtgatatgttttattttatttcatatgctgcttttgggtacagtttatgttttatgcccccagggcatctatacaggaattcagtagagctgacttaaaatgacataatcactcaaaaacctggcttatattcttaaagcatttgcgtgaataaaaggattttttgaaaataattatgacttgaaaaataattgttatgaaaatacagcttagttaaaagtgagggattcatcttgactttaaaaatagaagaaatattatacatgacacttgaatttactagaatcatcacattttaaataatcttactcttgatggtcatccactctaagctcactacatttttggttatgaaaaaggcatgattgtcacaattgctcatttataccagctaattaaatctcaatataaaattgaacaagtatagattattttctaggaatacacctaagagtgggagatgagaattgtggcaaaataacactttttcaaagattttatctgccttataacatctctagaagtaacaatgaaactttctaactggcttccacattataccccatggctggaaatgtatggtagagaaatagcaaaaagtgacattatctttaactgaaagagagaatgactgaaggttagaaggaaggcaaagctaaaaatgtcttgcaataagttggtcttcctgcttttatgaagcattcctgtcctttgagaaagcagtaagataaagcctactctgtggaagggactgagaaaaacatagttaactatcattttgggttttttttttacctacataatattcctcaactatctctatctcttacaaactctcttgcaatagtctattgcattataaatgcttttacttagttgcaaaaaagaaaaaaaaactattcctttgtaatgttttccttcaaaatctaactacaggatgaaagctttatctttttcctgaaagaggccagccataagattcacaccaagaaatagtgtaagacagaatgcactaatcaaatctatatctactgattctgccattcattcattcatccatttgtactcatttgttgaatattttcatttaataaagagttatacaggcaaggaataaaaatacaattttctgactcagaacatttagaatactgtggtggcgcatgcaatccagtttcttttgggtttggagaaggcatctatcattttatgcattaatcttttacccatgtattaagtgttcacactgtatattcaaggttgcatccccagggcctgccacagtacctagcatgtaagagacaaatatctggccaatcagtcagaaatgattccagccagtataatcagaaaaatagaagtaatttgataggaaaaataagtccaacactaccccatcatgctagacaaaacaaaagtaccttagagttttacaaaaacgtttccaaatgcaagggattgacagaaccaaagatgttctatgttctctgatacttcagctatcagctgattagaaaaggtatcaatttgaaaagcaacgagaagcattgtcatgttaacttttttggaaaatgtgactgctaccaccattcactgtaaggcaatttgtgctccttcatttttacaactaataaatggtgccagtgtttatttttctccttttccctttgatttcatttttttcatctcttcctatttcattcatggtgtcccaactcccagaggagctacctcaggaaaaaagatctcacatagcaagaaaagtccaaggagcaaatgctgtttgactctaaccaacataccgtagcaccttaggtccatgtataaatttagggaagagaattacatgctctcttccagttattattatatgattccataagtcaaagaaatctggaaatgtttctatgagtagaaatttgtgataaaggagatagtcttttttactctgctaaaatattttttggtacaaggaaggtgccctgtatataactgttgatttaatttgagatatcatgagccctgacacttgacttttagttctccaatttaagttactaagctgcctacattcgatcaggataatttgccatataatcatgaatgggtaggggaaattggcagcttttaacggttctcaaaggtaattcctaagagaggtgagttggaactgatgaaattgagatagatgctaagtgaccaggcatccctgctttgaattgtgaaattgaacttcaatgtgtaacaaatgcaggccttctatgagcagcaagttgctttttccactactgagcatggaaggagcatgaatgttggagctgaacagactggtcttaaatcccagctctgccacttactagctgtgtaaccctgggcaagttccccaacttctctggatttctttcgatgtaaaagtgaagttatttacacctattttgcatgagtattacatgtattaaattatctagacctagataggcatactatctagcacagtagctggtatatggaagatattatcatgaatatttattacatagatacaaccagctttcaaaatgaatggctcttgtagacattttcacattattctcaccgcaatatggaaattaaactttattcctagcactggactccctaatctttagagacaaacacacccttcacagagaaagtacaagtttctcacctaaattcacacatccatgtttaaatattctataaacagagaagattatatgtttgataggacagcgcttgtaaaagcacctcaaaaaatcacattatcagtatattgaaaatacaaggagcatctcttctctctagctacacgatgtaatcaagcatttgtcaaatcatatttggaggctctttgaattatgtgctccagttcccttttaggtaaagagaaggaaaccctaaattggcatggtcaggtgtgggtcagatgtacagtaccaaattactgcactgcactgttcaggagggacttaggagtatatcccagtttcctggctctccatccagttggcgtcttgctccttctactcctcctagtttcatgtttgggtatggggcagataaaaataacagcgggaataatttactacttttcccaagtttcttatacataacttgactttttaaattcttccctatgtcttactgaaattttaagtaaggcctttgaaaaatactagggaatgatgccgtcactcacagctgccagactggagagcactcagtggctggtgcaaagcccagtaaaatccaaccaaagaacacaagtgcagaaacaggacaagaattttgctaattgtcttctttgagaactaggagcttcattagagaatttgcctttgtgcatgtatttaatgagatgggatatgctgctgaactcttcctgcaggtatttcagtgttttatttagttatgatattgcctaatgacctctttttttggtccactattcagacatttttgggtcatttaaaaagttgttataaataaacatcacttacataacatttagatttctaagtgattaaacatatcctctcttggatagctttcctcttgccagccttgcatttacagtctgtctcactcaattctgacatatttcattgcagttgttatcacgcctctgccatctgggtttgtccttttccttcccgcacacctctgcaatccccgcctgccctcttcccttcgttatcattgcttagatgcctactaattaaggacaagaaagaaacctattcaacataaatataccttttatcatcatgcgaacttacacagatgtagctttttaaacagttcagaagacaaacttttcttgatgatttggtgtcatttttatgagcacgagggctggaaacacagtagtgatctcaaagagtattgctgactattctccataggtacccaagttgctcgtttactttttagtctatgaaagctcaatctagcttttgtcttttgtcagcctttatagacctctttcttccttccaatttgccccttcggatctgctttgagctggaaatccagataatcaaagttctccgtcctgagaaatgagaaattggctataaggtaaaggatatcagagaggttctcaaatgagaaagcccaggtgcatgagagcactcagtcaaggctcatggcttaaaatacacaagacctgttagtttcttccaaatgcaaagttcttcgtgaaggtagtatatttatttctaagcgaatctcagtaatattttcactatgataattttcaaatgggcttttcttattttattgagtccaagcatccttattgaaacaagattccacatttctaaatttctattttccaagatctattcaaacagaagccaagcctccttttgtgttccactgagttggctgggagggagggaaatgaagatgaagtaatataataagaaaggtggctgtcttactgtcattgactgctttgctacctgaaaaactcgaaggtacactggtttatatttttacgtagaacctgatgcagccatgcaggcatccagctgtatctatccagagtgggtgattcacctggtgtaccctgaagagacagagaaatgctcttcacggtagcatctttttggtttcctaggaccagttgtttgcttgacaaattgagaagccctggtacaggttatgggatcttacaatgctgctttccagtgatctgctgcatgggcattggagtcagacttacccaagtttaaatctggactgtactatttagagctggtagaacttgtgtgatttatttaacctctcatttgtaaatgggagggatgcactgccaatctatgcagtagttgtagggattaagaaaatcatgacagatgatatacttaacactgttcctggtgcgtgataaattcaaaataaatattggctattatcaccttcattattattttataagacatacatatgttacctccagcatgctgaaaataacgtttcttaataaagtaggcaaaaccccagtatcctaacattcacaagaggtagacaatccacttttgtccttgcctagcatattgtgaagtggaaggggaaaaagccaaacagtgcatgaagaatgcaaatgtattttttttcctgaatgttctcttttgctttttgacttttaaactctactttatttcaaaacacagtcccaaccattccaaagcatttttgaattggaaagccttctttttttgtttcataataagctaactgcaggtgcaaactcaagggagacagaccttggaaattttaagtatgttgccatggcaatggtttgcaagaatgtgtatgagtttcatcttagctttcaagcattcaactgagttcatacgtggaggttcaaatcactaggcacacaatgtttgccactcattgtgtcctgaaaggtttggaaataactatctgtgttgcttatagcaaccagaaaccacaaaattctatttatttatttatttatgcaaatgtagagatctagtcattcatatctgctcttaggtggcctatctcaccagtgtggctgctctaagagaagctgtacacataatttcaacactaatcattttcaccattgttgcaaacacagttgtactcccaatatggagtagctataaaaatgttccactgaatatcacattaatttcctcattcaaatttgacagatccttccagaagcatgataattatttaaagatgttgcattaaagcaaaatttcagtctaatgaattgtggagtatttccttaaaagtgtctcatcctatagtggaagaaagaaagtgaaagcacacaatccagtcattaaattaacaccaccctccccagaaaaagcaccagcaccggcactgccaacaaaaagacatgcaaaaaacatcattttatcacatattactaccccagtggttcttaaatggttcagctaatgcttctaaattccaaaacctgcacactgaactcatgcttcattgacagaggaggcaatggttcttgacaaaagcattcttttccccataaatggaatccatagcatactataattgggtaagttttaaagctatctattgggtacgggaaataattattaacaaattctcttcaaattacaaggctttttttcatgtaaaatgagtactaaacaaataatatcatttttaattaaataaatgatttatttaattaaaatccagcaagaaaaagctggatttctaggggtgtatgttcttcatgttttctagcgaaaacttgctgcaaatgattcatcatgatacagcagaatgccctacataaaaacatggccacaggagaccccagtatctcctgcattttgttactgactgaacccttcacaaacgcattattagctaccaaaccctggcagctatttaaaattcgcattgttgctttaactttgacccatcttccaaaatgcctgcgcacgcatgcacacacacacacacacacacacacacatcaatctctcaatctcccgtcctccttgttgtaacattttgttgacgtacttcaaaactgcagtagagcttccctgccctgaccctccattctaagaagcttacagcaatgctggaattaaacaaatgagaacacaataattagctatgcaaactgtcaactagatctaaaaagaaaaacaacccagaaaacacaacaatcagcagtttcaagccctaacaagaatctgcattgaattctcatttattttaaacaaaaatagattaggccttttgaaaaatattcagtgaaatttctatggaaataggacaaattagcctataggtctttacatctctaatttctgtgttgctgatacagtagaaaagtccaacactctttccaaataaatgctcttctactctttaatagccagatttacttccaaaggtgagtagcaccaaaaatatttccaaagtggatatgaaacaggttagtggatcaaattatatggtgtgacaccgcagttcccaactctgtccccacaacctcaccctaatcattttatcaatggtaattaaaatataaagggaaactgtaagggaaaaataattcttgaaatatatggtgtggctgggtatggtggcacacacctctagtcccagccacctggaggaggccgaggcaggagggtcacttgagtccagcctgggcaacatagtgagaccctaacactaaaaaaaagaaaaaagaaaaatatctggtgtgtttgtggtatatgaaggggagggaataggtattcaattctttgggtggagagtattgattatataatttgtagctaaatctctcagtttcttcatagataccaatcaactgcctcctcacccttcgggaaccatcctgagttctgatgaagcaacatggattatctctatgatacagacactttgaatgaatactaatctaatgcttcaattgactgttaaatgttctcttaacccatttgcatcccgtaatagaaatttggatttttttaaattgagaattgtaatgactctgtaaaagttttgttgcttcaagtcttttatctttaaacttgctgaataactgcctactttataaattgagaatgtaatatgtaatgcctgaaactagtgtaggacaagaaatagtaatctaagttttgactaagagttctatgtaacccattgacctggggcaaatcactcctcatcctaatataagtaggttagagtagatgacctttcatatttcccatgcaatgatggagagtaacacaagggagtcctgtggtaacggtagagggtaatatcttgattgtggtggtggttacaagaagctacacatgtgataaaactgcatagaggccggacacggtggctcatgaggtcaggagatcaagaccatcctggctaacacggtgaaacctcgtctttactaaaaatacaaaaattagccgggggtggtggcatgcacctgtagtcccagctactcaggagcgtcaggcaggaggagcccttgagcccaggatatggagacagcagtgagctatgatcatgcaactgcactcagcctgggcaacaaattgagagcctgcctctaaataaataaataaataaataaataaataaaatgaaaacaaaatacaaataaaatgaaactgacaaaataaaacaggaaatatcacggattcactaaaaattaaatatccatatttatatcccgaggatgctgccatttctgcccagttagctacccctacaatgtgtaatcttatttttcaatcctcaaatcctgcagaatccttatttatctgataattcaattgtgctcaatatgcttccttttaacgtcacagaattcggtgaattttcctgacttccatgtggtcgaaaaataatggctggtgacttagaaattttactgctatgtattggcttcaaaatttgtctttcaagtgacaggaatggggcagaaaaagacagtagatgccactagcagagttctggtgtaggcaaagtagaagaaaagaggcaaaacaaacaggaaataactaagcaagagaatgagcagaaggaaggagaaaagctaagaaaagagttcctccacctatgtttgggcggtggcagagtgtctctgtccattttacaagtgacatctatgatacagctatttcatatttaggaaagtagaatgaatcacgcaatgagatgtgaaataagtcttgattacagtattctagaaaggggcttaaaagaagcaaaagactttactcctggtaaacaccaaaccttcagacacagaacagaaatgtgccgttagaagatccctctcacccccatcctttaacatctttcaccaaacaaaacagggtaaaacaaactcaggcagtttctcaattactttcattaaaatgtctatgaacggtgaattaaatgacgaatctctttcagaacccattaatactttttccagagctaatactatcagtaaattttaaatagtgggaggaattattataaaagaataaaatatgtaacagatgctgaatcggtcatatgtcccagagctgctgtaacatacccaggcccgtacttcatgtgtccataacgaaaagagctggctgagaagttatgaggccacacctcacaacacctcaccctgctctctccctagtcccacagaggcacaatgcttctaaagctttgaagcctgaagttcagggaatgctttaaagatgaagtgtttaagctattttctggaagccaaatctatcattttaagattacattaaaagctacacttctactgttcatatcaatttacgctccaaactgctggtttctcagagcatccattgaatcctggtgggaggtaaatagtttctgtttagattttgacagaaaattaaaatttaaaacataatcactacatcttccatatactaagaagtcttcggtggctcatgctgtaatcccagcactttgggaggctgaggtggatggattacctgaggtcaggagttcgagaccagactggcaacatggtgaaaccccgcctctactaaaaatacaaaaaattaatcgggtgtggtggcgcacacctgtaatgccagctactcgggaggctgaggcgggaaaattgcttgaactagggaggtggaggttgcggtgagccgagatcacgccattgcacttcagcaaaaaagccaggcctggtggctcacatctgtaatcccagcactttgggaggctaaggcaggtggattgcctgaggtcaggagttcgagaccagcctggccaacatggtgaaaccatgtctctactaaaaatacgaaaaattagctggacatggtggcgggcacctgtaatcccagctactagggaggctgaggtgggagaatcacttgaacccaggaggtggaggttgcagtgaaccaagattgtgccattgcactccagcctgggcaacaaaagcaaaagtccatctcaaaaaataaaaaataataaagtcttgaaatgataaatgtaaaagttctttattttattttttgagacgagggtctcactctgtcacccagggtggagtgcagtggtgcaatatcagatcactgcaacctctgtctcctgggctcaagtgattctcccccttcaggcccctgacaggtgcaggtgcacaccaccacacctagctattttttgtatttttggtagagacagggtttcaccacgtttcccaggctggtctcaaactcctgagctccaatgatccacctgccttggcctcccaaagtgctgggattacaggcatgagccactatgtccggtttcaaagttctaattacgtttccttgtgtctaagaaaaaattttttctgcctaaggtttctaattattatagacaccagcaggctataaatatgtatatatattttgagacagagtgtgcctccgtctcccaggctggagtgtaatggctccatctcggctcactgcaacctccgcctcccaagttcaaacaattatcttgcctcagcctcccaagtagctgggtttacaggtgcccaccaccacgcccagctaattttttgtatttttagtagagacggggtttcaccatgttggccaggctggtctcgaactcctgacctcaggcgatccaccctccttggcctcccaaagtgctgggattacaggtgtgagccactgcgcccagcctaggtttttatatataaattgtgaacagtcataaaaataatttgtcctacacaagtttttgtgcctactatagactttcacactgatagaaaaaaaaatgcttacaaagcctttttctcagaggatctcatttggcagttttgaaatttacttttccacaaatctttatcagtggtaagaatgtttctgaggctgtgctgtcaatcacttatgtcaccactttccttcccacttcattaggaaccacactgtactttatttcttaaaggagaatctgaaactgatttggggaagaaggacttttagtccagagtatgcagcattgtataaaatatgtattgatataaagcctaaaaatacacacagtaggtacagcattcacatacgcaattatttagcaggttcagctggtgtgattttacaccacagtgttcttcttacgaataccagagagaaaatcaaagtttcttgacatatggtaataaatattttcacttacagtaaataatttttgctcttttggcatccattgtataaaagctagtttgaaatcattccaaattagcaaagctagaagtttggtaacacaaggggaacgagcagtataggcccccataccttcgttttcactgaagtgtgcttgcttttgagatacaacactgagaaaacttcctcattttcaagatgaagagatgttatttcttcctattgtgtttctaggactcgaaatgagcatctgtattcttcattatggaaatggaaaatgagtttgccctataattaatgctagacatgacaatttttctggcactaccttcaaaataaaaattttcaatatgaaaatctcataagaaaatctcagatgcagattcatctcaaaatccaggtgacataattcaacaaaatgaaaagcagcctgtttataagaccaattttctttaaagcatttcttttttttttttaaggaaacacatttattcacactctaaaatcatgaaatgttagacctgcgaactcctcaccttacaaacaagaaaatcaggtatcagatgattaagccattaagtcttcaccagtagatacagaactttctccagtacaatgtcttcacataaatcaattaaaagaaaatgctctaaaattagataagctccaaagagtaatctgttcacactgggacatgttgaatttgaggtgaactgatagcagttgtaagggtaaatctgaagttgagaagagaattctgggctggggatcatatagatttcccaacgaaaccaaaagagaaaaggagattctgagaccaccttcagaaaaatccaacatttaaaagggtagaaagaaaaagcaggtacaaacaaagaactgctttcctgttaattgtttttactcctaaaatatttgattgaatgtttccaagtggaaatctgaggagcccagtgaagaggattctcttaggcaattggtggattctcttaggcaattgatcgaacccagtgataaatttcccaaagtagtcttatgacacacagtgcatctatgacacaaaaactgtaaagtaaatcacttttcaaaagtaattcaccttaaaaattgattaaaattaactgaatgttaatttcttagtattgacagatatacaacggttatatgacatattcacattagggaaaaatgaacaaaaagaactctctaaaatatgtttatgacatttctagaatctcaaattattctgaattaaaatatttatttttaaaataaagcatgctgatctgattaactcccatatattacatataaaatgacaaagctgtgatatttataaatacattctcttttaaaaaatgatggagatacattcaacaaagaaaaatacaaccacaaccaaaacaagcaacctacaaattcctccccacttttgttacgtttatagacataaaacatgcattatccttgtttgaatggcatgtctttgaaaatgtcctcccattttagagtttcaaataaaacaagcatatacttttctacttaatctcatcaatttaaaccttcatatcttttcttaaagtactgcaaagagtagatgcatcatttagggattgctaggtagagtgaaataggctggagtcagtatttattttgttattgcaggagtagccttctgtttaaaatgacaccttctcttgcaattgaaatcttactggctatgtggaaaactagaaagtcaggaatctagaaaacacttgttgcagtggatgtcttaagaagtgtcctcagcttccttttctctagcctgaggttttgtaaagcaatcaagagctattcagtttaatgttttatacctaggtatcatttcagtcagttttaatgaatggttcacaaaatatcccataattcttcaccatattttaagctgcttactgagaaaataatactattgatgaccattccagtatcaagagtaaatggtttacataattattattacttattcaaaattgtttcacctaaggccagattctcatttactgcccagacccactcacactcacctacccactccatcccaccaaaaaaaaaaaaagaaaattaagagctggcgaaggaagtagaataaggcaaacaaagaattattgctacagcaatttataagaacgctcaattataccctaagggtctgagacagttatgcagttatgccaaagtgtccaatttactttttctgaagaaaaacacttagcaacaatggctaattttaatgaataaagagaatgaatacaaactaaatatgcagatgacttttaaacaaaaagttgcatccattttgcattacttttatatttcataaagcatgaaaccggcttttaagaaatcagtatgttgtcctgagaacatgtagaacaataggaaacaacccccttgactgattttgagacaagctacttgggtcctctctggatattctagtaccctcggtgtccgtaatgccattttagaagcaggtattgatattaagggatgtgtagcctacctgatttgacctgattttgtgttaccttttatttcgtgactggataactagtgctgctcaaacacaggaaacatacagcgaaataacatgaatgtatctccttgaaccacattaaactctcctttctccaagctaccttgaaatatatagaatacaatgagcaaatatattgacaagacaatgagcaaatatatattaagtaatgctatagggtaaaatagttaggccttcagtgctcctctagttttatgcctatttgtcttgaatcctcaattgaacttttaaggcagcaagtgtctcatttttctttgcataacccatgacatctagcagtgttctggcatagatacaatcatgcagtacatattttaacagatcttaactaacaatgtacaaaagcactgagaggggtgcttagtaattacttatatattttaattttcaacattctggaaagagatagtaaaattcctaaaggctaagaaacctcttggcaagtccaacagtagcttatccccggccaaatttttggcttgctatatgtacttttaagcctattagttaatagctacatgtttaacaatgttttacatagacacacattttatacaaatgttgtagtcccactacaaatctaaagagtagatgatccactcaaatctagctgtgctaatggagggatgcatggtatataattaaaacaatgattttgaagccaatggagggtaactggtccaaaaagcacatctaatcatgcaaaataattcattatgtagacagttcatacatggaaaattgagaattgactcccaaggctgtacatatgcaacttctaaataaagtgctttaaaaaaatcaaaattctatgtaaaaggtttgatctgacaataaaatggttttgaagtcataatggcagccttagttttatatatgtaattacaccttattataaatacattttattacatatatataatctatacatttgcatataaagtatttttttcattataggtaaattcatttcactggacgactgattaggaaagaattttgtctttgatatactctcccatccgagtactaaccaggatcaactctgcttagcttctgagatcagatgagaatgggtgcattcagggtggtatggccgtagactgatatactcctgtagagttttcaacttgaacgatgttaagtcagccaggtaatggcatttccccatactgttaagccttcactgtatccatgactttactaataaatttaggctgtgaacttatgtaatcatgttttccatcaaaaatctgaaataggcttagagccaagatggtggaaccctacaagactcattacattttaataaaaaagcagggggaacaaaggtgagagcacaaagactgcagaactaatttctttcgggaactgacttattttggctccccaaaataatattcaagtcattcccaccatgataaatagtttttgtctttcaaagtaatgaataaagtaatggagactttataacaaaaggctatacattatagtcatgggaaaatagtaaaacaagtatttgaatgttttttattcccaagaagatgaattgtggcttaacccacagatcaaaaaatatatagcacaacactgaaaaaaattatcattgatttttgggaaatctgagctagttacttatgattaatcaaatgaattaaaataaaggtgaaaatttgaggagcaaatggaaacgggtagtgataatacacatagtttatgatgcaaaaatataaactatctctcatatatttctgctttttaatagttgttactcagtttgaactcatattgtctttaatgtgccaaaagaccctagatatatccatgaatgtataattgtctgtgactctctccaatttttctgtatactggaaattgcctacctactccacaatattgtccttagctccattctctatgctagagtgatgagggaaggaggccttcaggagattcaaatatcagctgtcaagtaaatgtaaataagatagcagaaggtaaaatcagtctttctggtcaatactggtaactctagtgtaaattttaaaaacttaaatgctaaagaatgtataaatctaaacttagtgtcattatactatcttgaatttgcacaaagattattgtttatgtctttaataatctcaagttctgaagcaaatggatgccatttttttctatctattggtgtttgagtccataaaccacaggtaaagcaacagaggaataaaacactgggagcagggaaaatgggaggtaaaagagaagactaaataataaaaggcaccacttgatctaagtatgattaaatattcattaacgctgttcagctgtggattttggtagtgctcataatactagaattaacagcactaattttgatagggtgaaatctcatttaaatgtcattttctaaatgggcagagtataagttcttaaatatttaaacttaatatagacaaaggcctaaagtacttggctacatgcttttttcccatttgaaaactaaaaagtgtcagctaagagggcttttcctatcaattagcattctggttactgaatccatcatatagttaattgattgcccttgtaccttatcaatgcacccagatgctgtggtatgaacacatttcataaattaaagaagcatatggaagtgacacagacagtagcatttcatcccagaacatctttaatatgcgatgctacatcactaattattttgtaaatatgtaagtatttccctagttaatgtgttggtgagaagtttgcttggcagttgagcccaaatgttattgtaaccagacatttaataacagttcaggactcttgtagtttcattccattctgcccataaggagaatgtgtctcttagcctactgggcaaccttgattgtgcaaagtcaatgaaaatatttatcctttattactgggtaattttccttaatgaacagcagtctactctccataatataaatatctgtccaaagatcggtctggagactctttctaaaaatgttacagggaatttgccaagtgaggagcatattgctgcttagtgaatttttttccattaatttctaaggatagaatatgaaggaaattgcagcagaaataagttggctttattcttcaactttgggaaaactagtataatgatctgagtatattatcctgaatttaccttaaggtaccaaaagtaaaaatttttttcttcttgtctaagtcataatttcttgtcaagccaagtttcaaaagttaagtcaaaagaactttttttgagaatggaaactttctttggagaatggaaattctctacattaattaatgtattaatacaaaatccactagataactgacaagtgagctgcgggcaacccaaaagattgcatttaaacattttaaatttgtgtttctgttacattttagaagcatgatttttgtcagattaatttgcacttaggactgaaaactgtatctgggttcaactagaattttgtaagagtcattaaaatcagaggattcagaaataagttgattttcatcctccttcagtcctatgacttttctgggcaaaaactgtgtccagttctctgggagctgggggtgacagagggcttgatggaggctgctgagagattaatttcatttcagaatttgaactgggtattggtcaggctccacgctgcatgataaaatcaacaaatacttaaataaaatattcaaaagttattctgtaaatggccatctattaaaaagtcagaaggaaaataatagtagattagtttgcatggctctaaacattttcagaattgaaaacttatttagggaaaaatttggtaagccctatagatgcttgaatcatccaaagtctagtaaataagtttagtattaattgccacttttatatttcgatgctactaactaaaataatacaatagcctactgttaatttctcttctgcttttcctgagcttggcaaagagaaaaatgtgacaaacaccacaaatagacaacacaccatttgtaatctggtaaagcaacttctattcatggaatttcttccctttatgaagcgagggctatctaatttaatgaaaatagttgtcaccacagatatgacattctgtctcctaattaaatgaagatgcaatcagaacttcccttgaaaagagaggccaggcttccttcactattaagcacactcttccctaagggcaccctcctaccctttttctgatatgcaatcccttctgtcctccatctgctccacccccacctattgtctccactcactccaagcatgccaatcccatctggctatactcttgcttctgctagctctaattctccacaggcctagggaatgtttgaatgccaaggcatttttgcttttctcgagaataaggactagctaggagggtatcaaacaattccccaaggaattcacacacacatgaacatgcacatggtctctcacatacacaaacagcagtttagaatcctcctctaggatataatttctttaaaaatgtttttaattatttcatctgggaggcattttagaaaattaaaatcttactattgttgaaataatcaaaattaatatttcagaaataaacactttcattatcccagacacgcatttttttcagtaagcagaattaatgtaagtaaatgttactcatatcttatcatgaaatatttacattaatcaggtttaatcactgatcactaatacgttttctgttttagcaaacatgcatttaattcagacattccatctttacaaatgctcatgaaaatcccactctgccacaaaagcatgcatggtcagaatctaagcatatttaagcaaaaatttcagcaagtcattaacaataataaagcagtctggcaagtactgaaagcagcttttattcatgcttttacttgaactaagttaatacatatatacatacatatgcacacacacacacacacacacacagacacaagttttggttgtttttgccacaagcatgctgataaacccctgaagctcacacaaagcagcagacaaaactagaagcaaccatgctcagggtttaaggacattttaaaatttaaaacaacctttccacatttcacatacagcgtgcataaatttgacatgcaatcttcaagaagaaatattttaacataaatcttaaaattagtttatccaaatgagtttattcttattttcattattattgtttttaggcttctggtatcttaaaccctgcatgctgcagatctaagctgtgctcagcagcggctgtgacagaagaagctacctgcaagttttcacagtgccatctcatatccatgtctgtctggctaccctgcgtgcttagagcttttttcttaattcttaatggaaatcctaggaaatttagtccatcctctgaaatcaatactggtgacaggagagctccctgactcagtgggagatcaagatgataaattgcctgcgcatcagcccggcctatcagtgccctgcacacagatgggcgagaaaagacacagaaaacgctctgtcagtcacgtgtcactgaggagccaatggctgacgcactacggcaggaagggatgctgcagttccgtctgcagttgacgaggctgttggtacacagcccagcccggcaccactcaaaaagtctcagcagtcgttgcttttcaatttgctcccctaacgagaccgcataggtaaacagacctccctctaacccccgaccgaaaaaaaggcttattttcatgcacgaacattttctgtatattacattcaaatccagtgtgattgctaaacacagaggggaaacttttttttccccagcccttaaactgttatgtgtttttcttgagataattatctttttacctaatattaaattagaagacttaaaactgtgcaattagcatggaaccctcctagtagaatctcctcgaagccttgtaattgtaattacaattttatttgtaagttaatgaatgacattttttgaatgccaagtttataatgagtatttttatgggatgagtttgtaaagacaattatgcaacattaagaaatacattcttaggcttttttttttttggccaattacaactgttgctctttaaagacaatttaagtcccaataaatatgccattttatcaatcattaaaaataaaaacaagcaccaaaagatgcacatcctgtttcccaaagcctgaagaacaaatgtattattcaatgatgaaaatatgtacttatttgctgccttttctctgaaatttacaataattatttggtaagcaaagactacacatctggaataccatatggaactatatccccaaatacatctgtttccagtgatcatactgtaataacagatatgtttacacacttcttcaatgtgagatgattatatatagttatatatacatatacatacaattatatattatatatatgattatatacagtctgacagggtaggctataagtgatgagaccggtgtgtgtttcaaatgacagtatcacggagattttttttttaaagctcaaaagtagcataaaacaatcttcaggaataaaatttctagaagaaaaattaccctagccaccctggcacttttattgcttttcattgcccagttttcatactattcatacatttgaaagaattaattctaacatcttttagagtctggcaacactatttagaaaaaaagtgtattggaataaacattgataggtgtgcctcataagtaaagcttatgagttgtagaatgctgaaattccaaagctcaatttgtcttggcaactatttttttaaactaaacacattcctgaaagattgaaccctgtcaagtttttttgcaaattctttctttcattcaatattgactatcaggaaataataaagcatttttcaagttttttaaaatagatgttgtcatgtgtttttttctatttattcagactattcaataataacgtaattctcaacaaactttattcttaaaaaatattatgactcagagcacctgtcattaaaaacaaaataataataaaacatcaacactaaacctattcattagagcactgtaatagccccaaactagaaaccaccttaatcactgatagtaaactgagtagataaactatgatacagccttacaggtgaaatactcttcatctgtaaaatacaatgtggtaaatcatatgtccttatatgaagagatttctcagatacatttgaatgaaaaagccataaaatttaaattgtgtataggctatacttacttacataatacatgcatgtatacacacacaaatgattgcatatgcggaagaatttttttttttttttttttttttgagatggagtcttgctctgtcacccaggctggagtgcagtggtgggatctagactcactgcaacctctgcctctcaggttcaagtgattcttctgcctcagcctcctgagtagatgggattacaggagagtgccaccacgcccagctaatttttttttttttttgtatttttagtagagatggggttacaccatgttggcctggtgggtctcaaactcctgatctcgagtgatccgcccaccttggcctcccaaagtaccaggattatagaggcatgagccaccctgcccgacctacaggaaatttctgtaaggacataaactatcagttaatagtggccaaatagtggctacatctgaggagactgagttcaaaggtaggactgagacatagttttattaggtatcattttatacattttgtttaagtctatggtttacttttctaatttaaaatgaattaagataatgttatcgatgttcatgtaggtttagaagagcatgactggtatgttttgagggaaaatcttgagggaaaggaaggaagacagagggaaggacatgtggcctgctttttttcatgtaaagaaaatagtgtaggtgtgggcaagaagggaactgtaaaataaaggttctggcaatctctgctgaagaccttcacatctcatatcaacttgaagttcttttatctatgaatgcaaataataatacagacatggattaagagctttacaatttagagtgacgattaacccaaattttgtctgattcttccaggaacgaatgtaaaaggctgagaagtaaatgatttgtatatttacccagacatgggcaaattaacctcttcaagccttagttttctcagctggatgcaattagcaaaaagtggccaagctaaacttgaatttcaatttagggtattgttcactgctgcttcaaaggcaaaataacatccatgtttttaccaataatggtgtagggctaaagacaaaacaaattttcacgtgtttcctccccagaagcagcttatgttgtccaaaactgaaaacttggcttatagattctattgttggctcttgttgttattcagattcttgtaactttaagagatacaaacctaaaaaaaaaatgaattggccaaattaagtcaaagattacaatttgaataatttaagggttttggggttttacataaaagtgctgtaaatcagtggtttcggatggtgattttgctccatcccaccccccagggaacatttgacaatgtttggtgacatttctggttgtcaaaactggagggtgctagcagcatccagtggatagtggccaagaatgctgctaatcattctataatgtacaggacagtccctatcacaaataattatttggacccaaatgtcaacagtgctgagatagagaaaccatgttctaaatgctaaacttttctaccttctttccgaaagattaaataaatatattctgtattatgaagcatatattgtaacgtgacaagatttagatggagaagagaaggggaccaaggaccaagccctgggtttctccaattttaataagttacagaaaacaggaaaaaacagcaagtgaggatgaagagatgggaggacaactcaaaggatggtgacctggaagtcagtggtaaaagtgtgttagtaaagagattagggtcaatttgttcaaatgctgtgataggtcaagttatctgttcttcataggttttttaaaagaattaaagtgagaaattaacctaattgaaattaacagtatacttgaagtctttattgctctgcatgatatttgcatttttaaaggtatggacagaaaatgtagcggggcggtggctcacctgtaatcccagcactttgggatgctgagtcgagtggatcacgaggtcaggagattgacaccatcctggccaacatggtgaaaccctgtctctactaaaaacacaaaaattagctaggcgtggtggcaggtgcctgtaatcccagctacttgggaggcagagccaggagaatcgcttgaaccagggagtcagaggttgcagtgagctgagattgcaccaccgcactccagcctggtgacagagcgagactccatcccccacaaaaaagaaaatgtagtaattacagggatcacaggaggactagctgaggaaatatataaaggagaggaaacttctgtaactctcaaattataattctgaggctactttctctacaaaggtgggcttgtgagcaagaaagtgaacaaatcctatcttggaccaccctacaccacagcttgcatgggagacagagtgccaccctctccccttagaaactatgtctgcagttcttgtcctcgggctctcacgaagtgtctctatccatagataaggtttctgaaaacagagttctaaggactaacttcaggtgcttttcctcctgggactcctctaatgctaatccccacactgtcaggcctgtggtgttcagggttagtgcagcaaggctcaaagacagagccagctggaggactaggacactggagcagctttaagcaaagctaatgcctttgttgcaaaggaaatgttagaaatctcacagaaaaacagctgggggagggagggcagaggagagagagagagatagccataaaaagaaaagagaggccacaaaaaaaaaaaaaaaaagatgaccacaaacccatggatattattacaaactctatggtgtgggagaaaactacatgtcacaattctcttaaaactagatagatttttacaaattgaatagtccaactccttcgttttagagatggattttaatgtagagaggttaaataatttgttttaaattttaagtgaaagtgacattctttaccattcaaagcaatcagtgaacctgatattgacaaatttcaaggtgctttcaaaaatcatcatagataacaaccagggtaagacttaggggaaggaggtcgggtgcgggggctcatgcctgtaatcccagttctttgggaggccgaagcaggtggatcacaagatcaggagttcgagaccagcctggccaacatggtgaaaccctgtctctactaaaaattccaaaattagccaggcgtggtggcatgcacctgtaatctcagctacttgagaggctgaggcaggataatgccttgaacccaggaggtggaggttgcagtaagccaagatcatgccactgcactccagcctgggtgacagaacaagactcaaaaaaacaaagaaacaaaaacttagagggaggggaaaagttgatgttcagtaagagataaatctccaaagccttctctttcccatgctgatgctgtattaaggcacggagagcctttgctatcagggagaggaagtattatcttccaaaatattccaatgagtatttataggttatgaaatacaaaagaagaagccttgagtattctcctttcagaagaatttaagtggctgctgaagttttttttaaatgaaaattctcatctctatttgcactacagtcatgatgaataggatgcatggatgactttcaaaagacatatgtcagaaagtaaactccagttgacaggaactatagcatagggaaatattttggactgttttcagtttttaagagatgggaaaaatagaagtggtggaaaatccaagcagattgtcttagttttttattatttttcctttttctccttataattgaagcactactttgagactatggagtaccattaaattcctattaactattaatttaatatttgcaagtatggattagagataggatggaaattaatgtccaagtgagtaaaattccacatagtcttatattgtttttttggttttttttttctgctactgtattcttgtgggttttgtttttcttactctggttgtttatctaggtatatatgctttgtaaaaagcaaacagaaacaaaacatctgtggccccaggcaatcttttcattaacattatatcctaaaaattattatgctaatgttaaaaataaagaaattgggactcagagggattaaataacatatatatccatgaagctagcaactgaaagtctacgactacattttgaatgttctctccaaatcagaactagcgttccagaatagttgttgttaaagtttattatgcataagaaccaacaaggcacacgttaaacatccagatttctgggcccttccatggagactgattcctactctaactcagatggattccaagagtctgcattgttaacaaacattccatcttccatactttaagaaccttgggaccatattggagtttcagcttcggaattcttctttgggaaaagccatatcaacaagatttcaatgaatagaaatgggaagctttaaaaaaatagaaaggaaagttggtaggagtagttttttaccaagagagaaactggagcagagaatagcttcacagcagagaggaaaaatgcagatgacttagagccatccattaagggatagtttcccatattgagttagataaagtatgaagtattttagttgaaaatatttttgagcaaggaagattaatgtgcatagaagaaatgtacaaatcatagcatttagaataggatgacccttttgaacctacaaatagggcacttggctgaattggttcctacctccactgctgcaattagaaaccatgaatgtgcagatatacaggcaatgtcattttgtatatgctagaaaataatttattttcagaggggttttcatatgatgggtttctagacctctagagagaggtaaagtttcctttataagatgagaacctactgaagtcagatgaaaacctccccaattgcttgacaataaatcttcccagagaaaagtcctcagccatttcatgtgaaatgatgactcatgaaaatgaaatagtacactgtacagaaatcttgcaattctagtttttctcctagctgacttctaggttggaaagcttaaggtcaaagattagtggtgccaaaacatgctcattttaggctaatctctacatttcctactgccagtctctgaccagtttttaaattttctgagctttttggcatgctatgtatttctcttactttgacagaaggatgacatactattcactttgatccaacctcaagacccaaaggataaggttaataaggaactgaatctttcaggacaatgcagtttaccaaacagtagtcagtgactaaatatttttggtaactgattgatgaaagcactcatcaaaaaaccatagtccatggacaagtccatcagaagaaattaaggaaaattggaaaaaaggaagaatgaaggggagggagggaagagggaaaagaactaaaggaaaaatgaacataaaaccttacatgtagttgaggcacaacaatggactatacgagaaacttttggcttgtcagtgaatacagcttgtcaggcattatcaagtgtaaatcctcttcccccccacttttcccgctcttgataatgacccaagcaataatattttatgcaacaagaatgacttaaataagacacctatgaagaaggccacagatgacttcataaccctatgcatatgtacatacagaacccacatggagtgaatgttgcctattaacaaaactgtgaaatctgagttagaaacaaagctcagcttggactgaatatataaaaaaatcagtgaacagaagatattttcaaatggacacttacataaatacagcattccaagggaaaattccagcctcagatgcacttatttcatgaagactcaatattttatagcaatggttttccaaagttaagttgcttaagatctagggtgcttattaaaaatgcaaagtgtctggacccaccctgatctaaggaattataatttccagggatgagagtgaaaatctatatgtataacatgtactccaggtgatcctgacgtaggttgttttagactttatttgagacacacactctccaatgtacataaagtcaagaaccagattcttctccaaccatttcctgcagatagtcacaccagccttggacatgccgggtcatccaattcaattattaaacacaatgtctttcatttggagagatagaagattgataaatctagaaaaagattaggaatgatgagatgaatagattatcaatagatttcatgaaacaggttcgattcaatttgggccttgaatgatggtagagttaattattttggcaaaggcattgaggtataaaatgtttttctttaaaactgttagaatttattattaaaatgataaacttctttatcttttcagctggagggcttagcaatgcttccagcacatatgaaatcaccaataactcttagttgaattagtaaattacatgaccacaaaaaagtaaatctacttaaaaaaaacacacaaaatcccaccaccttgacaaaacttcatgatttttgttgatgatgctgttgttttgatttttatttcaaattcttcatttcttatttgtatagtttgaatagttatagtaataaagatataattttctttggttttataagttatataatggcacatacattttccatcttgatttagaatattcataattattctagtagcaaaagaataaataaaatggatgtattgtaatgtacatacctattctgtgttttttagataatggacgcatttctattctgcatttctgctttgtaaataacaattttcttcctttgtatttttttcataacataagtgaccataaatgagattactagactaaagacatagtgtttttatagatcttgaaacaatctgttaaactacttttcaaaagacttgttctaattttcacattgtctcaagcatgctatgttctataacatctttactggcatgaacatgctgtcttttctatctggggacgcccttttcccatttaaataaaaaatcttggtaaactcctacacattgttttgtactaagctcaaatgctattctttcttgcagcctttccaaatcctctaggaagagttagtcattatttccattgtgtttccatagtactttgtaataatactatttgggacacttattcaaatagctctgtgtttgttatagtttgtatatttcttttctttttcctagattattagcaactcaagggatgagccgctgtccacttcatctttggaacatcagcttctagcacaggggctggttatattagacattcaataaatgtttgttaagcaaatgaggaataaatgagtaaatgtcaatgtgatactcaagtcaaaatctgtggctgtatgttgggtaaaaatgctttctttccttaagtcttttataggtcatttagtactaggaacatttatatttttacgggtcttttaaattatatttttatacttttaatatttatatattttgtaggtctacatttttaatacctttgctgatgactttcaggcttagatagcacaattctatgatatgctgtgagtcagatctttgagtcctttagataatgacttttaggtattctggaatcagaaaatgtctttttctagttcatacagaaacaacttttgttaattaagtgttaggactagtaaataagattagaaaccacctgtggagaacacagcatgtacatggccccactgtagatggaataaatgttttaaaataactgctgataaattatttaacaaaatataatcaataattattctaacatatatcactgtgcattttgttgcattacatatattctctcattttctctctaccaaaactggtaagaaatacaaagactggacactgtggctccttcctgtactttgggaggctgaggcaggaggattacttgaggccaagagtttgagatcagcctgggcaatagagtgagatctcatttctactaaaattaaaaaaaaaattagctgggtgtggtaatacagcacctgtagtctcagctactcaggaagctgaagtgggaagatcacttgagcctaagaggctgaggctgcagtgagctgtgatcatggcactgcactccagtgcggtcaatagagtgagacctggtttcaaaaaattaagaaaaaaaaatcagaaaaagcaaatacagacaaagcaagtataccataaatgtaatttgaaagataagtaatctaacacacagaaatgtggctagcaagtggaaaaatcagaaccagaattcacatattttaagccacattttagccttcattctagtaaaatcactacacccaactgaattttgctaatttcaaactgagaaaatgagatctgacgtcgtataaactaaacaggtgttttaaaaacaaacagaaacttctctagcaataaaaactttttttccaaaataatgcttatgaataattcaatataaaaaacaatatcagaggactcatattgaagtgagtggccagtgaaggggggctcctttctctcctcttttatggctcttggtagttcctagagcttgcactcaggaaagcactgtattgggccatttctttacttagtcattcagtcattaatacatcttacagcctaactaggtacaaagaattgtgggaaagataaatacaagacaaagtcctttgagaacacacaaacacacacacacacacacacacacacacacgatagtatattataaatgccacagaagttatattgcatagtagtaagcattctgaaagttcagagaagaatgatgtctagtcccataccctggattgagttccacatgtccacctaaggacacacagattttgtttcttatttggtgacttggtacaaaccatttaatctgcctatttgggcatccattcctgagaaataaaagtgatcaatgttgccaatccaatgcatgtaatatgtgactatagggagagaataacttagtggagagaatggggcagtgaaatcagacagatctggttttacagctttggcacttagattgagctagttagttcaacttctctaagtcacagctgtttcacccataaaatgagagtaacagcaatatataccttttgaaaatttccataaggtatcaataagataaaatataacacctagcagagaaactagcatagattcaatggtcaataaatagcagaaatccttattaactattaagatgaagaagttacatctaggatttgcatagactattttgattctacgattcaataaattttatttttgacataactcattcaccgtggaagaaattagtgttctatatttaatgaagaccaaagactttggcttggtaaatactattcttagaattttcctccttttcaagctgtatagattcatgtgaagcctggaaaagacgctactatgttttattttgcaatgcactagattttgcttgtactctttagaaaatgttaggctttatttcagtcgtcatttgtgcataaactctagtcagatcaagcaaaaacaatgaagtcattagtgtgcactgagtttagtcacttctttaaatgctacattaattgctttgagattctctacttccactgtgacaagcaagacaaatggagtttacctgcaggacacatcaccagtcaccttcccagcaagctggctacaacctcatctgctccttttcacttaagaaggcatactgtcatgcaaatgagtgagaatgataacacagacaaaatcttgaatctacattgcttgatatttacaacaaaaaaaaaatattcactcactttggaagttaaaccattattagtaatactgacaacacatttcacattcgatggggccataccaatatgtaacaatttatggtacagaatcacttcatggtatgacccaaggaaatgtacttcatttgtggaataattaaaagtccatcctttctgtgaagaaaatgctttatactctgaagaccactatcatgaattaaaaaatccagtatcacaaattgtagacaacctaaaagaatgttaacttaataatatgtgacttcgatctaaatgaagtgataaattggccagaaactcagatgccacagggcacatatgttacataaataatcacataaataatctagcatttctctaaagcagcgattctcaattttggtcttagatcttattgtcactgttaaaaataattgaaaactccaaagacatacatattgtttatgtagattacatatgtggatatttactctattagaaattaaaggtgataaaagttaaatatttaactgatttaaaaataacaataaacccattaacataaatttaaaaaggaactacattttcaaaaacatacattttaaagaaaataatactgttttacatttttgcagatcttttcaatatcttttaaattagaagactggggctcatatttgcttctgcaatctattgcaatatttcatgtcatgtagtctttaaaaaattccactgtatccttatgaaacaatgagaatgaaaagggtaaagttttttctttttttgttgacatataataactacatatttatgagatacagagtgatattttgatacatgcatacaacatgtaataatcaaataagtgtaattagcatatccataatctcacacatttatcatgtctttgttttgggaacactcaaagtcctctcttctagctttttgaaaatatacattaggttgggcatggtcactcacacctataatttcagcactttgggaggccaaggcaggtggattgcttgagcccaggagtttgagaccagcctgggcaacatggcaaaaccccatctctacaaaaaatacaaaaaattagccaggtggggtggtgcacacctgcagttccagttacttgggaggctgaagtgggaggaccacctaagctgggcaggttgaggctgcagtgagccactgcgttccagcttggctgacagagtgagaaaaaaaaaagaaaatatacattaaattattattaaccatatttaccctgcagtactatagaacactaggacttattcctccttatctaactgtaattttgtatctgttagccaacttctccctattcttacttccccctttacctttcccagcctacaattctgctctctatttcaatgagctaaatttctcttagctcccacatatgagtgagaacatgcagtaaaattttagtattattttgaaaataattttgacctcactgaaaaggtcttacaacactcctttcccctgtcctaagccttggcctcccaagacttctagatcatattttgagaaacactgctctgtttttataatatttagagcatatattatttattattttttgtgtctaatttacatatatgtcctattgttgtttccctatttgaaattttcctgatggagatcatcattacaaaccttaggtatcactttacagcatgtggtaagcctgcctggaaccacagtgtacctcaacatgtaatattgattcaatgacccattgatagattgaagcctatagtgtcttatggtccctttaatgacctttaaaatatgtgatatagtagtatttttatagtttgtcaaattttgagcccattatgtcaacattctacctaaatagaaggatgagctaatcatacataaatttattctagatgaaacaacgtttttttttttttgactcagctgtgacttttggaaaagaaactagaattctagagaagttattattatacatttttttcctataaaatttatcctaacatatcaggcaatattttaaggtctaatcaatttatatatttagttgtaatttcacaattacaaaacaattgaaagcaaaaatatgaaaatcatcagtttgaattgatttgaagctatagtttcctatgtctatgagtggaacaaaaaaagtaacaaatattacttttatgtgttctactgccaaatcagatcctttgaaaggcacccacttagtaacttggaaatgaaacatttatacattcatccctgctaaattgctgcaaaatgtgatggttgggaaatatatattaaagagtgaaacagtcctcctaaattaaaggttttcttacataataaataatttctttgactctttgaaaatggttccattatctcctgatctaggaaacccacagagaaagacttagtgtctgccattaccttggtaatcagataattattctgactattctatcagaaaaaaaaaaaactgtacatactgaaaagaagactctttcctgctaaaatctgggtaaacaaaatagctgctagactgggaaacaaaaagaggggtcacagatctgagttgactcttcctttttcatgagtcataggacagcagatatactagttgtcttttgctttcagaagagttttacattacctaaactcatggctgaatcacaaagtacatggccagaagacttagtgacttagtaacagagttctcttagacattttaccctccttaaactaattttggtcttgacacagttaactattaaaaaaaaaaaaaaaaaaaagccctgaagcctgcctattcacctctgatcactgagaatgaattgaattatcaccgtacaaataaatttgggaagcaagataatgggagggaaaagagatgattaatatttgaactgtaaaggatatatgtctgaaatttaattattaacaaatgtgcattgatgcaattatgtaccattacatagcagagttaagaaatctaaattaagtaaattgcaaatgctataactaaacttataacaagttattttaaaaattaaaactctcatcagttgaaaactatatccaacagaaatcaggcaggaatttctaccacctgttcatatgcatgtacagtgggaatctgaagcattgcccagcacaatgtggcagccagactctagattattccatttgagttctgagtaactgtaattgtatgctattttaagcttatgaatgctaagattgtttaattcttaataagctgataggtagcccttaattgcatgatgaaaatccaagtccaatggcttgtgtgccacttgcctataaaaagcaaataaaggacttacatttctggttcaggttgtaatccaccaagtgaaaccttggggtctttaagctaaggatctttacttgaaaatcactgttttatagcttattaaatttccatgtcaaaaatatcaaagaagtcattcaacaaacatgtattgggtctactaagtggcaggtctctttaggactctgcagatgcagtagtagcaaatgtgataacaaggctctaagtgaattcatcttctatttgaagaaagtcagaaaaccaacagccaaccaacaaaccggtcaatgcactccagggaaagaccatgaggagcatacctttacttgaacaagtgagtttattaattgttgtagcaaggaagaacacacaccacacggagccatgaagtatcttagtaagatactaagtaagggcattagtaaaggcatattaaaaagaattcaggcttattcggtgattctggggagggtttaagaaaacaggactttgttctgtactggatgctgccagaaagtagaagcaattctaggattggatagctcaataaatcttatctatagcaagagcagactagagtgagaataaagttatgattggtaggaaagtagtattcaacttaaccaataagatggtttgacattttgtgggttatatagtgacaccaatttttatctgttttttaatgaaaaaatgacatagcattattttcactcactttattatggtcttagtgtgactgtgtttcatgttggtactctatgaagttatttctctctaatgggtgaacaatatcatctacctgtgggctccaggccagcttctaacaatgctgaggcctcacttacggattagatcagttcccagacaacaggggctacttttccctttcaatcatgcaaccagccaagcaataaatttaaaaaaaaaaaaactatcaaagagtgatagaacatagtaaaagggatggccctttatattgggtgttcagggaaaggctgttagatttgaacaatcagaaggagccaacatatgactacagggggaaaaacatttctgtcccagtgaataactactgccaaggccctaagataagaaagagtctgagcatcaaaagaaagacagtgtgatctaagaatgatctaagagcacagcgaggaaagacaaaaggaaggagggagagccaggtggccagatggaagttgtgtagggtaggtagggtattgtgactttattctatatatgataggaaatcattgaaggttgtaagagcagaataatgacataattttatttatatatttaaaagatcatcctgtatgttccatggagaagcagagatgtgagtcaggaggttttgcagtttaggcaagagataatagtggcttgccacaggtattggtggtggagaaggcagagctgactgttctgaagtcagtgttcataagacttactgataacatatcagtaagtaatttgggaagtgaaaagcaggaagaaatgagtgaaggatgatcttaatagttacttggttcttaatgtcagtgataatcttattcatcatgttattcctaatacctgattcacagagggcactagatatagaatgaaagaataccttttgtagctaatgttggcactattagcaagcttcaaaagtatctgcatttattaatctccagttggggtttggttcctaatttcttctgttgatttgcagttaactcagtggtggtagcaaggtacaaaataccccaggactacacagaacaacacaatcaaggtagaattgacacaaataactcctaagaaaatgtttcctacatatagagtaaataatttactaaacatgcttaaaataaataaatttggaaaaaaataaaataaatagaaaacttcctcaaattgataaagaacattcttaaaaacttattactaacatcatatgtaatagtgagaaacttgacacttctccactaagactagaaacaagacaaggatatctccctttcaccaactgtttcaacatcatatgggaattactagctactgcaataagacaagaaaaaaatagtaggaatacagattcagaaggaagaaataaaactatctttgcttgcaggtgacacaattgtgtatgcagaacatctgaaagaatcataaaaacctcctggaactagtaaatgattattgcaaggtcacaagatacaagtttaatatataaaagttaatctctttcatatataccaacaatgaacaagtaatattcaaaataaaaaaaacataataacatttacattagcacccccccaaaatgaaacacatagatgtaaatcaaacaaaatatctaaaaaataagtagttttcttctatataaggagaactacaaaaccttgaggaatgaaatctagtaagtaaataatggatagaactaaataaatggatattccatgttcattattattgtcaaaatgtcagttcttcccaacttgatttatagcttcaatgcaatcccaatcaaaatcctggcaagttattttgtggatgttgacaaactgattctaaagtttatatggagaggcaaaagaactggaatggctaacaaaatattgaaggagaagaacaaagttgaaggactgacatcatctaacgtcaagccttactataaagttataacattcaagacagtgtggtattaatgaaggaataggcaaatagattaatggaagagaagaacccagaaacagacctagataaatataatcaactgatctttgatatagagcaaaggttacataataaagcaaagatagtcttttcaacaaacggtgctagaacaactagacatccatatgaaaaataatttagagacagacaattgacaaacattaactcaaaatggatcaaacccttaagtgtaaaatgaaaaaccataaaactcttagaagacgacacaggagaaaaacctagatgaccttgggtatggcactgactttttagatacaaaaccaaaggatgatccatgagagaaataattaatgagctctacatcattaaaataaagaaaaaacttttggaccgggtgcagtggctcatgcctgtaatcccagcactttgggaggccaaggtgggtgaatcatgaggtcaggaaattgagaccatcctggacaacatggtgaaactccgtctctactaaaatacaaacaaaaaaaaaacaccccaaaaacaaacaaacaaacaaaaaaccaattagccaggcatggtggtgtatgcctatagtcccagctagtcgggaggctgaggcagggaaattgcttgaacttgggaggcggaggttgcagtgagcccttcctgcctagcaacagagtgagactctgtctcaaaaaacaaaaacaaacaaaacaacaacaatacttctgttatctgaaaaactctgttaagaaaatgagaagacaagccacagactagcaaaaaatacttgcaaaagacctatctgataaaagactgtgatccaaaatatacaaagaactcgtaaaactcaacaatgataaaacaaaaaaagggccaaaatcttaacagacacctgaccaaaaagagatatagatggcaattgagcacatgaaagatgctccacattatacaccatcagggaaatgaaaattaaaacaacagtaagatatcattacacgcctattagaatgaccaaaatctggaacactgacaacaccaaatgctggcaaggatgtcaagcaacaggaatgctcattcattgctagtagaaacgcacaatttcacagccattttggaagagagtttggcagtttctaacaaagctaaacatacttttaccatacaatccagcaatcactctgcttggtatttactcccaaaagttgaaaacttacgttcacacaaaaacctgcaaagagatgcttatagcggctttatttataattgccaaaacttggaaccaaccaaggtattcttcggtaagtaaacgggtaaataaatggtggtacacccagataatggaatattaatcattattttaaaaaatgagccactgaaccataaaaagacatgaaggaatcttaaatgcatattactaagtgaaagaagccaatataaaaaggcaataatatggtataattccaaccatatgacattctagaagaagcaaaactacagagacagtacaaagttcactggttgctaggggttttatggataggatgaataggcagaacatagaggatttttaggtctgtgaaaatactctgtatgacactataataatagatccatgccatgatatatttgtccaaatccacagaatgtacgacattcatgtaacctctggcctttggttgattatgatgtgtcaatgcaggctcaccaattgtaacaaatgcactactctagtggagggtgttgataatgagggaagctatccatgtatgggggcagggagcataaagaaaacctctaccttcctcttaattttgctgtgagcctaaaactgccctaaaaattgtcttttgagaaattaaaagacatttagaaatcatggaaaaaatagaaaaacgtaaggcaattgctcatcatagcagataaaaaatccaaaggttctgaattctgtcccaaaataccctcaatagggtgtccacctttacctcattaacttatttgaatggtacatttgtatctcttgaagaactcttagaagaactggctgtggtgatgttttctgccttctgtcaacctttcaaaatcacatgcccatcagatggcattctcaaatttcctgccctgtaccccaagagaactgtcctcaggaacaatacagaaactgcctaactaagtatagtcaataaaccactgcttcagaatcacaccggggatcctctgtttcccttcacaagcagagtctctcaggaagcagtaatgaagcatagtacgggggtgctcctccttaatgcctatgaagactcataattggaacccaaacttgctcttcaatgtgttgatgactctgcagacaaacctgggcttctctggtgtgctttcttattgtggaaaccaacaggtcaaaatattaatatgtgcaggcagaaataggtgtagaatataagcaagaggcctctttctttctctattggtatgtttgaagcaatatgactaatagacgaatccagtctgttttagaggtttagtttgggaaagtccttgtaaggcattaaaggagtagttttaattcacagataatacgacactcagatacaatgccagaatatccaaaataatttattgcattctacacccatggattcctgaaggttagagtatatttaaactacaccggtaagagttgttgggaaaaatacaagtatctcagagatcacatggtcacaacctacctataaggacctcaagccatgtaaaaacatcacagctgagggaactacttcaaggaaacaaagacagaacatggtcatcctaaaccccagaggcaaacttacagccattaaatagactcctttggccagtcatgctcattcattctcatttaaaataattatttgatgatacagtcaaacaagaaagtattctgctttttgtaaggcaaaaggtgagagtgaatttctagaagttaataaacaggttggtagttttcttccactttgctcataacatcatggaaaaatcactgaagtgtgagaaacaggattctgtcacaccagtgcctcacatccaatgctgcgagagaatgaaatattgacaatttaggtgtagttctcataatttcacccaactcaaaggaatgactgaaacactccttgataacaagaaaacacctgaggaagggagagaaaataatcattctctccaaccttctttgcacctttcgatttcatatagctaaggatacacatttctcacagtgattgaagagggtggcaacatctgtcaaatctgtagagtcaagacatgaaattcaattttaaattctcagtagaggagaaaaatgagagaaaggtaacttgtaatttcttccaattagatatacaggaataactaattgaaatgaatgttttataaaaaaccttcttttactttttaaaaactgaatttctacattttaataacattgtcatgtgtaattataggggtgttgaaattttgtttcctcttttctgagccctaagtttgccttctgagagaaaatcttgaaaatgtagtcatattttaaaaagtggtaaagcctactactgttcatatcattttcaaccatcagtagaccttaaagataggaaaagaggccgggcgcggtggctcacgcctctaatcccagcactttgggaggccgaggcgggcggatcacgaggtcaggagatcgacaccatcctggctaacatggtgaaaccccgcctctactaaaaatacaaaaaatgagccgggcgtggtggcgggtgtctgtagtcccagctactcgggaggctgaggcaggagaatggcgtaaacctgggaggcggagcttgcagtgagcggagatcccatcactgcaatccagcctgagcgacagagcgagactccgtctcaaaaaaaaaaaaaaaaaaaaaagataggaaaagaaagaaaatagcctgtacttcaagtatgaaagcaccatgctggatagtaaaaaaaaaaaaaaaaaaaaaagaaaaaaggatttagagagcctaagtgtatgccccttgggtctcatgactctgtcaaaatgacagggtgatttccagaaattcattaatcctttcaatgaatatttactgagcatccacagtgagcagtgatctgcacaggaagctaggagtgggatggggtgagtatgatgtacaatgataaatgagacacagaaaatgcctttgaggaccttatggtgtagaaggggagaacacatactttctcctaccttgtattaaaattatttgtgtgtgagagtcatgagaagtataaataaggtattatgaaagttcacagaggtaaaaaattaattcttacagggaggaattgcagaagtagaaataactgtctttgcctggaaggatgaaaaatctcaggacatgtagagaaggtagaagaacattttctttgaaagggatgggataagcaaggacattaaaaagatagcatggtgtacccacaaatcattcagtttacctgaatcaagaggaggacaggaatggaaaggaagattggggatttacatagtatggtaggctaaatccatctactttctaatctctggaatttttaaataagttaactgacatggcaaagtctttgtaggtataattaagactcttgagttggagatattatcctggattgtctggtgggcccagtgtaatgacaagggtcctttcaagtgaaagaataaggcaaaagaatcagagtcagagagagagctatactaatggaagcagggatcagagtgatgcaaggaaggggccataaactgaggaatgcaggtggcttctagaaaatgaaaaagacaaggtaacatattctcccctaaagcctccagaaggaatgcagctgccctgcccatccatgctagacttccaacccctagaactgtaagcaaatttatttgtgctgttttaagccactatatttttggtaaattgttacagcaacaggacacagatatagagtggaatgttttgaatatactacatcttagtccaaataattatttatccattctctcttggtgtacctcaacttttacttattatttcattacaacatttatgttgtattttttatttttataaaatatatttgcctgtctgcttcgtttgagttataaagaaggtgaaagtactactaacagaatacagaaaacccacaaagagaaaaatatttaaaagcaagatgctgaaatctttttcgaacacagtacgtttgaaataccaatgggtcaacacggtgggtggacagttggagatggaaattcatgcctcctgcttgaagataagagcgcatatctcttggaagcaattacaaaaatttattatagctcacaaaagagaatcattgaagtgtgactattgaccattgggaaaatttaaatagtatgtattcatgagaagggaattatttaatcagggtattttgacataggttgctggaagaagtgattttatattaagtattattagctaaaatattatcattttaactacctgtgattacctataggcaaggcataaggcaatctactggagatgaattcacgaatggagaaaaagaccttttaaagaaaagtatgtcatctacaagtttcttggtttttgaaatatctctagcaggacattaatccctcaacttctcaagtattttctgagtatctactagtgcaaggtaaggtcctttattcatttttatcctaacatagcctttggctttgagaagcttattgtctccttgccatgtaaagttgtgtacttcctcaaaatactagaaatttagaattttcctaaattatgattttccccaagggtatataagttttaagtctcaaaagcatacatggcctatcttacagcctgttcctagagttcatctctctaagatgagtctgaggtcactctctgcctgggaatctgaggaagctgggccgccggggtgcaagggagacttcacatagggaaaggaggcaaggaaggcttaaagtgagggcaataaaaataacctttacctgtttcaagtcttgggttggcccagactaccaccacttcagggatttttataaaatgctgctgcattgcttttgctaaaagagagccaggtcagcagagtgggatgacctttcccaacagaaatgccatgatgtttagccatcaagcagaaatttcagggacaataagatactgtagtctgcatgcttttatcccaaagtgaaaaccatagaggtcaaaaatatgagttaagggaggaaagaattaaaacttttacctgctctaaactctgaaaagatgatggtgtgttcatccctgaaccttgtctcaacacaatttcagagaactataaatgatgcctcctaacagactactatatgacccgtgactcctgaagtagtacaatgagaaggataaccttcaccacttgcaaatcttaatgcccatgtatatacacatgtacatatttttaattgtaaaatgtgtgtaatgaattcccttcaagatagggaggatataatttcccataatatgtacttggttgctttttatatttttttagaaacgtcaaacttttttcaaaactttttttggaaatacccagtatttttttgctacccaaaacacatgtgaattggagcatacttctttatgtaacaattaaaatgtaaaatgaaccaatttttgctgaaaaaccaatctgaaatgcagtattcacttccctgccttcttaatcaaaggatgatggacataatttaacctttttaaaaaaaataatgtcatggctttcattattatgaatgataattattctacgtcgctgcgatacacagagacccttagggattgctgtggtgtatggagcttcttgcctacacgaagtagtgtaggtgctttttgttttttcattttgagccagctgttcataaatttttctctgtcttttctcactggcatgctgtatgtgggttgccttttttactactgtcgttgtagtcagtcttcctgcttccatcaactcctagccaaacaaagcaagacattcccagtgtgccaaagctcaggcaaattaccttgtactagcattttaggccgatgcttctcgtactttagtgtactacaattaatctggggatcttcttaaaattcagattctgctttggtagctctggaatgggaactaaaaatttgtgtttctatcagcaaccaggtgatgcctttgctgctggtctttgcaacacaccttgaatagaaagatattagctatcatgactttttagaattgtgtctagattaaaagaaaatttgttttgagggagtgattggctactctcctataaataagatctaaaaatttagaatatgaattttaaatatgctatctccaaaatgactttccttatctttatatccctgacaccaccacataaacatatttcccttctctatactaatatagcatttaatttcttcctctcttatggaatttatatatttataacttattatttagatataagtcaagtactgaacatgaagaggaaccaagtcttacatatctgtattttttgaaactataccttgctcaaaaatggttgttgaataactgtagcaattgaaagctataaggttctttccgtataatttcatattctttgttgcatcaatttttcaaataagtaatcaggaaatgagacaatagtataataaatcagtataaatttcaaattaactgttaagaaagtaaaacatgttttcagagttcctgcctctttgtcgtatacttatttcttcaatttgcctcctcccaccacacctcatagaacacacaaatagatataaaagcacatacaatctaaacatatatcatcttcatattctttaatttctaaaaccttatttcaagaaagggcctggaattaacttacactaaaatgtaatgactaactgcagcataaagtatatttcctaccttcaccccaagaagggcttaaacgttttaatagaaatcaaagcctacatagtggaatgaagctgtggaagaagatttttcggtttttaatcataaaacaaaaggtatattaaatagaacctctcctaatactctcacattgggtgatgtttgcactgaacttcccctaactgagaattgctaatccacagctttcctgcacctgggctgtaaagttgctacatagtgataaactgcttgtatcctgatatgatgaactaatatgcacagaaaatcctcactaaaagtgcaagctatagaaacagtcaaggctaaagcagggcaaacacaaaagtcaatttggcagctcatttgaatctacattgtgcttctttccaatggcagacagaatttatcatctactggaaaagaataaaacaaagccccaatttccattaaacatttgtgtaataaaaagaaatggaaattatataactagagataattcaaatatgtaaataaaattgtcaatggaagcagacatcatcatagcttttgagttaatattatgtgatatccattttactaatttcatccagcacacaaatttgctacttatctcacacctctaattaaattagtggccacctacatgaaattcagaatgcactcaataacaggtgcttagaaggaaaaagtgaggcataaaataagatagtcaacataatttacacagatttatataaagttgctctgcatcaacatattcctaaacaatagagattaataagaatatgactctagataatagtcccagagtctagagtcatttctcttgttaacaggatatcaatgtggtgaaaagtgtacaaagggtatctggatctgcctttcctgactctgtagattgttcgctgtgaaaatggctaggatcagctgagaaatctgagcataaaactggtgagcaaggcaggctggaggtacagatgagttctggctgagatgcggtgcagacagctataaaatgaagttcttacagtatttgctttcttggtcatccaggggttgttcaattgtgaaagtcagacaacacggccttaatttcagataagataaaagtcataaaattgttattttcttcccacaacaaaacaaacccaacaagtcagcatattttgctcaaaaggaaagagagaataggtactagcttggcagtgccttacaaatctcagaccattgtagtcagtggctttagcatcaaagggacctgggtttgaagtcacagcccaagaaagcatggctgagctatttaacatctctaatttcagatttcagtgtccttatcacaaactgtggatggtaatctttatctcacagagaggttataggataaataaaataacatttatggattgcttagcaaaatgactgctcaataaatagtatttataactgcttacattgaagacaatcatactgaagtacaaattttatgatcccttccagtttatctgaaaattaaggagatgaagtgaatgcatactaaaattctttaatcaccaggggcttaaatattaaagtatgtaaagcatttagggggtatataaaagagtaagctattatcacagtgagccacagaatgtgttaagaagatagactctggggccaaattatcgcattcacatacctattctgctgctgcccagctgcgtgctttggatgagtaacttaaatgctctctgcctcagttttctcatatgtaaaatgagaataataacatttaatttttaaataaggtaaaaacgaaatgggttaataaacataaataagagattggcacataccaacttctacgtatttacatatatatgttttagagcacacacatactgttgtaaacagaccttagactgataagtaatttctgcctcctatatctacatcttattggaattttctccctttaagcgtggacatgacctgtgacaggcttctggccagtataaaatggcaaatgttaggctatgttataaagactccatcttaggagaaaggagtgccagactctcctgctggccttcaagaagcaagcttcttgatgcaagctgctaatggagagggtcctatggcaggcagcctctaagagttgagggcctcagttctccaaccagaaagaattaagttttatcaacaaccatgcaagcttgcaagagggccctgagctctagaaaggaatgcagccctgccaattctgtgattgtagtctagtgagagccaagcagaggacttagttaacctgtgccccgacttcagtcagaccacatgaactgtgagataacaaatgtgttgtctagagcttgtaagtttgttgtcattcattacacagcatagaaaactaatacacatacttccatatagaattcagagaaaagaaagggaggaaacgaaaaagcttattttctcagtgctctgtcttagtttcaggctgagcagccttgacctggccagtcattgctgagtctatcattgtaaagtacatttaggacagaaagatcttactctagtcaagatttctcctataggccctattttagcctctggccttcatgaatggcaagaatattaggatgtcagtgatagttgtttttccagcttcagattccagttaaggaattttagcaaaacaatatgaactagaaacctttttgagagtgggaatgagagatcaaaatatttgtcttttaacgtcaaagtttactaggttttgctgacaaaactaatcttatgtattactggctttctgatgagcttctgtcatccttccctcatttttctgccctgctctgtccgccattcccgagaaatagactaggagtcaagggatctgtgtacaagtttaagcttggcttgtagttagttgtatgactaaagatgataaagatgagccagctcaactctctcttctgttgacctgaaagtgttgggatgggggaaaatagatgaacaataaatgaaaataaagttcttgagaaaagttacaagggcagaacaaatacatgacagtaatgttacaaaacagtcttgaaacctcagaggaatctaggcaactcttaaaaagcctcaagccctttccaaagtatgaacctgcttatgatttagagtctgggccaaaagatttataggatttgagaaatgagaaataagtttttctctcttagacaactcctatataaaagcagtggttttcgagatagttatgttctaaggcttggtggatgagaataccctgattaattatgcatcaatatggaatagggtccatatataccacttctgtcattagtcccttctgtacctacaacaggtacagagatgagagatcagaggcttggggaagagaaatagcttgttaagattatagagctagttactttcagctgtgggacataattacaaaggaaatttgtacatttggttattcttgttaagtatctctatttgtaatgccaaacacaaatttttgctacttcaaaagctgttttatttcttaaatttgtgatgtctctattatattttgccaatgtgaggaaatgagtgtctaatcttgtcaatgtaatatttattctcaattcctgctatattcattcctcctaatttgaaagttgataaaatctgttggcaacctccttgaagctgcaaagcagttactcaaaacaattttcagaatgttcagtataaatgggcacatgaaccattcttgaaaaccgatgtgcctttttgcttcacatgtttaactaaagtcggttataaattttaaaattatttatttaactttttcacatccttgttttaaaatttccataccataatacagtgttctttcaggatcacatgtgaaatagataatatttccaacatttcatgaggagctatggggaagaaatgatgagcaattccataaggcactgatagacataaaataagagtacatactttcatgtcattccagatagaaatatcaaagatggaacattttccttccccttgacttaacagatgcccactctcatttagaactatttcctgacaatgaaatctagttggagagatacaacataataattcaaacacattgaaataagttttgcactgaggtaaaaaagccacagggtatgaaaaggcatggtgtagttggtgaaagggaggtgaggtattacttgagtaaaaagtttacattggtggggtggcagagataaaagaagatggagatagagataggcaggagttagatcatagtgaaagtcttgtagttattttagggaacccaggaagcttaaatctatcaatcaggatagtgacagggtcagatacatattgtagagacactcttgtgagtaaggaaagactcatttataataaaatatttgtggtagtccatatgatttggtcattctgcaatacatttatcaatatctcaaaactcacaagaacatgtaagcaaaagttaaggtatatatagagagagtggaagaatctttagtattctctggtgtcaatttgtatgtgatttttaaaaattgtttttggaagcattttattttctgtttagtggttgctgtagttttcttgagtcttctccctactgctaatttaggctatttggcatattcagcctcatggttgcaaaactggggttttaatattaaaacttccattgttcatttagatttttccttctgaaaatttgtagaattattcaaggcaatcttttatatacactttctaccttcctttgcctcccaaatcaacaacctgaaggtaggccgaattaatacacactagttgtggtaataatgtagttaagttgacactgtgagctgtggtctaggcagagaatgttacgtgcagagcttctattgtcttctttctcccaaacacagtggtaggttattcacattcattccttgctacacgcatctagttaaaataacttagactttttcaggaaagacaaactgaggccaaaagctattgctcatctcattgctaaaactctggcaacattttctgaattccacagatccacagtttgagaagatgattgtttaacttgtggcatcatgagggcccaacagtttagaaaacagtgggacagcctgttgccctgcagccaggtgataatccacagtaaccaaaataataacaaatattcatgaaaccactgtctttctttttcagctcattattgaatatttgcactgtatttattatttctgctgcaaagaaagtaagaaattaccaaccaatagatcatgttcttatcaagtgccaggcaaaaataattcttataactacacactaggaagagagtaggaaactggtaggaagggaccaaaatgttatacaacaaaatactatgcacgacaaagatatggtatactatagaaagcagattatttttaaagaagcgatatagacttttctgcaaatgttaaaaattgattcttattacttgagaggaagacaacttgctccaattctaaaatggctttaaatcattttctctttttaccagtcaactgctttcctacaggccaataatagcattaccaaccgggacaaccatgagagtctccttactcacagttgtccaaagcctttaggcttcatactgtggaatgtatcatctactttttaccagcattatcttccagaacctagagcaaataacttctcattactactaaaaacaaaacaaaagcacaaccaaaaacaaaaacacactcttccagagcttcccattacctagagaattagtctaacctcttttatagagtttttaatattctctaaacatctgctcaaaattattcacttccctgcattctaattaccttctgcaccaaattctacagttctcaaacacactgtgcatcttcacaatctttgctcatgctgaagcctctgcctcagacgcatttctgctaattctccatctgacgataacttactgcccttttaatgttagcatttttgccacagttagatctattaattttattggaatcaactttgccctatagagaggtttctgaaagtataacttgccaccggtgtccgtgctattaaaaacactcatgcagagaatgcatgttgacacaccttggttgtctacctcatcagtgactaccattgttcttatataacataaatcaatcctcagtaagtatttgtagacatggaacttcctcagcttgttccctttctctttggtatctcttctctccatcctcaaagctcataatcaatggccaattaattcctcttgtttcggcaatgttcctcttgcctacacaatattcccacttccattaccctagttctaattttcattacctccttcttgaactaccgcacttgcttccttagctattgctcagcttctagtctctcccttcttaggccattttgtagtcagctggtgaagtcattttcccaaagcacagctctaataattccattccctggcttaaaaaacatcaattgctctctaatgcctgcagaccaagtccaaactccttagcaggttttctatcatctgcccaccatttgcctttgcaaacttttgttatacattcccattatactcattctgcatgccagtcattccctgaggcattctgtggagtctctcccattccctgacctgatgtatgaattctctcctttgatctcttaggttactcttttcctcaacattgcctgttgatatacccacctttaaagaaacaaatgaaatgcctcttccacaatgatgtatgtcaagaatgtaattttagatttttttgctcctagagtatattcattgtattgctaaaaatgtattactccactttactactattgcatacaaaactgtgcttgtgattcaaatccccctctctgcagggataaatcatgttttgtttacttctcttcctggggttgggccttaaacagtgcaaacacaaagcacaacttctggatcatcagaacgatttagcaatgaaacaggctatctcgaagatgaaaaatatttgaagagaggctagatgctcatctatgaagatgactgaaggaaatgcatgcactaggcagatggtgagattgcatgaccttttaagtcccttacaagtgtaagtttctgtgctatcaagggaacaggccaggtacagtggctcacacctgcaatcctgataccttgggaggccaaggtgggagaatcacttgaggccaggagtttcagaccagcctggataacaaagcgagaccttgtctctacagaaaataaaataataattagccagacatagtagtgcatgcctgtagtaccatctcctaaggaggttgaggcaggaggatcatttgagcccacacatttgaagtcgcagtgagctttgatcccaccactgcactccagcctgagtgacagagcaagaccctatctctgacaaaatgtggtggtcacattttgacgtttgaggggtcaccacccctcgacaggccctggtatgtgatgttcccctccctgtgtccatatcttctcattgttcaaatcccacttatgagtgagaacacacagtatttggttttcggttcctgtgttagtttgctgagaatgatggtttccagcttcatccatgtccctgcaaagaacatgaactcatccttttttatggctgcatagtattccctagtgtatatgtgccacattttctttatccagtctatcattgatggacatttggctgggttccaagtctttgctattgtgaatagtgctacaataaacatacatgtgcatgtgtcttttatagtagaatgatttataatcctttgggtaaatgcccagtaatgggattgctgggtcaaatggtatttctggttctagatccttgaggaatcgccacactgtcttccacagtggttgaactaatttacactcccaccaacagtgtaaaagtgttcctatttctccacatcctctccagcatctgttgtttcctgactttttaatggtaagtgttattctaactcccaatgctgtctacctaatgtgaaagttcaccattctaagtaaccagtcctggctttgttatgaaatttggatgctgaatccaagagattaacaacatgatgacaaaatttacttattctctttaaatgtgtataaccatcaacaagagagacaagattatttatacatcaagatccttgccttattaatttcgtctccccaagtatctagacattcccaaaataggaggttcaatgttttaaatagcattgatacatggttttccaagtgacttgggagtatgatgacatctcctaagcaagagtgattggacccatgatgaattcagtttctaatgaacagaacactagagaactgggtttggatctaacttttggttcttttctatatcctcttggaggtagttagcttcctttactgtttagatgtggaaagggccttgtttgctaagtttggggaaatacaaaaagcttggcagtcaggaactaagcaggaatccaatggactgaaaactcctttggagaaggatgccattttttttttttttttgagatggagtcttgctctgtcacccaggctggagagtggcatgatctcggctcactgtgagctccgaggatggcatcttatggttctttttgattccttcctccctagaaaagtccagaatatgactctgaacactatgtaagatatgcacatagtaatgaaaattaattgacaaaattttctgtggaatctcaattgccttgcaagaaataatacaagtgcagatcgagtttttaaaaccctgcataggaaggagaagaaaatgaacattctgcttcaggattggagttttctttctgatctgctaattctacaaagtatataagattactcaacacgttttaagtggaaagcaacaagcttactctacattatagtagccataatgtcactagggggtgtatgtttggttgtgagagggtgttatcaatgttaattacaaagtttttaagagttgataaatttcttcataaaacaatgacataaaatatctcttcaaggtaacaaatcctgagagtcaaaaagctcaggatggtttcaatcaataactttataactaccaactatttgtttttccaaaattattaattaacaactaagaaattgctgaaagcctccttggagcatttttacaatctttgtatagaagtaaatagtatttatgatagtatcgatatatttggactagactttaccatggctatgggacctgctatagttcttgatgatcccttgtcatgaatggaacttaggtagctattgtcacaatctctgcagtcactaagcatagaaagtcctcactaaatgcactaagcatagaacgttctcactaaatgcacaagattcaaataagatggtattttccaattccttcactcagtcacttatatgagggctaaagccatggtaacatagaggctcaagtaacttaaaaaataacatatttgaaatttacttgctggaaagggacaccccaccttgattttaatgaatttcagagcaaatacaagctgtcctcagtggctttcatatgaattccctgcacagtcttcttcctttagaaatgcaaaaactatttcaagatttttatgcctgcatggagaaaattgctattgtgtacaattagcatatttactaaggtttgtcattacttttggtaattaaaatcgtacaaaaagagagacatatccaattcaagaaaattacacagtacagtaatatacaatcataatagtcgcctgacaattattaaaatacaccaagttctcccttacagtaaaagtattcaccagagtagcttctgaataagatcattgcagtgctttctatttaaatgtttttctgcacagaaaattataattacatttgcataactactgtaatcaatctagaattatggctgaaatttttattcttgaaatcactgttctttctaagatagtaggagctctgaggcataatctaggtttgtgggccattattctaatttgtaataggattaaatatatttttgcactctctttacaacaatcaatcactctagagacatagcagacgatacaactacatcacacaatttgttttcttctgtcttgaaaaaacaaaccaggctttaatttaccaaatccattttgtccaaaaagcaaaacaaaacgaactcaagttaaaaaaaaaaagtcaaatttataaaaggagaacaccaaatattatttcatgaaacagactcaataagaagtcaagcattcatctctacatttagatgctctgtacttactgagattagctgggatggccgagataatttctgtcccatcatggaaatactggctaccataaaccaaagatttcttttgaatgttctcctttactcctgctgtattcaacaggcttccttggagcctgatgttattgtcttatctttttaaaatatccaagtcagatctgatgaaaacgataagcagacctaaatacattaatctgcaaccagattctggtagagctagccttttgcaacgataactctaagaaaatgccctgctagccccttcttctgaccaatgagctgataatgtaagaccctcacagacaccatctgcatgcattctctctcaggagtgcagagactcagacactgtagcaggccagagaatgaggtgttctaaaatcccctctctctggtcctgctgcaacttgtttttggttacacagcccagctcctcaagagaatgacatctccagggatcaggccataacaaaagaaattctcaatagcacaaacaatatatatttcctgagaagcacaacataaagtcactacagaaagctaccctgaagcatttctctaacatgtggtttcaaaatcatttccatgttatcaatgctaattataaagtttttaagacttgaaaaatgtctacatgaaacattaatgacataaaatatctctgcaaggtagcaaatcattgagagtcaaaaagctcaagatggtctcaatcaataactttgcaactaccaactatttgtttttccaaaattattaattaacaactaagaatttgctgaaagcctccttggagagtttttacaatctttgtatagaagtaaatagcatttatgacagtatccagataagttcggactaggctttaccttggctatgagacctgatatagttcttgatgatcccttgtcatgaatggaacttaggtagctattgtcacaatctctgcagtcactaagcatagaaagtcctcattaaatgcaatgtctttttaacaaagatattaaactgaactcaatattttcatacttttttactttggaagatttggagctgtgctcaaaattgtacaaggaactgttttaatgaccaattaattcagattggcagatacacagaaataaacatgttcagagaataacagcaaagactacatagatacccatagattatgattgacttttggtgagaaactcagataagctgaggacaaacattaaatcagcagtggaattataaccttacttatctttgtgctcaagtgtttgtttataagcatagataatacctacctaagaaaaatggagcccagcaggcagctagatttatatttatataattttataaaataggttcttgcctcaccatcagaggctggtcaagttgccagcctctagaaaacattgagatctctaggtatagatatatccttatttggaaggtgtatgaagccaaaataaagacaattccaagattcctcttctttaaataaggtgaagacccttaaagatggagaaaaatagtcaaagaagaaggcaaagaatcatagaaaattggagataggtggatgttaagcacattttattttttattttcattttatatacataaaaattgaggctcaaacaaatgaatattcttagtcatgattacatagccagcaaatgcattgatgaatatacagctaaatcactttccattatacaacactgaatttgaagaaataagatcacattatggatgtaaggcaaacataatagcccagggtcaatatggcagagaaataaaagttagcatttttctatcttaaaagtattctggattttccccccatcttcataaggttggtaacaacaataatggttcatggacaacctagaatatttcatatttaaactagagtcttttctcatggaaaacaaaccatccatgtcttgatcaaaacaggggcatgaattactagaagaataagagcaaagaagaaataagcataaaatgtttttcaaggaccatcttgagataatactattataactgcatttacaacttgtatgtctttttaaatctgatatttgtagtagtgtatagattagcatacttatggaacaaatgtgtttctctttgtttaagacaagtaagttataattcatacaaaatattagtcatggtgtcatctcttcaccaattctattatcatgtataggtcacaagctatttctggttttcatttttctttaaaaaagaaagaagagcttgaatagatatagcattttgaaaattttgtcctgaaagacttttccacctccattcatcttacagatctgataatttttcaccaaggaaacagtctttgtcctggagtctcatatggctcttgccataacagtatatccaaagattcattcatttatttactcactgaataaatgaaactctacaaggcaccaagttctgtaccatggctatgtatactgttaaaaacaagaaaaagaagtagttgaccttttagaatttacactacagtgaatgggaaaagtccattttttttataatgtagttttcatttgagtattgttttgtattattaatagttaacccatggaatggaatggattgcactcctgaagtattacttctgtgggaccttcaatgcttgtggctgtgtccttctttgctgtggcacatgctttgctagtggaaagaatttgcaaagcccttttgtgggggagaaaccctacctgcttgggatctgatctgaaaacaaaacctacatttgttcatcaccactacctcctctctaaatcccttaaatatccctctactaacagtcactcaagatcatgatttaatcatttcatgtccaataaagtattgatttcattttcattggttatcttttatatgatcatttagccattttaggcattatatcttcaagaagaaggagatttgtaaatactacaaaggggttttcgttttgtgttgttgagatattactattaaagtttctttttttttttttggatacagctgtgtaaaataaccaagatctatttctcattctagcatgtggtctcagcattctgtacaaatgattttactggcttcgtaaactcccaagttaaagaatctctttaggaagaatcttaattgacctcttgaattgttggcctggtacccagagtaaaagaattgtgttttaataaggattacttttgtcgtggtttattatgctttagcaccacacgctaattgatgtagttgcaggaaataaggtaagacatgccatggtttggttaaaagcttcattacatgtatttatgaagagtcttatggatgaaataatttacaacatctattacatatattgaaatgtatgctactgcttccatttcttataatctgcggaacccaggtctgaaaccacttggtggaaaacgtttttaaattttattttggtaccaagtggcaataacaaaagttcaatgactggctgagtagcaatttggactgatttctaaatgtgggcacagcattaatgaaagacatttcttatttttgagataaagcaaacctacatgaaagagaaattacatcatttgggtactagtttcagtgaatgcctgacaatgggggagtcggaagagtggtgtaatgacggaatgctaaagctaggtgagttaggaagggttatttggagataagccttgagtaggacctcaaagaagggaagcaatgtggataagctagtaggaggctgatccagaagttaaatattaaaagtatagcactagagatagcaacaaccatgtgtctagactaaagagcttgttttttttttgtttttgtttttgtttttagaaatgagtatggatggagagaggggattatagcagagcgaatagtgttgaagtcttggtggggacattccgatttaataagtaagtatagtttctttatcaagagtaaccattcgaaaatgctatttgaggattagttaccaatgcaactaaacttcataatgaatgatgatcatggttagcacccactaagtgcttactatgtgttatatactattttaaaaacttcatgtatgtccttgtgtttaatccaggattttgtaaccatgatgcaattgacatttaggattaggcaattcttacttgtgggggactgacctgtgcactgtatgatggttagcagcatccttgacttctattcaccagatgccagtaatcacaccaaaacatccccacacaaccacaagttgtgacaatcgaaagtgtctccagacattgccaaatactcgagggcaaaatctccctagttgagaaccactgatttgttcttaacaccacgtttcagttaaatttcattaattctttttttattgcctctttttgtagttgaggacatggatgctaaataacttgcccaatgtcacatggttaataaacaaattttaaagcctccctgtgaactccagcgacttaattctagggcctggatttgtaaccactattgtctattacatccccataatctttctaggcaggaatctagcataaacaaaaaaagaaatagcccagtgtagtaagtctcgtttgaactgatatatgaaaaaaatggcagacatttaaattttaggtaatgctatcacagccggtgtagtcaagacttctgtcttttgttttgcaatttatcaaaaggctgactttctcatctaatcctatttcagtggtatgttctacataatttttaagagattttgttgtatctaaccttaaatcaatatcacagcagttttatgattttttagtgcctctctcatcatttcttctaggctttggctggacaaggggaataaaagccctgtgtttttccacaactataagaaatgcaattatcagagcatatcttgtactttccaagtatccctagattgtacaatatgcctaactgtcctaacacaaggggacacttgctgcacactttatgattagagctgttccatgttcctttaacgatatgtggaaagcaaggaaaagaatgctaggagggaaaaaggtctctcctttctttgatgtggaagttttgcaaatcatatagtgagacctcctaagagttcatctcactctaggcacacaggagactgtggctggagtagggaggaagaaatgagaataacatagaaatgattataaatggtcacagcctgtctttggctagaaaaataaacagggatttctgccaaaaaaaaaaaaaaaaaaaaaaaaaaaagacctgggcttgggaggaggcagcctggccctctgtgtgtggcctctgtttacccttctgtataatattatgacaggtccttttcaatgataatgttccatgcatcagtaataatgaatgaaaaacaagaaagcacttgcagggtttgcctattaccttaaaccactgaacatcatagagaaggcagcagatgtgacagacaaaaagagattcatagattaatatagctgaaagcacactgacagccaaaagcatgttttttttccattccagaaagttctacctgtgaaatctgagactctgccttttcatctataaaatgggataaaactatcttgcaggattttgtgaggcttagataaaaatctccaaggagatggaatttccaacagtatccatcaaaatacaggcactcagtaaacttacacgggctaaatagataaatagttttcaagtgaaaatgtaattgtgaagtgcagtttagttctctttgcctctctagggctttgtagaacatgaaaaaaagaagtaaggatctttttattttattttttattttaacaagacccatggactaaaggtaaagagtaatgcaatttaaaggaccaatgcaactaggtaggtaaagtcctacctagactcagaaagtccagacaccagttacaggaaacaagataaaatgtatgagtctcaggataagaccgagggtttcaacattactcacagaaggcaagatgccattttctacaaacttaggggcctttctttgcgtttagtcaactaaacttgaagtgagagaaggaactcaaataggagaaatggctaccatttctttgccggtgatgggggagaagtgaaagcagtggggctatgtattattctgttctcaccctgctataaggaactgtccgagactgggcaacttataaaggaaagaggtttaatttactcacagttccgcagggctacggaggcctcaggaaacttacaatcatcgtggaaagggaagcaaacacatccttcttaacatggccgcagaagagagaaattagtgcccgcaggggaaatgccagatgcttataaaaccatctgctcttgtgagaactcacttactatcacgagaacagcatggggaaaaccacccccatgattcaattacctccacctggtcccactcttgacatgtgctgattattacaattcaaggtgataatcagagcgcagacacacagccaaaccacatcaggctatatggaaaaaaataaatcaaagaagtttgtcctcagacacagaagcaacatttcacgttccaagacattctacaatgaagtgagaagcctggcacttccttcctccacttccagacttaataactggtagaacaataatatccgtaagtaacaaagagcctggaatggatgagtctgacaaagcccatccatcctgccacctcacaaactatctatatttgttcttttttctccagctttggagacagaggatgtgttccagctcacagactttcaggaataatactggaaattgacatctaatcagcattttatgcactataattgtgtaaacttttaggcctgctgtacaataatccttccctgctgtgtggtgagcactttggggccctctggatgctagatgtgatatgaatgggaagcattattattatttatgccttataatatgtcaactctatgtcctctgccacaacagacacttatttcaaatgtgcagtaacagcccccaagtgatgtattgtcaaaatatttttgaaatgaaaaagcaaaattaaccataaactgcccccttgtctccatgaaaatggcactgtaacactaccaaggaaaagcaatgttaaataataaaagctacaacaaaataaaagtcaaaaaaaattggaagagctctgtgtttggaagaagtatgctttggtaaatcacaacaatgacaatttcgctttccaattaaagtgtaatagtgaaagagcaaaccatcaccccagggtatcctcaagaacagctcaatgaattctggcttacttaaaaagaagttttcagtggagctgtttttcttgcaaaagattttagaaaaaaacacagcctttttttttttttttttggatttacattacgcgaaccctgatattatcagatatcatctaatgactcatcaattcatacagacctttaaggttggaaagcacatatttaaatatatagtagacagcaagtaacaaatgataggaactacattttagtgggtaaaatccttctgcaccatcaaagactttctaagagctatgggtttattactcaggtgattcagtttccattttgggacaggtcatattaattttcaggatcttttcccagaatgttatttaattagtgtgactaaatatctgaatcaggatgctacggtatttttaaaaaggaagatgtcgatttaaatgtgatagatacttaacagtttgataaacttttaacagactgtaaccttgatgctttccctggtgtagggaggcatccaagggaccctggtgaactgaaaaagttaatgcacttctctaaacattttgagtctggcagaatctggaactataaaataacatttcttcattaacatacaagtcacaatgctattcccataaagcacctctagcatataaggctggacgtttttcagaccatcatttatagggcgggtttatttttctttgtcttgacattaatgagctatgtattcagggaaatagaagatttcaatgcctgtcaaattacctttcaaattaccaaagcttgcttttctcctactcaaagagcaagcagggacttcttttagaatgggggaccaatggaatattcagtaaaaagggtcatgaaaataaatgtgaaggcagtaatggatccattccaaccatgacttcatgacaaaatgctgtgacttcagcatttcattacttgccatgttctcatcctttgtattattatcacacctcccctctctcccacgttattacatctttttgggaaaagaagatatgtgaaaatttctgtagttgtatgataccttgttctaaaatttagactgctgatttgatatgaaacacataatgtttttatagatcaaggctgccagttatttgtaaccattctgttacaaaaatctttcctgagcaatcttggtatatcatcttctgccacatccttagcaattaactgaagctaactgtttcactaacatttccttttccatttatgtagaatgggctgaatgtgttaatgcaatataacaagagaaataggcacagaaaaatcctctttcatatcgatctcagaatcctgtctgtgtctcatttgggatgaagagaaaaaataatcaagaaaatatgtgttggcagggttaagaatacaaaggaaatattactggaaaatatttaataggtaaatatagatgagggaataggcacaaggttaggtaacaagcagattgaatttcaaatttcctaatgactctccctgttttgcaaatccttccaaaacattacctcatctgtgctttcatcatccctagggtatagggttcgattactcatcctatccctttgcacaatggagaaatttacatgtattcagccctagccgtccttctagtcattctctcagtttagtacttacttgttttcttatttgggttttggcctgttctccataagtttgaaagctgtttgaggacagggatatgtttattctgtacttttctggtatcctcgcttggaaatttagtacttaagagctaggtcgggctgggcgcggtggctcacgcctgtaatcctagcactttgggaggccgaggtgggtggatcacaaggtcaggagttcaagaccagcctgcccaagatggtgaaaccccgtctctactaaaaatacaaaaattagccaggcatagtggcgggtgcctgtaatcccagccactcgggaggctgaggcagagaattgcttgaacccgggaggctgaggttgcagtgaaccgagatgctgccattgcactccagcctgtaagaaggagcaagattccgtctcaaaaaaaaaaaaaaaaaaaaggaggctgggcgcggtggctcaagcctgtaatcccagcactttgggaggcctaggcgggcggatcacgacgtcaggagatcgagaccattctggctaacacggtgaaaccccgtctctactaaaaaaatacaaaaaattagctgggcatggtggcgggcgcctatagtcccagctactccggaggctgaggcaggagaatggcgagaacccgggaggcggagcttgcagtgagccgagatcgcgccactgcactccggcctgggtgacaaagcaagactccgtctcaaaaaaaaaaaaaaaaaaaaaaaaaagagagagagagagacctagggagctacgtcctcattaactattataaggtggtttcagaggagcatgtagtgcactattgaagctcaggtttatcttaataggtgtatttgtatacattcattaagtatacgcagactaggcactcctcattttacactcaaaactcaagtagctgtaggactaaattacttatgattttgatttataaacagcagaagaacaatgggtaatccatattaaaaatgattgtgtatcatctcctaaagaaagcattttgaatacgtgtttatcctgttcttaaatggttttactctttgttatattcattctaattaaactgttctagtgcaaaaatgctaaagcaatttctgtagtttcattttttattctaaaattcttaactgtatactgaaagtgagcttatgaaacattcttgatatgaaaactcacaagttttcaaacataattctttatctttaaacacaatacctacctgaaattttgccagacaggcttatcctcagagtatgctttagtaggttaatactctgaagaattaaatgtaattcacatattaactactggtagaaatccatgtgcaatcatattgtttacttgataattccatatacatctttaaaatcaaaatgctctgtttcacttctcaggagcagttctgacacattttatactttttgcagattcaggattagccaggtagagctagcctgtgttggcttcccagttaaaaatcaataaattttaaacataaataaaaagaaattctctctttaaaaagtattttgaatttctatatgtgtgtgtatgtatgtataattacagtagtaaaaattttattaaatctctaccaaaatctctcctgacacattcctttctctttctacttttgagtaactataataatccttctcaatttttctagaaaaagaaacatgcattcaaactgatctcagaaaagaatttttctcatgccaagtcaaacaagttagcaatggtaaaatatatttcattaaaattttaatctagtcattaggtagggaaggttaaataacttaagccttttcttaactattaatagataatgtcaactcttgcctagcagcttcaataagcttttgcaaagtgttgaattccagtaagcactttcagaaggggtaagatgtatacgtgatcatctacttaggtcataatactgcacaaatagtgctaatgtgaaatatctgctgggatttttagtacaggttgtttttatagtttaaggatcaagttgcttagagagtgttcacttctctaagacatacggaaaatatctatgaaactttactatctgaatgtgtactacctgggcacactatatatagctagtatagcaggatggaaacttcttttggttggaaaatgcgtagacacaaatgacaaaatcaagtgtaagcaaagacagtaagcatattggaaattatcttggacaaagagaattttgcatttcttttgaatatctcctatggaatatatcacatagttactaaatgcttcccgttgagaaatagtgaagaagtatttttctaagaaataaattattagagactcaaatattaacccttattagccatacttacaagagacaaggatgttagttaaagccaggagaattctttagtgctgtctttctagacgttagaatttctcaaatgtattcagtaattaaaaacattttgaaaaatttttaaaaatgtaatatacaatcattttaacacatattttgctaaatcatctattcagaagtcctctagtttctttatgaccctatacagaagataattcaaaaccatggctacaacatatatgttaatggtaatatttatttatttatttagagatggagtctcgttctgtaacccacactggactgcagtggcacgatctcggctcactgcaacctccacttccagggttcaagagattctcctgtctcagactcccgagtagctgggactacaggtgtgtgccaccatgcctggctaattttggtatttttagtagagacgagatttcaccgtgttagccaggatgatctcaatctcctgacctcatgatctgcccacctcagcctcccaaagtgctgggactacaggtgtgtgccaccatgcctggctaatttttgtatttttagtagagacgagatttcaccgtgttagccaggatgatctcaatctcctgacctcatgatctgcccgcctcagcctcccaaagtgctgggattacaggcatgagccactgcgcccggctacaggcaattttttaaaacctgataaatatttattccttattgttccagtcctggatattaacttctagaatttaaaaaaggtgataccttagtactttctgatttaaaaattttattagctcttgtacttaatgattagatacatagaatgacagatcttctaatacaattaactctgtaaatcaagaatcttttcttccccaaaataatataaaaagatataaataatttacaaaagcaggggattacatttagcaccaattcaaagttcttgtgaaaacaattaaagaatgtgtgcaaaatttcaaaactgggatacaaatctgaaattttatagaatcattgtcaaacaattgcagatgcaagaatagtatgtttgatttatttcttcatactttggaacagaatcaagtttgtataaaaaaatcaaattctcaatttttacaaaaagagatgttttgtatttagttatactccataatttcctttcactctttctatgaaatctgtgatgagtagtcactgaaatatcaagacacaacaatgttagactttcattcagtggcctgtaaatttactggttgccagaatatcttatatagtaggtaaaaatagagcttctaggaagactgaattctatccttagttaatgctgaggttcaggctacatatattcccaattgttgctgaaattaagtagtactacatcattctgtcacctgccaagggagtatgtgtccttccttcctcactgatacccagggaagaaacaagaatgcactgaagatagtgatttgcagcaggtgctgaggctcccttgatatatgtacatatacatgtctgactccataatatactggaacccataagaaaggcataaattactaccaagtgtttctctcattcttcctggaaagaaagtcctactactttaccttgcttagtaaatctaggtgctgctctttcctaaatgaaattttgattaagaattattatatctgaaactcctttaacctccatcacttctctttttcaatgccatttgcaaatatgtgctgtaagatataaagaaacactgataagattacagttcccctggtactgtccaactaaaaaggaacccaagaacatttaagagcctggtgtcattttttttttctgggaaaatacatcccattttttctcctgtaaatgctttcaacctggtgacctatgacagctttgcagtgaaaatcttgaactggtttttacttactttgaataaaaggttaatacaaggcttcatggaggtttaatcagcaccacattcaaaaatgagggaagcaaaggcaaagctaatgaattgaccttttaaagagcaattcaatgggataattgccatagcacaattcacttcggggccgaatatgtgtatatggctggtcttccttggatccaatccaaggacatttaagtatgtaagtaccaaaatcatggtgggttggatgaggtggacaacaacatcacatacaacctagtggacctcaaatacatttttcataaaagtaaagctgtgctttcacgcataattttaacctaatcaaccagttcatgtatgccaccaagaaaaattaaaacattattaacattatctgccatctgtgctaaacactttatatttgttattttgtacaattttcatagcaccccaggcattaggtgtttttattcctattttacagatgaagttggatgtctgtctagatacattgccagttcttcctgaaatcaagtagttattcatccttctgttcttccaaggaattgtgtgtcctacctttctcactgatacctagggaagaaacaaggatacactgagaacagtgatttgtagtaggtgctgaggctggcttaatataggtacatatgcatatcagaggggtttaaataatatgcctgatagaccacggtggatgacattaggaactgagactgaactttatctaacaagaccttagaccgtgactactcacctactcttaacaaaaaggacaggtttttgccctgagtgtttttctaaaacatcttacatgtagaagtacccccaaggttaaactcaagataataaaaaggtttccccttggtcttatgccctacttttcctacctttatatttatgagaaacattacaatatatgtgctatcttataggagaaagctaacagtttcctttaaaggggggaagattgggcttttttctttaaatcaattatggctgtggctaaagaattaaagtttgagtgcagagaatcaggttttagtcccatttctgcaactagctttgtcaccagagtaattctttttttttttggagacgaagtctggctcttttgcccaggctggagtgcaatggtccgatctcggctcgctgcaacctttgcctccaggattcaagcgatgctcctgcctcagcctcctgagtagctgatattacaggtgcacaccaccactcttgactacttcttgaattttttttagtagagatggggtttcatcacgttggccaggttggtctcgaactcctgacctcatgatctgcccacctcagcctcccagaatgctgggattacaggcgtgagctactgtgcccagacaccagagtaattctttaggttactcacctataaagtgaaggttctgggctagctgatgaatgagattcacagtagttttcagatggtgtgatttcagtactgttcactcagcctatatatctacaaacactgcactagatactgtgaagagatacgcaatagctgacaagacacaggttaaattctgaatgggtttataatttggcaaattgggggtcggcagtgagtgaggtagagagtggaggtgcagcaacaaaaaatgttcttttatgaaagataatctttactaacccactacacctgcgatgttccttttaactgcatattcctacaatacatatatacaactctatccaaccacggctttacaatcagtcccaggagatgatttgtaaacaagatttggggaacagtagcaaatatgagtaggtagagaaatgaaattttaaagtaagaagactggcttatacggcgacaaggagttagagatgaggagtcagacatgttgaaatgaatggaacttatatttagataggcacataaatgacatgtgcaatgtcatatgaaacaaagctgctataggtcatggaagccacaatcttcaggaaagtagctaaagaaattgaggtggcagtgggaagagtaaatcaggaccagagcgtatgtaagaaaaatatgacaatgtcaagtagcagaaaatttgaaaatgctttggggtatctacattttaaaacacatttctggaagtaatattagtttcttaagcatctatagtgccaggaatgttgcatgcatcatctgtcataatttttacaatcatcttgcaaactcagatatactttcctattttatgcatgcttaagcaggttaagtggcttgataaaggtctctagctagtaaatgagaaagccaggaagagatcacaagtgtgccctgcagctagtaccacgtcaagtcttactccccaattaattttgcaaatatgaaaagtaatgactttagcctatgtggcccaacttcaggccagtcccaactgggaagattttataataacttcttagaaactgctactggctctttctcactggcttagtagtggatattaatctctttattttccatatacaggcatatggcttgcagacatggcatactgtgtgcataaaaaacttccttagaaaatacatcatccaagaagcaggaattgctgattatttcattactgcagcaaactcatgtttctaccatcccaagtccggactctgtctacaagagtagaaaaaatccactagatttttaattcaacatctattcaagttttgaggcacatgctatctgaaacaccgtaatttttgagtttgaaacagagaatttttctttagcaactttggccctgaaatgtcctccaatctcaatgtcaggaggtttgctacaatggtctggagagtgtagtttttcataaaaatatgttctatttttcaacaccaaatgaatatctctttcctgcatattgctcaaaatagccatttccttcacatggttatgttttattactcatgtcatcagatctggcaatgtgagatttatttagggggaacatttcatcaattacaaaacataaagcatgtgctgtctctcaatgagttcagttacatcttaaataagttctgagctgttgggagaattacaaagaacacacttttcctgaaaaccattaaaattgcatactcatagaattttaaaaaaattctatgcctgaagttttaatatttttatcccagggaagtggattttttcacttcctttttagattatggccctgagaatatatcacccgaaaatgaagcatgaaaaacaagacaacttgagagcaactcacagaaattagctgatttcatgatatttatgtgctactcacttgcattgtttaagtcttttcttttctttttttttttttttttttttttttttttttttttttttgagacggagtctcgttctgtcacccaggctggagtgccagtggcgtgatcttgattcactgaaacctccggctcccaggttcaagcgattcttctgcttcagcctcccaagtagctgagactacaggtgtgtgccaccacacccagctaatttttttgcatttttagtagagacggggtttcaccatgttagtcaggatggtctcgatctcctgacctcatgatccacccaactcgggttcccaaagtgttgggattacaggcgtgagccactgcacctggccctgtttacttttttcattgactctccctgccttaagagtaaagctcaagtttctaccctgtcctgatttatttccttctttccttccttccttccttcctccctcgctccctcccttccttccttctccttccttttctcttttccctttccttcctttgttcgttcccttccttccttcgttgcttccttccttccttcctccctcccttccttccttcctccctccctccctctctcccttcctccgttctttcctttgctccttctctccttttttgagacagtgtctcactttgtctccaaggctggagtgcagtggcactctcatgactcactggagacttgacctccgtggctcaagcaatcctcccaactcagctcctgagtagctgggactacaggtgcatgccaccatgtcctcctaatttttatattttttgtagagacagggtttcccagcttggccttgaactcctgggctcaagttatcctcccgccttggcctctcaaagagtgggaatatagatgggagccatggcaactgcctgagccctaccctgtttttgcagggccctgcatattgtagtctctgtctcctaaacaggggaaacttctatcctaacacctttgctcaaactgtgcttgccacctagaatatcttcccacatgcacagttatgggaagcctccttataccttaagggccttgctccagttgtaaataagccccgattcctattatgttgtgttagttttctctgggctaacattctgtcttcaagatctttgtgtttagatcctttgtatgtttcaatgtgtcttgggcataagtactgagagcacaggttaaatgcaaaggtgagagaggctgtggagaaaaaattaaaaaaaaaaaaacttttggcatatttagaagtcactttgcttctcttactgtcaatgctcttatttctgccctagccataactgtaagaaaatacttaccagttgttcaaagataggttgttcaaagtaaaacattaaaatgttgctctttaaaattctttttgtggatatactgagggagcttttataatcctataaatatagagaattgggtgcacatttcttctttaaagacaggtttttacccactcttcctaggtatctaacaaggagacatcaaggcattttaaaacaaaagacccagattctaaaataataatgtctttttttacactcaagattccaaacacaatttgactgaccttcaacagtcttgtaaatagccatatctagtctcactccctatagagagaaaatcaacagcatagtgtgtcctactgaatattatataagttgttagtatcagcattaaaacaagggagtcttactccttaggtgctgctacacatcatctggataggcaatctctcagcacaccacctaggccttatcttctgcacattgctcaggctaaggccatgcctggcaggtagtcagtatgcaacaaatgagccatcaaatataacaatataatgaaaggccattaggtagtctctagaaatatctgtccttaatcttacatttgttttttctcactgtatgtctaaacattgctagtttatcccagaaacctagttgcttcttttctgacagtggttgtattaggtaagatgggattgataaaataatcttggaatcttaacatgtaattaggtgaacaataaaactatataaccaaggaaatgtgctgggttcaagcataatcaagatacaaaatttgtcttcatggagcttgcaatgctgttagtgagtttgatggtctgaatgtttgtgttttccccaaattcatatgttgaaacctaatcctcaatctgatgttattaggaggtgaagtctttgagcagtgattaggtgttgaggatggaggcttcatgaatggaattagtgcctttataagaggctgaacaaaccagagttcttccttttcaccatgtgagagacaacacagctaaaagacagctatctgtgaagcaggaagcaggccctcaccagataccgaatcagctgccaccttgatcatggacttctagcctccagcattgtgagaaataaatgtatgttgtttagaagtcacccagtttataccattttgttatagcagccctattggactaacacagtgaagcagtcactacggactgaattaggtccctgcccaaatccatatatatcaaagccctaactcccagtgagtttgtatttgaagatagcatctttaggaggtagttaagattagatgaggtcttaagcatgggatcctaatccaacaggactggtggccttataagaagaggaagaggatgcacacacacatgctctccatcctacacgcaggaactaaggaaaggccatgtggacacacagcaagatagtggtttcctgcaagtcaagcaaagaggtctcgaaatgaaacctactttactggcatcttgatcttggacttcttagcctctggaaccgtaagaataaatttctgttctttaaatgcccagtctgtggtggcccaagcagactaagtcagcagtagggcacattgggctctgaatttaatatgaataggtttcaccacttgtcaactatttgactagagggactttcttagccttatccttaataagcccaaaggtcttttgaatgaaccttataagaatatctatctacctcaaaatattattgtgacatttaaaggagaaaaataaaatataaaatgccagctccatgccaaaatataaaataaaataaaatacccagctccatgccaaaaatgctcaaagatgcaaatgcaagcaggcatttaaaatgtctgggtaactatgtgtcaagtgggtagcagagacaaaaggactgtagaattttggaggagaaagagggtctctttggttggaagaatcaaagaacattcaagatagacttaatatttatctcagcttgactaaaggttagacaggttgcttcctgactataggcccatgaccttcttttccttagagcctttactttagaaaacttgcaattataaattctttctctgccccttttgaaatgtatctaaacctccttaaaagcctctggccagttctatgatctagggagtatctctctcaaggacctgcatgccatacttttcagatctaattatcaagaaagatagtgcccccatctcccagtctctgtggacacataggagtctatcataagtgaacaattagaaactataaaacactttatgtcatgcatatgtgagaaagtttactttctcctcctgtaaggataacaggcaaacacaggtggcctatgattctcctacatctgctcttaaaaactgtccaacactttgtttcttcagagttgagttcagtttctctcccctattgcaatagccttgattaaagtcttccttgcctgtgaaactttgtctagcacatttttctttactttgacaggaaacattcatagagaatatacaacttgaaatatgttgtaaggtatggcttagatattggtttggcaatgtataacttaaaatgaaaagctgcatgcattttcatgttagcagtaactagttatggcatgtctcaatgctttactcaagagttttcttgagatctttttaatatatattatttcaacagttactcagcacaaagtaagtattttttcaggctcaaaatcctgcactaacattgtaagctccctatggcactagagtttgtatatatactttcaggcagctgaagacataggtaaatctttgcaaatggggagagagggggacaaaaaagggttcctggctcataattttaaagcactacccacagtgggactgttttctaaagaactcttaagtatgcagcatatatactaacatgtaaagcacaccttttgcactaatcaaatgtgaagttatataaatttaatatccaatgacttaagaaagtgggatgccaacactcatctttatgactaaagtatacaattttatgaatcaatgtaaagaagccagcatgcttggaaggaatcttttgctcaaactcagattatgttattacactgctaatcttggtgtgtttttttaaaaacgtaacatccttctaatcaagcatgattagttacaaatagaatccaaagaaatatctcaaatgactatatatctaaattatcttgcttattacttatgggatatttttcttatccatatccaggttaattacaatttcagaaattatctgtacaaatgaataaaattcaattctcttagccaatgagttactttttccagtgtaaagtacagtcatttaggcattcacaatatatggaatttagaaatcttttaacatgatgaagttgaaaaaagtaaacaaatattactttgccaattctccaccagtcagaagcttgtctatatactaactgtgtatttagaaaatatcaatgcataaggaagagaaatgcaatttgtctcatccaaacgcatcatataaaatgaccaagtgctgttaagtgctagagatgtgtctcaaaagactctcaatgtctgtatcattttggggttgtttggaagttaaacccttttagtaagaagtattggaagataaatctagttctcagcccttaattcgccattcactggtgaggtgttcttattagagagcatgtctcctggtctcactagttcctaatgaatgtgtctggcctttcctagcaatatataaattctgagaaattggaagacatgattgctccctacccaattctgaaaagagtgaatatatcattctttgtaacagatggaatgtattaaaaatatatcaatatgtgttttcataaaaaagaaaatatctaccattcaattagaaaagtattttggagaataataaaaatgatagatatgctattttactgttactagccagccattattgttagaaagaatatgattctaaatatactgaaagtctggtgacatgtacaagacaggaaaagcacctttattcactcgtaataaatattttcctgttcattccctacataaactagaacaattaatattttcctcagctttcctggagaatgagatatttgacctgaaactttctctattgtgatactgctagcattaattaagtggcagtattcaagattaattggagacaagaagactagttgggaaattgttttgtcataaagtagaaaatagtgccatgatggaaggaatggaaaggaaattcaatttcagaaatttcacaaaggaaatatggttagatcattgaggttgaatttgcagaatttagtaatatacaccaagattgcaatttgagagctaaaagctgtttcaagttcagtgttctatggactaaactgtgttcccggaaaattcataggttgaaaccctaacccccaatgtgacttatttgaagagaggaactttaggaggtaaagttcaatggaattataaaggtggggccctaatccaataacactggtgtccttatgagaataaaaagagacaccagagctctttttccctgtacacagaggaaaggccactcagagagggtggctgtctgcaagccggtaagagagctgtcatccaaaattgaatggatggacactttaatattggactttccaggctcccaaactgtagcataataaatttctgttgtttaagctactcagtctgcagtgttttcttttatacacacacataatacacacatacacacacacacacgcccccatatttatatactgtgtatacacattatatatatattttgttatatatacatgtatgtatacacacatatatatataatcttattaaaatcttatatatgttatatttgtctctattaactaaaatttaagtaccatgagggcaggaattttaatctattgtgttcaccactgtttctacactgtctaaaacagtgcctttcccagtcctaagcaaaaagaacaaagctggaggcatcatgctacctgatttcaaagaatactacagggctacaataaccaaagcaccatggtactggtacaaaaacagacacatggaccaacagaacagaacagagagcccagaaataaggctgcacacctacaaccatctgatctttaacaaagctaacaaaaataagcaaagaggaaaggactccctattcaataaatggtgctgagataactgactagccatatgaagaagattggaactggaccccttcctcacaccatatacaaaaattaactcaggacagattaacaacttaaatgtaaaaccccaaactacaaaaaccctggaagacaacctatgcaataccattctcgacataggaacaggcaaagatttcatgataaagacaccaaaagcaattgcaacaaatgccaaatttgacaaacaggatctagttaaaccaaagagcttctgcacagcaaaagaaattatcaacagagtatacagacaacctacagaatgagagaaaatttttgcaaactacgcagctgacaaaggtctaatgtccaccatctataaggaatttaaacacatttacacacacacacacaaacccaattaaaaagtgggcaaaaggacatgaacagacaattttcaaaagcagacatacatgcagccaacaagcatattttaaaacgctcagcatcattgatcgttaaagaaatgtaaatcaaaaccacaatgagataccatctcacaccagccagaatggctattattaaaaagtggaaaaaaaaaaaaaaaacaaacagcaggtgctggtgaggttgcaaacagaagagaatgcttatacactgttggggggagtgtaaattagttcaaccattgtggaaaaaagtgtggcaattcctcaaagacctaaaaacataactaccattttacccagcaatcccattactgagtatatacccaaaggaatataaatcattctattacaaagacacatgcacacatatgttcattgcagcaccatcctcaatagcaaagacatggaatcaacctaagtgcccattattggtagactggataaagaaattgtggtatatgtacaccatggaatactatgcagccataaaaaagaatgagatcatgtcctctgcaggaacatggatggagctggaggccattatccttagcaaaccaacacaggaacagaaaaacaaatatcacatgttctcacttataagtgggggctaaataatgagaacaaatggacacatacagggaaacagctgacaccgggacctagtggagggtggaggttgggaagaggtagagtatcaggaaaaataactaatgggtattaggcttaatacctgggtgacaaaatagtctgtataaccaacccccatgacacaagtttacctatataacaaacctgcacatgtacccctgaacttaaaataaaagttaagggaaagaatagtgcctttttcatagtaggtgttttacaaatatatacttagtaaaggaatgaaataatgccaatatttgaatgtggttttgtatatgactcaaacccatatagatctgtaccctatttctatcatatttccattcctttctaaaaatgtattttctatgttgacttacctgaatactgttattctaaggtccacttggataatttatatatagtttcataaatgagtagattttagcagaggtgattggcccatattagaatgtaattcaaaacttgaatttattattttaaattgaatataacagcttggttctatgtgtcataagtagagttaaagtcatatacctttcttatatttcattcttccgtgtcatcacacaacaatgaagggtacataatgctaaaatgagcacattcattgactgcacatctcaggaagaaataaaagaatataacctgattatttgaagttacagaggctagatatggggacatctaataaaaagtttgaataatttcaaaacatatctttttatctttgtgagattttctctggtatttacattttcgtatcagcatttctcatgatctaggagttcctactacttgaattaaactatcatgttttctaattcttacaagctagatttttccttcccttacagagtctcatttctctacccacttactgaaaaggtagtattttctgtgtgtgtcttaaaatgtttttagattgcaaaacaaacaaaaaaactctcaaaaacatgctgttaacttctgccagctgtttaattaagcagattttataggaatgtgaacaataaaaagcaaaattctggagctatattgcaatccagataatattcttatcctcagaggaaaaaacaatgaccttcacttaagttctgctatattattggctatgatttgaataagaaagcttagtatgacaactgcaaaacatatacttggagaaaaatagcctaaaatataaaactaaggacaatgtaggagcatgtgtgttaatgcataacagacccacagacacagtgggtatcacaagcccttttaatcaagacagaaatatgcacatatatatcatgaacattaatgaaacttgtggaactcctccatggttccaaattatgtcctgtctcaaaatacatttatgtaccttatggtaaagtgatctttgaataatgggatcactgaccattacagttcaccgatgaatacttctaaggaggaaaggagagaaagctaactataagacttaaacagcacctgctgtcagctaaacaaattagctgccctgaaatcacatgtacccacaaggaatgaatagcacaacctttacctaggagactgccttcggaggaaaatgcgcagaatagaaatagccagtatgatatggcttggttgtgtccctacccaaaatctcatcttaaattataatcccggtaatcctcataatccccatgtgtcaaggaagagaccaggcggaggtaactgaatcatgggggaggtctcccccatcttgttctcatgatattgcgtgagttctcacaagatatgatggttttatgtgtgtggtagtttctcctgcattcattctccttcctgctgccttgtgaagaaggtgccttgcttcccctttgcctttcaccatgattgtaagtttcctgaggcctctccagctatgttgagttgtgggtcaattaaacctatttcctttataaattaccctgtctcaagcagtgctttatagcactatgaaaatggactactacaaggcttctaattgttatcccaaatttgttcagcttttgacaaatctgtatacacatttgtctttgatttttagctgtttgtttgactttttaactttttagctattaaattttatcatttactaggctagagcagaaatgataatacaggtttttcctcatttcttaaggtgtgattaattacaaacatggccaaaattcttgcaattcctctccttgaatttgggctgaccatgtgacttgcttaatcggtgtggcaaaagcaatgtaacgtgagttctgtacctgagcctcaagaggctttgcaaaattccattttcactcatgggattctgtgattaaaccggccttttggaggatggggcataagctgttctaactaattcatcttagatagccagtctctagctagcatggcaagctgatcaccaacatatgaactagtccagttgagatcagctaaacctagcccagatcagaaaaaccacctactgaagcccagtccaaatggcagaaccacagaattatgagctaaataaaaggctgccattttaagcaactaagttttagaggagcttggaacacatcaaaaactaaatgacacaaaaggttagctgagaaacattttttaaagacaaaatgtattttaatccagcttaaacagaatatctttattttggttaactttaaattaatagatgaaataggtaatgataactatacagggctaaaacattttatatatggttaggtttgagtgtaaaatttttatctcctttgttcttttttttaagtcagtttctgggcttctttttagcaaagcaaacagttatttggctctaattacaatcaaaatttataaaaaaaatttttgaagtcaaagtaaaaaatccagaatattggaatatggctaataaccaaaatcttcctctccttctaacactactttaatatctcactaatatttctattccttactccctggaataaattgaaataggataacaagataaaattatacctggtttttcattctgggttttcttcattgataaatagagggttatgaagtcagaaatataagactattttctcctgagatttcattaaagatacgatattaggaagactgaaggctattgtgctggcttaccacatcatatacttccaaccatcagaagtgaatgacaatgcaataatgcaaaagaactcagctcttatcaaccacagaagcatttagaatttctgtgactgctctttgagtacaaacgattattactaaactttgtcaaactgggaagattaaaagatttttcagggttgtgtaagtgcaataccataaatactcaaccaagtagaaactgcttcagcaggttaaactaatgtggggaagacactagaaatatcagaattcagaaacactgactccaatgcattgtttttttcatatttcagaatctgctaaaagttgaaaaccagattaattgcggccatagaaaagccttctcatctgtcatttgaatgtgaaaagaaattacttgaaatgtagtgggcattctacatttcaagaaagaaagagggtcgatgaatgaaataagcagaaaaaggaacagcttagaatatgatatgtagagatacctgaggataaagaaacagtgagagcgaatctgtagatagtctggaaggagattagcagaaaatatacataaaaaatcacatcagttgacatccctctactctgtgacattgtggtggcgtctaagaaggtcatcagtgtttctcagtatctggcattcctgcccctatgtaatgtccttcgcttgcatgtgggctagacttacagcagccaggaggaagtgtcacttccaagattaggttataaaaagcctgtggctcctatcctgggctttctctctctctctctcatctgtcctggaagaaaagtaaattgccagctgttgtgaggatccctgcacccacatgtaagataataaggcatgctaacaaccatgtaagtgagcttgaaagtgaatggcatcctacacacacagctgaaccttccagtgagactgcaggaatgatcaccagtttaactccagcctcacaagagatactgagccacaggcacccagctaagtttttctgggattcctgacccataaaaactgaaataacatgtttcttattcatagctgcctaatttggggataatttgttatacaggaacagatagctaaataaccacctaaaatatagaaaagaatagttttctccgtccttccctccctctcttcctccctccctccctccctcctttccttccttccttccttcccaccctccctccctccctccctcctccctttctttctttttgccaaaaaagcaaaaccaacaaacaaactaaaatctagacagtctttcttttaaaagcaaagaaaggctgggagcggtggatcatgcctgtaatcccagcacttttggaggcagaggtgggtgaatcacaaggtcaggaattggagaccagcctggccagtgtggtgaaacctcgtctctactaaaaatacaaaaattagccagtgtggtggcgggtgcctgtagtcccagccactcaggagcctgaggcaggagaattgcttgaacccaggaggcagaggtggcggtgagctgagattgccccactgtactccagcctgagcaacaaagcaagactccatctcaaacaaacaaacagacaaacaaaaacaaagaaacttcccagcactttgggaggctgaggagggtagatcacctgaggtcaggagttcaagaccagcctggtcaacatggtgaaatcctgtctctactaaaaatacaaaaatcagctgggcatggtggtgcacgcctatggtcccagctactcaggaggctgaagcaggataatcgcttgaacctgggaggcagaggttgcagtgagccgagatcatgccactgcactgcagcttggacaacagagtgagacttggtctcataagtaactaaataaataagcaaagaaactgtgcaaagagaggtaaggctctttctgtggatgttctctatttgggcattagtttgtctgctatatgcctgctacttccaaagaaaagcctgtagctctccatactctgtttattctcaacctgacaagcagtccagactggtgctaaagaacagaagatacacatcgagatccctttggaggtaggttgttgagggaaagagataaggtttgatagaattaaaactgtgactgggaatttaaaatgatgatataataaaggcaagagattcaatacaagaaaaaataagtatgttgagtagctcatggaaaaacaaaactatagaaaacaaatatgattcaaatataacgcaaaataaaatgtcctgatttctgagcaactgataagtgcaagggaatccacttgaccttgatcctagaggtggaaaaattctcctttgagtagtccaggtaatatgatatttaactcataaaaaaagaaaggtaatcttaacatataactgagattagtattggataatatttacacagtaatggtaatctaaatggtcttcattgttttccactttagaatcctcataatccaaataaaatatgggagatttagttgtggttggttgtcagacagaatgttaaagttaacatccctggaaataaaatgagatcatgagatgaggaaaagaagagggaagctagaggaatggggaggagcataaaaaatatctttagcttactaatgtggatacttaagagataagagatattcttgtaaattaatggaacaagaaattagatgcaactatattacttaaagcaacaaaatttatatataatttacatatagttttatctaatatatatcaagtattatatatataatattttatacacatacagacataattcacaggagagaaaaaagcaaaagaaaggattaaagcctgagctaatcctcaattttcatatccaggattgtataagtattgtataaaaggaataaataaacaaatggaacataagcatattatttggagatatggagctaattaccaaaaagaattattaaaagacatttactctggggaataagactgggagtgatgaggggataaatgtggtatcgttgcttttttatataccatcttctaaactatattgatttgtttttatgtgcttgctttatattaatgaaaacaatgtatcaattattcccacttacatatgtacaacaaagcaaaaaagtgaattctgggagtaatctgttactagtttcaggaatagttttaaaaaggaaggtataactggtatttgcaatttgagttatcatccatttaaatatattgtattttctttttttttctatttccttttgctttttttaaattacactttaagttttagggtacatgtgcacaatgtgcaggtttgttacatatgtaaacatgtgccatgttggtgtgctgcacccattaactcgtcatttacattaggtatatctcctaatgctatccctcctccctcctgtattgataggacgtatctcaaaataataacagctatctatgacaaacccacagccaatattaatatattttattttcaaataagccacatagcaagaataaattcctttgacatttcctaggctttatcaagatctgtctgttgtgaggaattcattccactacccaaacttcatttaagtctttgcatccaattagtgttatcccaacatgtccctctaatctcttcttttgcttctctagttctttgtacttcattcccatttttatttgcctataaaaaaatcatagtttttacatgcttaaactctgcaatgagtgtcttttaaaaatgttatacattttccctatttcgatctggttttctagatgtctaaatatcaaccttatgcacagcttgtcttgtagccctgtcaagagtcactggtgcaaactggttctgtaatcattaggcttcctagagattttcgcctgtttcttccactccccctaactggctgaagacatcaaaaaatcagacaaactgaaaatgtgaattctcgactctttgaaatgggcaagctacttgcaaaattgtgaagtaagttttagctatttgtctgtggctcaccacagacagcaaggaaaaggtaaactcctatgaagacaataagagatgatttcctgtagagaatttaaaaacaataacaaaggtgactgaaagtcagactgctttttattattagagtgtgtcaacaagtctaaacaatgtcagtgataaaatattcctcttgagaggggaccattaacaatgcccctcctccaccttggtacggcactataacccaaaatgatgagactctagtaaacctctggaacagggttttacacatgttaatctgtaacctggtaggcaaaattatgccactttgggcccgtctcttttccttttagggacaactactggtgcctccttcctagtcttatgagaagaatgtcagtagcataaattgaaatgggaattttgcttcctgcatatcgcatccacccctttttcttaaataaatatgcacatgctttttaaaaaaccaaacaactgtaatttcaaaatgtctttatactgcataagaaggaagttaattcttttaacatcttgttatatataccatctttattctctgcaaatattgattaatctaggaaaattcaggactgatacggtttggctgtgtccccacccaaatctcatcttgaattgtagttcccataatccccatgtgccacgggagggacccagtgggaggtaactgaatcagggaggtggtttcccccatgctattctcatgatggtaagttctcatgagataaggggcttcccccttctctcattattctcctttctgccaccatgtgaagaagcatgtgtttgcttcctcttctgccatgattgtaagtttcctgaggcctccccagccctgcagaactgtgagccaattaaacctctttccttataaattatccagtcttgggcctgtccttatagcagcgtgggaatggactaatacaaggactgagcaatacacaacatttatcttagcatcattttatgcattctgtgttcattatttattcaaaaaccacttactaagtgtcctttttgtatcaaacactgcattaggtgctgagcatacacacattaagacaaaggtcttgactttaagatgcttgtcaaaaaaaaaacttaaggttataatctctaacaggtagatcattatctatctatctatttaaatgaatctctattcatctatcttttccaaagtgctatgaaaacaggaaacaggttctgcttggggttgttcaggaaatcataaagtgaaatgcaaagtctaaaatcttcctgtgccattaacactaacaaagctttagtatttttcaaatggagaagtgtatcattaactagatcacaggtacagtcgcaaaacaagaaaaggaggaaataggaacactgctggcagatgagtcagtatatcagaaagtgggaagttgcattttgagtttaggcaatgtgaacagtttactaatagcataccaaatacaaatttcagactagattctttatacatgtgtttttttacttttctgaatcaaattcccaaacaatgtagaatgcaaagttatataagataattgacaaagttacataagataattgagccattaaataaaaatggaaaactccagtcacaaaaatgtctgaaactacagtgaaaattctctctttggacagtggaaagccctcagttcagaacagaacaagttgggcacttaactttcctgcagtgtcttatcttctatcttgtattagattgccatgtagaccctgtcaagaaacattaccaactgctagttaatgctgtgcacggaaaagtcagacttggtaatgtcaccacagaatttgaaaggatattaatgggtccttttcatttctgaaaaaatagagattagaaccagagaacttcccttcaaggacaatttcttttggaagaaacttatattccctttggatccatgaacacaagtacctacatcattttctagctgtggactcactctttcaaaacatactcagggacagctgatgcaaaggtaagcttggaggtgtagaaaatataaaaatcagtttttctcaagtgtgttccagggccaaatttttactgctgaattttaaatgctggtctatgtttaaggaagatcttataacagctagcatagcatggcacaacacatagagactcctcacttggttcattctccaatattttggggaatctatagttgaatatatttgttacttggtcctggagtaatgtgggccaaatggagaatcatttctcttatttgagatttgggtcatcatgtgtgaatctgtagtgtctagaataaggcctagcatatggaaggaagaatgaaaaaaaagggagaaagaagagaagaaaaaaggcaatagcacagtggggatgaggatactaaggaagaacaaatgagcacctgctatgtgccagatgctatgccatgagctttatttgtgcaagtttatttgatactctcaaagaatgtggcaaaacaaacatgattttaaagttctcattgttattgcttcatactttactccatgtcgcagttaaacattgaggttcacaattataacagtcttggagttttctcaatagcatataatttattccatgtaaagatgaagataaaaaaatgtagcttcccccatatgcctctagggtactctgtatgtcctgctgaagtagaaaagtcctagaagggagctaagggggccgaggctaccaactactctattaaatctacagacttgatggtaatgtctattttagaagaagctttccgcaaatgcaacttagattttaaagacatcagcaagagaatgtggataattccagagtgagggtagtgtctagcacattgccaacacttaagacgtgaaacacttaagaagcatgtttccccaatatgcttgttattaaaaagagtctaaaatatcttttctcctttaaatttgtctctgagattcaactgtgttagtgatgctgttaataatatactctaaatctgtcatgtacaaaagctttgctattgttgatgtagggcactttataatttatgtatagattcactagtaatctaaggtgtgagaaatggttcttcaaaaaaatcctgaattgctaggtatttatcctcaagaatagcataataatacctagcaaagtgtgctacatatattagttgcacataagattttgcaaatttgtaattctaaatgaaaattttgtggatttacaggcaacatatagcatggtaaaaaaaatacacacgtacatacactgcctattttgttttgttttgttaattaccatttggaatgcttactggataaaccattggttaacacaagtgctatttgtctgcttgagatttcatataaagagaatagtgataacaagaatacagtgaaagctgtttggtaaatgctgaataaaggcagagaaattacctgagccttctcctgaggtcccagcctaatggtgttaatgtattttttattgctggagaacttttcagtgataccaacaacaacaacaacaacaacaacaacaaaactaacataggctctagatgataaaacatgtaagaaattaacatagagatttaaaactaatattgacttagttttttgaacaagcttaatgtttacatatatcatgaaggagaatagcaagtatggttaacacacacatacacttgtatacacaaaattatcttttttgttttgagacagagtgtcactctgttgcccaagctggagtgcagtggcatgatcttggctcactgcaacctccgcctccgcccaggttaagcaatccttctgcctcagcctcccaagtagctgggactacaggcgcgtgccaccatgcccggctaatttttgtacttttccttcctccttcccctcacagacaatgattattatatgtaagagatgaataaatcaacaggtgtaacacaaacataggtatgtattgaaaatcagaagttcacaaagtattacagaacaatttgtagagctgataaaaactaagacaattaaactaggttatattcttgctacttagacaagaactaattatttaataaaaagatattactttgtcctaccactgagactagacattttagaggaagtgccaacttcaccagtcctgagaaaattcccactgaaatcactgtcatgtatcgactaggtacacagacttcattcaatatctccaatgctgatacagaatatatcaaaagagatatcgagaatcatgagcccaatctagtctaactcacagctggaagtacttgaagtttttcattctcaagttgaaaaattagtatataatgaattcttaagctccttaatcaaaatatgttatccaggatagatacagaaatcatatttgcaagattcagtatcacaccatgaattaccttctgtgtgtgacaactggggaacagacacaagaaacttcctgagtgctcagtcaacaataatttgaagttggtgaggaagtaggggaggttgcataaaacagcgcaagttatgggaatccttggacagctcttcgttgtccaggactgtcccagcattgcagtgtgtgtagtcctcatggacctcacgataactctctctttgtgttattacctgccctccactgccgcttgcttcccatacatacatcccttaggggaatggtgctgcctcattcaacagagaattcagcttggtacatgccacacaattgatgtgctgctgaagaaacataaattcacagctactcttcaagggcagagaaaatagctttaaaggtaagaaagatgctttaatttacagtgtgtacctgaagaatgcttctcagacatgactttcagatgtatggtgctcacctgtgacaggtactttgaacatttctttatattttaagatgaacatatgaaatttctattttttatagttaaaaactggtgaagtggccatcatttcatatggttcctatactcttgactcctataatcctcacaataaacttatgaggtaggaaactgaggtctaagtaactcacagctagtacgtggtaaacacaatgctgggatataggtgggcattttggcttctggagtcaacgcccttgaccactatgcatagtgccccaacatcccacacaagctttcagaccttagactcccagaacgcagggcctcatcatctgatcatgttaggtgtccagcatggaaccatatttataggcaatgcctaaatagatactattagaaggagtaatacatgatacaaaactcaacttcactcatgactcaaacacttactgtgtgaccttcgacaaatggttcccatttctgagggctaaacttttcagtctatcacatagaatgtatatggatgcattaaggaagggaacaatatgactgtatttgcattttcaaaaggatagtctgacagttgggtggagatcacaatggaggtggttaagactatgagaaagcaggaggtgatgagattctgaataaaggcaatacgtaagagcagaatatagatcacctcaatgtatcctgaaaaaaagtgggcagcatagccttgggtaagttagcttttctatgcctcaatttcctcctttttgaggaggaataataatatcaagttgtactttttgagtttccatctcttcctcagacatatatatatatgtctgaggaacacacatatatatatgttctgcaggatatgattacacttctgatttaattagcaaaatatttattagaagccagaggaccacagaggccaggtccttctagaggttaggagcaggtaaagtatatcttggtgttgcttttgatcttttctctggcttccagtttcctaagaaagctaatgctgccagtggcactatccatacagggtgcagtccttctgggtctgaagaaatgcctgaagattaatataccaaagttttatgaaattgatacctacatctcgaatactttacgcacatccattcaaaagagatttccatttcatggttcccttccacacacaggcatccccctcttccttcctctgtttttttttcttttttcctgcagcctttgacatcccacactattcgttttcttgtctattgcccatcttctccaactagaacataagttcggtgcagaaaagtctaattttgatcaatgctgtatttctacagactagaaaggtagtagaaaggtacctgagatatagcaagtgctcatcaaacttggttaagtgaatgaatgaatgggtatatgaatatatttatctcggactagctttgtgagaagacatctcaaaaccaagcttgcatctaccaatagagcattttgtcatctagtaaaacctccagaccccaaagaaaatgcaccacgcagaacttaaaaaaaatcctttaaaatgcattactctagtactttttcttgccagtaatgagaggagaaaaacaaagtctgaataactgttgcttacacgcatttaaaattacaatacattacactcttctcaccaggcaccattaagttcaggagaacatgcctttgtatatattttaaaatacacatcaaagtgtttttctttgaaatatgcactaaaatttgctgtaaaaatgtacattaatttaagtgaattcagaagattgattggactagggaaaataaattaattattcatgtcaccagtattttttaaatgcacagtggttatcaggaacatatataattataagtaatgctattattttttaatagcaaagttacagctaaggttaattaatatttttaataaaaataaaattttgttctttgaagttgcaaaatgtattttgttagctctaaatatttttcaaggaaatgtgtgtgaattctgcttacatttttcaaacaaataatattcatttttcatgagtacctccaaagcctccaagcaagcaacagaagtgtccaatatattcaaacattcttttcttgcataaacattaattgggttctttttcagaaaacccaactgggaatcaaatgctactgactttaataggatgtctcatatgtgaaatgaatgtctcttacaatctaccaatgatatttcttgaactctcaatagttcctttccttgagtaggtttgctaactctaccctgaaaaaatgcctaactgaaaccatggaactgctccaatacatttcactcatatttactgattctgtctcactttataatttaatttcttcccaagagttgcaaactatagtcaaaaaccagaatctctcaaaattttattctctctcttttctcaacattgttgaaataagataaaaagaaaataaaaaaggttatggattctaaaaaccaggcaaggataccacagacaaattttgctctgaatataaagaacaggacataatatgtattattcttatgaagtatgcttttcttgcaaaggtaaattttggatatgctgtaaaagtagagtataatataatttatagaccaaatggcatacttttgagagtcaaaaatatactattaataattacactgaacatcaggtatgcacaggtactatccaggccaactgggctgcatggccacatgatggaagacagaggtgaaatctatgttttggtaaataatcatgagaagacctaattaagagcatcatcactagaatcaaagaaatcttagagctgagtacaacttaagagtttcctagttcaacctacttattttacagaggcagcaaggccaaagtacaatgatgtgacccaagttgtccaagtcacatgacgagataggtggttgtgttgaaagtggaaaccaggtctcctcattcatcatgctctttccattatactacaatctctctacagtatgtatgtattctctatagtatgtatgtagcttgtaaaatattctcgaaggaaagaacaaaaagatcgtaaaatgtgctataaagaacattccagaaacgatgtcacaagcttgatcgtaaaagaaacagcacagttcaattttcctttctttgtggacaggcaaaggaaggaagtgttgtcctcttcatgttggcttacatgtactcatctcataagacattgcaagtttaattagaagagggggaacatttagcagccaaaaaacttgcatgatactcctgccacatgccaagaagctctcagaatctcaaagaactttataccaccaatagtttttgtgaatatttgctttctgagattagccttctggaaagtttcataaaatcaggaggccttatggaaacatttaaaaattaaatattccaagtaaaatgaattttataaattttataaattttatgtaatccacataaaaagtactatcaatattgttatattcacattaaaaaggaacaattcgatcagaagttttggtaaatgtccctattatttcttgatataaatcacatcttcctaaagtaaacattgggctgaaaattgattatcattcaaagcaaaacttcttttttttttttttacttttaaaaggatatttactttaagtaggaatataaacaggactttatggaggatattttgatgaacactactatattctctgagtctgtgaaaactgaaatacatttcttccctattactatccctgcaggatggctgaacaaacctcatctcatctatttgaaatgagtccaatttaattctgcctgaccaaaaatctgtttccatagttttaaaacatgcaatcaccccaaggtacattgccattgtagcttaagtggctcagtgttatcactgagaaaaatgcactttgattgagaaaacagtccagtgtggcttttgaaaaatgaaatgaccctttctgatacacaatttagtaagacagttgataaaagcaggcggatatggccactatagacaacatttaaaggaagatgcttcatccaacctgtaaaaataggtcaaagtttacagtttcgaaattaacattagaaatttatctcatatttaaacttcctggtttaaatattactgtatttagaggacaattgaaaagtcaattacgaattatggaaaattttcaacaaattattctgtcactcaaatataaataaattgctttcttccctaatgttttttccccatacatacatgtgttgttatctgtattcatatatatatctcactacttaagagacttttaaaacctattagcccaactttaaaatactgttgctactactgaatacttgtaacatattaagtcaaattctttaattactgtcactggtttattacaaagctaacaattttaaatatctatttttaaatgaacctaataatcttttatttaagtcaatatctcctcaaatgaaccaagtattcactaattaattagatcatttacatctataaactgctgctgtcttcaaacatgtaatagcttataataaaagaggctcttttcattggcaattaaggagcagttaactctttaccttctgcattttaatattataaaatgcataaatctttatttctgcatttctacgtatttagctttcaaatgaaacagctgttttgtacttaaaaataatatttcttaatatatgttactaattgacaaaatacataaaaccaatgctgataatattttcttcttttgggacacacctggtttatataggagatttggcaactgtaatctcattaatgataaaacaagactactaagaaaaatacctgattatttcaaattatattcataaaagcattcctaactctgaatgtcctcttgtgaattattttagataaaggaaagtctatcaatttatttgtttcatttttcctgtatcagatttactgtaataacttgcttatcagtaagtgaaccataaatctacagcagtaacaaatcattaatgaaacattagcaaagaatgttaaatggagctattgggcaaacataaatctttctaaagtcacaagtctttatccaaggaactaagtgctatgatgttattggcaaccttataaatcctaacgagagaaaatcaacaaaaggatcacattgcaggcaaacagtcctactaaaatgtatattctttgagggcaggggtttcgtttgctgttaccaatatatcctcatgcctagaaaagtatctggcacatgtagacagtgatcaataaatatatatttgtgaacaccctataagacatcccattttattttgtagccacatgcaaataggaaacgaaaagaaaagagagaaaaatgaaaataagtgcacatgtaggtacaatatatccaacactacatttaatttgcattttttgtattttttgcccatccctcttctaggacattttctcttcatctattctgttcctctcacccttttccattcaaagtaaaaatcagagtcaattttcttcattttctgggaaacatgttaattcatatttggggtgctgatacaaacagaatttgccttctattattttccttccaaactggatgcaggtctgtttcaaatgcaagaagtaaaagcaaatttaaatataattatcattcttgcttcttcagaatgcatttttctggaaaagtagggatcgtgtatttggaaaagctttaaatggcacctactgaatatactcactatcagtaaaacagaacaaaacgaaacaattaattttggaccaaggataatacacaattctgaaaaaattaacaactggatacatacaaaggctgcaaataccaacaggaatctaatggcatttgaacagcatctaacagcatttcgaataaggtttttttttccctgtgttcttcactgatggaacaccaatattcaaaccagtgcctgaaatgtagtaggcaatcaataattatgtcctgattgaattaacatacttccaagttgtgcaaatgccacatttaaaaatcatattcttcaaaaattttaggcacaagattgaaataagctaattagagttaattgtaggtgagggcaattaatcacatacacaaaatacctcatattttgggtttgtgtgctcagataaaccaatagaatgtttttttatttttaaataaatagtgaaagagtatacccatcattcaccaagaaagccacatggctggctatcaattcaaaactttaaacttcaaaatactatagaagtattgtactattaaaatatctcttttaagattaaatttgccttgattttattttgaagtgctgagcttaaacagacaaggttttcaaatatttcattaacttgttcatttaaactaaaaagtgaaaatcctatgtaattagcagacgatctactcagcttgggccagaggagggttatggaatcaagactatcatttagcatctaacaaaccaaaacaaaatcttttgtaaaagtccacaaacctctaatgaacaacatacacacatttcatattcaaacggaatgcattatgttaagctagtttcaaaggaagctgtagtgcctaagatcagaaaaatgttccaatttagaaaagacgcatatgcagaaaagcccactatcataaataatataggatgaaaatgaaggaataaaatccacaggctcacctggctaatgggttcttttgtcgggggctttcctcttctggctgtgctagtagccagggtcgtggtagtctccataattgatgtggacatctctgattgcatggcagtggctgttgactcagttgtcatagaggaaggcacttcaccaaccagtctcacatttcccactatggcgatgttggcatcgttttcggctgccatattcagaactttcaagccattgtagtacagcccagagagctggccctggaagggctggccctgctctttcccgccaattattatggttgcttggctattgaagattgtgagctgacgccctgtaaaaataatattacatacatgcaaaaatgttgattgtgaactctatatctacaatggatgataaaacagatcttttatggggtgaataatgagagcaataaactataagagaggcatttgactcataattcattgcttataaatgaggtgtccatgaaatgcataattattggcaaatacttgtaaattctcaacttattataaatgtagtgcttttgctaaaagaccaatcaaagatatgtattacaaatcagtttttagtggatcccttttcccttttacatcaagatcttatattgttggtgtctaaagtctaaattgttaaattttaaaaatgtaagacaacatttcaagtatttgtcattctgaaattaccactgacagaaactaatacatagcagctgaaatctaatttaaattttatggtaaaaatttcataattcacataatgtccacatatatctatatgttattctttagtgctgtttattttttgaaggcaattattcattgttatttgaattattctatttttccggcaatcacactgaaaagaaattcatggtttacactgagcatgtcagagacaaaaaaattccaaaaatatttttctgattggctttcagcaagtctatcaaaacaaaacaaaatgaaaaaaaaaaatagcttcagatgtaaaaagcggcttcaggaatgatacacaaaccgatggagaaattatggcacatttccatcaaacagcaatccttaataacagtaccattatcatcaaattgagtatccagttttagcagattgctctctgctcataaaagcatgcacacaactttaagttcagttttaatatgggcttgttcccaaatcctcttagaaggttgcaaatgttaaagggacttcattatgactggcaattcatattgcccactatttaagattcctagagtttaaacaaagagtttttgtttttttcaggaccataataaagatatcagaactacatatattttagttaataatttagaggctggaacatgtaatatagtctatgaatgatttatcattttgggttaatgcttgctgtgagtaccctcatagattgagttagtggattatatttaacagtccctttaaccttaagttaactgggtaagattattaaacagctggtacgtctaaaaatgtatagaaattattatacaaggtatgcaaatattactatctacattttactgttttaaagttgtttttaatttagttttacggaaaatttattttttatgtttattagtgttacaatgaagtactacttggttatgttcaaattatttttttatttgaagttttaatcaatgttttttacctttgtcgagtagccattcatcaactactcgaccaagtcgatatggaattcgctgtctagcaatcgccaggcgctcgttatcattgtttcctttaaagtttaaagagacatttcattggttaaaatctgtaaggtcaaaggttaaaagttaatacttaaagattgagctatacagttgccacatgattttttgaaatttggaattttaaaaagttctacctagaacatttcatgtttcagacttgtcattcattcatttattttattttagcaaacaaaattattcctatgttaattgaaaattagaaatctgcatttgagctaggttattaaacttatgttatagacagacccgaacaaccaatttaaacagcatataatagctttacaaaaaatgaccaatgacctcagggttttgtctttttgatgtttcttattaactagttaaacatgttcaggtgaaacaggtttaagttttcaaaatacattcaacctcttattccagattaataatttatgatcaccaaacttaataccatatttggcacactgaagcatctacaataggcctagcatactttatttcctagtcagaaaacagaaattcttattcacctcatttaagaaaacaacaaagtccaaatagttcttgtgtatttcacacaaattgatttatcaatcacttggacatcacaagagaatgcatcttgcatcatccagatacgttattacaggaaaaggctttgacaaaagtcactttatttgagtgtccttgagtttcatttaaagcttaacatgttgaagcaaataacatttgaaaaaataattatatgtatgtttttatatagtcaaatatctgctttttattaagttattctttaaaagcatgacagcttaaggaacgaatataagccacaaacagtggcccctattcatagatctaacctaagtgagagccctgcttctttgcataaaaaattatctgctagaaacactgtttaaattgaccttgaatattgcttgcaaatagatgagtgttttcttgatctgtagagcacttacgaagaatctgagacaccatctcggtgttgagttgtgtataatgcaagaagagattttctattccattagagttaactaacatggaaatttaagccaagacattttggcattagctcagatgaggactcagaggtgaaagaaatgttgaatggtagcactatctgcataaaaagactggagtgttttgttagagaagataaatgaatagatttacattttattcctctgatttacaataatttataagtgctttcttttgctactcttataatacattatacttaccactaataagcccagcataatactgattacacacttttggagagatagaaaagaactatcttttagacctcatcaatttgtcatctgaatgtctatatgactgaaaatatttcacacattaatatttaatttaaaatgtaaatatcaaagtcaaggcaaatataaagtttaatgaaaacattaatatgtatttctctgtattctgtgatcactaaaacattgtaaaataatattttataatgtgggaatatagttttgttaaactaataatttttttaaaaggacacaaatggtacaaaattccaaccctgtcttcattttttaaaagtgtacaaaatttgtgttctctgttgtgtgtttgcatatatgcatatttggaatttttttttaatgtaatattagttactttaggacagtgtgattattgatcaattacatgtttttggcttataagtgattttatataataagcatgtttgacatgtgtaatttgaaaagcaatcacaaaatattttcaaaaatacataccctttgctctatagtcttatttgtcactcaatactcataccaactcacattggcataacacttctgacaactttatgattaggtggttcctcatgtttttcatgctagagtcttccaatcatcaggcatgacccacattctctcagacaccatccgaatctaggtcgcaaatccctcttgcccaattactactacagtctattgacagacctctctacatcttctctgtgattaatcacacccattttccatataagccaatatctaatcatgtcacttgtctagtataacccttcccatttctcttaggataaaatctcagacccttagtgaaatttgtaagtacttccacaatctggtcccttcctacctccctgtcccctctcacggccatcactgcctcactctgctctttttatccttatgagacttctttcaattcttccaaatcttttctttcttctctctgggactttgcacatgtagcttcctttatggaaaatactctcccttgttcccacctcatctctatctttcattagctaaccattactaattaatggaatcttcttggtaggaacattgcttccccagaaggtattccctgatgtcatcaggttacattaggacacttgactatattatttgtagctcctgaaacatgccctttagaaagaagcattgaacctgtaatggcaaatttgatagtttgccttcaaactctgaatatccctccatgaggccaagtactatgctactatgtgcagtatttattatttcttcagtgcttacttgcacaatatctatcacatacaatcctattaatatctgtagaatgaggtagtcaagaaaaccttgtttttagttctggtagcttctgttgcactattaacacattcttacaacctaacaacattaaaaagaaaaagaaagcaaatactagtgtccagagaataaaccacttgtagctaagcctccctttgcactttccaaaggaaacaccataaacctcacttataattttattttttgatgaattgtcactgatttgaacatctctacaatcagttcattatttgtttaataataaattccccatgtcacaaaattggtaaacatagttattattagtagggaaaggttggggaaaaaaaggtctaaacaagacaggtagagaaaaatcaaagctttatagattattttaatgacttttaaaaagatcacataaacacataaatacattcacacatacatacatagaatttgtcctcaaacatttgactagtactaataaaataattgtgtgattgatatagtatgacagtatgatgtaagtcaacagaagctttggagatccttgctgagactcagctaaagcaagaacataaacactgaattcccaatgattaacagaggtcacctaacaacaacaataaaacaatttagaaaatcgaataggcagtagacacaagttatgaaaatatgtgataatatataagaaaggtagccacacaagggggtcatatcttcctactaccccagaatatcagatgcctactaattcagtgagcactgttttaaactgaagaactttttaattacaggacagactttattcttgtatgggtaatgaatggaaaatcagatggtgcttattcaattcaatatatacctactttattctctaaattctttgttctcctactagaataaaaaactaatgactttgttctcctattagaataaaaaactaatgacttttctgctgcaaaattatatgcagatacattgtgatatggtttagctgtgtctccacccaaatctcatcttggattgtcgctcccataatccctacaagtggcaggagggacccagtgggatgtaattgaattatgggggtgggtttttcccatgctgttctcatgagagtaaataagtctcacaagacctgatggttttataaatggcagttcccctgcagatggtctcttgcctgtcaccaagtaagacatgactttgctcctccttcaccttctgccatgattgtgaggcctcccaaccatgtggaattgtgagtccattaaacctgtttttctttataaattacccagtcttgggtatttcttcacagcagtatgaaaatagactaatatagtaaattagtactggtaaagtggagtactgttattaagatacctgaaaatgtggaattgactttggaactgggtaacaggcagaggatgtaacagtttggagagctcagacaaagacaggaagatgtgggataatttggagcttcctagagacttgttgaatgatgttgaccaaaaagtctaggctgaggtggtctcagatggagatgaggaacttattgggaactggagcaaaggaaattattgctatgttttagcaaagagactggcagcattttatgcctgctctacagatctgtggaacattgaacttgagagagatgatttagagtatctggtgaaagaaacttctaagcagcaaagtgttcaagacgtgacttgtgtgctcttaaaagcattcagttttattcatttataaagatacagtttggaattggaacttatgtttaaaatggaagcagagcataaaagttcagaaaattttcagcctgacaatgcaatagaaaagaaaaacccttgtcctgaggagaaattcaagccagctgaagaaatttgcataggtaatgaggacccaaaggttaactgccaggacaacgaggaaaatgtctccagagcatgtcagacatcttcacaacagcacttcctatcacaagccaggaggcctaggaggaaaaaatgtttttgtgggctgagccctgggtcttgctgtttgtgcagtctcaggactcaggtgtcttgcatcctagctgtggctaaaaggggcaaatgtacagctcaggtcgttgcttcagagggtgcaagccccaaaccttggtggcttacatgtagtgttgagcccgtgggtgcaaagaagtcaagtattgaggtttggaaacctctacctagatttcagaggatgtatgaaaacacctgaatgtccaggcagaggtgtgctgcagggacagaaccctcatggagaacttctgctagggcagtgcagaaagaaaatgtgagtgggagcccccacacagagtctccactggggcactacctagtggagctgtgagaagagggccactgtcctccagacaccagaatggtagatccactgacagcttccaccatgcacctggaaaagccacagacacttaacatcagcccatgaaagcagccaggagggaagcggctgtaccctgcaaagccacagaggcagagctgcccaagaccatgggaaccttcctcttacatcagcatgacctggatgtaaaacatggagtcaaaggagatcattttggagctttaagatttgactgccccactgtatttcagatttgcatggggcctgtagacccttcgttttggccaatttctcccatttggaacagatatatttacccaatgcctgcacccccacggaatctaggaagtacccaccttgcttttgattttataggctcataggcagaaaggatttgccttgtctcagatgagactttggactgtggacttttgagttaatgctgaaatgagttaagactttggggaactgctgggaaggcataattgattttgaaatgtgagggcatgagatttgggaggggccagggatatggtttggctgtgtccccacccaaatctcatcttgaattctagctcccataatccccatgtgtcatgggagacacccagtgggaggtaattgaatcatggggacaggtttttctcatggtgttctcatatagtgaataagtgtcatgagacctcatggttttataaaggcagttcccctgcacatgctctcttgcctgccaccatgtaagacatgcctttgctcctccttcgtctttctgacatgaatgtgaggcctccccagccatatgtaactgtgaatgcattaaacctctttttctttataaatcacccagtctctagtatttcttcaaagcagtatgaaaatggaaacattgtgaagacacatctaaataaagtacagcgacaatgtctttttaatagatgattccccaaatccttccaccattaggtataaaatagttcagaatgtttaggttctccagcgactaggcctatatttttcctttacctcatgattttcataaaaatgttgcatactaaaaggggtaatggaagtatattattttaaataatttctcaagatgtattttatttctttacaaattcatggtgatatttacttgtaaaatatcattcagtagctttgcatgattttgctgattatatttaatactgtccattgttcaatatacatctagaccttacatgcaatataaaggatataaaccatttgattgggaaaggtcaaaggcaaaaataatttccaatgaccttttcttttctttggaaaggttcaggatctaatatcaaatatgctgggatatagaagctttacatacagcatttgtgaatggtcagtgtaagcaggcttaagctggtaggtgagatgaaaaacaagtggaatgtccctgaaaattcaaatcaaaacaaagttgaatctttcgaagaagacatttttaccttcaagtattctaaatcagaggtaaggataaagcaataaatgacccacttttcaaagatctatacattccgggctataaaaagggtccaaaaggaatttcatctctttctaaaagcataaaactctactatagcaacatgctgagcaaataggcttgatttataaaagcagagccttctcattgaatagttaaaagataacaatttagtctcacacttttcccatgataaaagcaagataggattttcctttgatttctttttcctccagttaattttgtgtggtttgatctgttggtaccttcactgaaaatgtcagtgacaacatacatgcctctgccgaagtaattttcaagcaatgaaactgcatgtaaaatttggttttattttcctttgaatttcaaaaagaattaagtatttttgacaggaggaaagactcccttccccccaatccctgtagtaatgccattgcaacaaggtacaatctctaattgtaaggtattaaatgtcattgtaaggtattaaatatcattaatacttcaaacaagtttcctggggtgaagaattcaaaggaaaatctgatggcttatatttggaatgtataccctctattttgattaaatcccagataattttatttgcctatttgtatagactgaatgtttgtatctcccaaaattgatctattgaaaactaattccaaatatgatagtgtcaggaggtaaagcctttgggagctgattaggtcatgaggaaagagctctcattaatgggattagtgcccttataaaagaggctccagaaaactcccttccctccttctgtgatacgaggatacaatgaaaagatggtcacctgtgaagaatgaagcaagccctcactagaaatggaatcttgtacttcctagtcttccgaattgaaagaaataaacttttattgtttttaagccactcagttaataatattttattatcattgcccaaatggacaaaaataccatgtaacaatatttggtcacattttagtctatttattctatatgaacaagcagacttccgggaaatgagagtaattacaaagaatcaaggtaagtagcacaaagcaataaaactcaaatccttgacttggagttaaatttcatggtgtgactcagagaacaaagataaatacaattttaatcatattgttataactatcgatcagtagagacaagctatatgaacatcactgatgtatagtttttctcctttcattttagttcttcactcttgtgtaatttctcctcagaaataaaagtgtcagcatttgatatgacatattaatatctatggggaaaaagtaaagaaaaacaatgctatgaaccaaacatttgtgcagaataatatgaaaataaaaataacaagaacaaaaagagacttgcttctttggaaggcttcttatttcttgagtttttaacattgggaaaagaaacacaaaaggattctgaaagtcatctataccacaagagaagattagtaacctgtgtacagactgatttttaaatgagaacaagacatttggatatatctaggcccagaaggcaaagtaatagttttgtaaacatactctgattttaagtgcagcataatcacataattttcaactgaatgcaatgtgtattgttgtcatatagaccctgcaaataccataatgcctcacttggctgataatgttccaaataaatagattttgaatatcgacaccttttgagaaacaaacttttgaaaaatatagctattctaataaaacatttgtcttatatattactttatttcctatatcattaaaatgtaaaagccgaatacacatatataattggctccagcttactccagtttcatcttgaactacttttctctgactctttaaattagtcactttgtaattttttcaattcctttagctaagccaatccactttgaacccgacattctcctttgcattgcgaatttcttgcatccctgtgtactcaacatctctgcccacctcaacagacacacacacacacacacacacacacacacacacacacacatctaaggctggctaaattttttcttttttaaatatcagcttatacatttctcaaggaagcattccctgtgtcccctactgctccaccaaattattctacttaatgaattcttccactatgcattcttaaaatacttagtagcaatatctataatcatgatcaaagaagttcatgtaattgattctagattctagattccttgtgagcaggaaccatgtctgtcttgttcaatgctgtacgccttatgtataacacaatggtgagcacatggtaattgcttgttaagtaatttctaaatgaaaactgaacccatacagttatgcaaaaaataccacttgaggtaattttttgcatgataacatagtggtatttcttgttcaagatccataaggcagtgagattgttagtgtccacttacatatatgtatatatagtcacaaacaccattggattgtgagaggaatagaactttgcaaaacgttatagtaaattttgcttggacgtcagatttccttttttcttcttgaccatttagtgtccactaattacatatgtgtgcatgtctatttagtttattcagtttaccagacactaaactaaatagagataaaatatgtgtctctatatataatatatataattactgattcattatatatataaaatgactcagtaactctgcttatctttcatcaattttgaatttgccattgtagtacacaataggacaaatcttttaaatcttatttttatgattaattacaagtcaatgatttatagtctgaggtgagctctactgtggtgcatacacattagcagaaaaattaataccacgtgggatcttctttttttttttctaattgtgtagagagctgatcatgacaatctttgatttggtcagggggaaatttctgcaagtgcttcaattctctaatgactgtgtacaagaaacagtcttggacttgatgaaccttcaaaatatgtatcatctccaagactatattttctagatgaattttagtggtgaattctttcaaataaattgaaatgttgatactctggtttctcttcacatcgtattaatcttttactaaattgaatcttttactaaactgaaatgttaaccctccaaggagcatttacttccaaagttcatcaataaatacatcaatgccttgtaaagaaagcaacattcatttaaccaaggcaaaaatgatacaaagttgaagcttataaagtcaggtagtagaagttatggatcttctagcctttgtaacatgagggcagagggcttctagaatttgcctgatttgtggctgataaagagcagcgaggggcttggattgtcttctggacttttaagacctcactgaatgatgaacacacactaccagaatcaaaggatggtttttgtcagacagcaggactagaccagacagtaaagctacaattaagtttcatgcatgctgggaaatccagtttttccgtatgaaagtggtctgtaggtaaagaaactgaagaaaacaaaggaccaccagaaaataagaaaataatgtattgagtagcttcatgttttatgcattgtgttacttgcttatttaggttatcttgtttaatgctgatattgatcccagaccataagtaccttttattttactgatggaaaaactgaggctcaaagagatgacataaaactaatgctgcatcatacatcatagaaagagggaccatttgaatcaagataaagctgactcgaaagttgttccatggaatagttataaagtaatatctcttaataccgtgagtcataagggccaacatcttctccttaatccttatagcactcttttgtataatgtaagatgtcattaaggcttgtctacaaagtttctgtcttctagattctggggtgagatcgcccttatggacacatgaaatcagtaatcttccctaaatcctcaacgatttatcaggaggataattttatcatctccattttatagattaagacagtgaagcagaggtaagtaaagtgatcaaagacctataacagtggagatcccagtgagaagcagtattttgttttttttccttttataatgatgccttgtatgcatagctactggaggcataaaatgttccagacattccttgtctttacctctaacctataagaaaagccacaagcataataatccactaacttcagtgctttttggacgttgaacctctccagaaacacgttggaaatggagagaggatcctagttgtgacacaaaagaccactgtacttcattgacttgtcagagaaaaagaatattgtaacatgttacagtaaattttgcttggacgtcacatttcctcttttccttcttgcctatttcttatctctgcgtttccttttacacagctccagaaacccagtgctttcatgccacctgtcaacaactcaaggcgtatatttacaactgcggttcctacacatatctcatgttccaaaaatacttcaccttccttcttctctagtgccaataattaaaccctggtttctttagtatagctcggctagatgttagaaaagcaatcggactcaataaagtcaatatataagcagtgcccatgtactctgaaattattgtactctgaaaggcacacatcaatacatcacatggattctattgttgaagagcttacacgttgtctagggagtcaaggggacaaatgaggaaagttaaaaaataaaagatttaagtaaaagttcaagataatagataatgagacataagtacgcaattaaccaccatgtgaagtgtagttgccatagaagttcagagagaacaatggattagagcaaagaaggtgtgatggaacacaaacgattgcacctagatcacaatcaaaatgtcattgaaataataatgagctaaaaatttttcataatgtgaatattaatcctcaaaaggttgacaattgatcattatcctgaacttcataatgctattcacccaacatctatttttaaataaatagactctccaataaaacatatttagtctcaaaatataattacaagtatgaccaataatggttaaatattcatgtcacgaaccatgaaaaaaaagaaaaaactctcataaaactactaagtaaaatgcactgaaaatcggcaagaatttgagggcaatgtgtaaaagtgaaatatttgtgttaggatggagaaattaatggtgaccttttttcaaacttcaattttatattattgatactgcatgtatgcacatttcaactttgttcccactgcttccttaaacacatacacacacgctcatttctctaaattaaatgcgatatattaatgtaatgctacaggaagagggggtggtgcaactcaagagttctgtcagtcattctcacagctagaaagagcacgcacagctcaagtagggtgatgcgctgttcgtgactaatgcttcagatgacatcccagctccttatgtgaaacagcaggcttttatatccagttaaacaatatattcatgtgagactgctgtgatgttgggcgtagaaggctgcaggctgtctactgcagagttcaatggtgctttggggaagaaattagaatcttagtgcatgtctaactagcttaagtaatttcttccttcacatccctctcttatgtggatttacattaagatatctaagtgttttacacaaagatttgtacaagcacttgttcccactagctacttacattcaaaaattttggtttggatattgtttcatcagattaatttgaaataaatacaggtaaccttgtgaattttggatctcattgcctgtgtggaatgaacagtgatttaaattttcttccctacacctttaaatgctgtttgtttcccattgcaaaggcactggagtatcatatcaaaaaccagcagcaagaaatgaaaagcagcagggacaagcaggtaacaaaatacagaacttactctgataaattaaaggtcatactctgttatcatgcatactaaagagttattttgtgccagttgtgtagcatttaagacagaagaatggtttaacagctacaaaaacaggcagagccattgatagacatcactaaatactgagaataagaaaaatgaaaagtaagagcagccccacattaccttacaaatggcattttgccattttcccagatatgagaatcttgagtactttctaaatcataatgtcataacatttaaacctatccgctctaataaaaacctaaatatatattttttctaaagtgtcttttcccagttcttgttttttgaaaattggaaaattatgtggttcagctgaaatttctacactccattatcagtcttgacttttaatctagtcttcttaatattcaaattggtccacggaaaaaaagataggtgaatgtttcatacacagtctgatgtggcctataaatggaactgcgaaagttccctattctcaagtggaaaagaaaagtctgattattatgacattctgatcttattttcaatggacttcaatctctctcttccagttgtaactggaatgcaagatttttttttcaattagaaagatgaggtttgtccattgtatgcaaataatttaagattaaatggtctggaattgcaaaggaccaagagttggataaaggtgctggataattgctagccccattcaattttataaaatgtaaaaccactgaagtaaaataaccatttttttctttttgtagataaattgaatactatggatatgaatttaaattcctaaaataactttcccctaatacaagttaattttctctaccaccaattatttcttaaaagtaattatcctgtggtcagaatcactgaggaaagagaacccttgatggttaagataatgagctctaattcctaggttcaaatcttggcttcaatattgactagctggatcagtagcataacatcttttaacctcagttttctcatctgtaaaacagatatttgtaagaatagtatccataatatatgccaatctcttagcacaatgcctggcacatggtaagcactcagtaaatattagcccttatattgtagtcatgtcattgtttattctctagtatgatgtgccttacacaatatatctaagaatgtgtacatcacaaaaaatattttttttacccatctgatcatagaaagttgaagtaaatgtgaagaagagtggaaaataaatctattatctttcccagaatgagtaatggccaaagagtgagccttattatgagtgatatcccgaacgtaggtgctttatcaaaatcactgcactttctcccaagcaatgtcatctttattctcagaggtttatgcatgctacttttaagtcaatgggaacaactgaaaagaggtcattagctggaagaaaccacacaaaaagaaaaagccaacagcccctgccctgagggaaaacagaattcagggtactaccatgtgttctgtgacagcagcatggtgacaaaagctgttcccagaataagaatactttggatagcaatgaagtcttaaaatgacattttaatccatatattaatgcttcaaagggatccacttcaactagaatgccttaactcttctttttgcccaataatgctcctggcaaagaagggccacagaaaccatgaacaggagtggatgctgcttgatccattttctgcaaaatgagatttggggactggatggcttctaagctgaccctcaatgctaatggcccatggtcccaggtatcagatggtgttgttgtaaagacaagcattaggccaccttgttaaaacatggtgattgtggattttcatgaggaaattaattttagagccattaaaaataaaataccataaatgttttttaactcagcaaatatcttttaaaaagcagtgaaatatttggcttgacatgttcttttcttcatctctctctgtttttaaaactaacttatggtgccttgacaattttatgaagaatttcagttggcatctgtggagatctttataattaagccattacatttttctgaaacgtttcatgttttaagcttgtcttctttccactttgtgctatacagacacacccacctcttatcactgagacatttctctgcattctttctacccatttaccacagcatgtcatggttttgacagccatcttaagaggaggaaggcagacataggttagatttcaggagattttgggggtttttttttttttttttttttgagacagagtctcgctctgtcacccaggctggagtgcagtggtgcgatcttggctcactgcaagctccacctcccgagttcatgccattctcctgcctcagcctcccgagtagctggaactacaggcacccgccaccacacccacctaattttttgtatttttagtagagacgggttttcaccgtgttagccagggtgatttcgatctcctgaccttgcgatctgcccgccttggcctcccaaagtgctgagattacaggtgtgagccactgcgcctggccgagatttcagttttatacagagtagttaagacaatgaaggacaaggcattatgatactaggaaatagagaagtttgtctcctcttcatttgaaatttttagcactaaagagattagatcagaaaaatttaagaagaaatctgaggacttcaagtcaatggctgctctttgcaagccctttttgtccaaagtgtatcaaaataaaccttttcttggattgctgaaacacctgtgatcatgggatcagtacttttggagctatttctggttcaagagacattctcatgagagttcctttccaatcaaatctgtcaggggctgacttaaaaacctgtaagtgggccagacacggtggctcacgcctgtaatcccagcactttgggaggccgaggcgggcggatcacaaggtcaggagatcgagaccatcccggctaaaacggtgaaaccccgtctctactaaaaatacaaaaaattatccgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaaaaaaaaacctgtaattggctcagtgtaactcagactaagtagagatcaccaattaaaacccaggcatcctaaataatgcagtaggtacagaggagaaatagttcattgcataaaatatatcagaataaaactataaatttctctacttccttcagtatttcttcttaaacttaagctacctgttatttctagtgatctctaaatgcagaacagaatgaagacaagataaaaactacaaagatatcctatcaaatttgagctgatgctccattactaaggacaattggaattgatgcacacacatgttcttctccatcttttttatagcccaatagatctacagttaggctgtgtcatatacaagaagaagcctgaactaactaggccgtataactctggcctgattaacactttatctaatactttttctgaagtcttttaatctaagtcttgttttgacttcattgaaaataagcagtttgttggtaatcgccacacaagaaccctacacatacttaaagactgttatgagctcaattgtttatcccccaaattcatatggtgaagccttaacccctaagacctcagaatgtgatggtttctggaaacagagactttaaggaggtgattaagttaaaatgaggctgttacggtggatcctaatgcaatctgactggtgtccttataagaggaagactggacacacaaagagacacaagggatgcacaggcatagaggaaggactatgtgaaaacccagcaagaaggtggacatctgcaagcaaaggaaacaggcctcagaaggaatcaaacctgctgactacttgattttggacttccagcctccagaactgtgagagaataaatttctctcatttaagctaccactctgtggtattttgctatggcagtcctagcaaactaatacagagataatttaaacgtagtttgaaataatatattgttagtttattcacagatctttcatattaagatgtgatagtattttgctgccagttgctaaaatagtctaaaagcgagtactcatggatttgcacacagaataaagctctgtgttaatgtcaaaatcatgtccattttaattattaattttagttaaaatgtattttgtcctgttctggttttgctgcaaattgtaatattctacattacagtcctggtaattagtacagttaccaaataaactctatccatgtacattttttgcatgactaaaactataaaataatattattttcatcatgaaatatacatgattatatgtagttccattaatgtatatagaacaacttttccaaaaggaactacttaacctctcataccattaaatgaattttcttgaagaaaacaaagtattttctactaccattttcttcactttgtggctccttataacttccctccttgtaacacctgctacgcggatgactgcagcactattaaaaatttactgtcagtgttagctttccaagttatggaaaaagtctcagtgcaaaacaaacaataaaagcaactctgcataagacaaatccttacttatgttaatgattacatgcggtgacattgtcttatttaaatatgcttatattttcttcaatttggaaactactgtgagatcccaaaagatacactgtgtccacttcaaaaactctaaaattctaagtaccaaaggacaagcacatatttattcacactaatttttatccttaggaactgcctaagaaatttaaaaaaaaaaaaagaaaaagtgattttgagagattataattagttttgtgaggcttgctaaatagtcatggcaaaaaaaaaaataaaacagcaactttcactgttaatttggaatgtttatcttctactcaaaactgaacgaatgtcttacattgttgtgctttttctttggtgcttatcactgaagaagaatgccaattccaagcccaacttggacatatacctcagtaaagctgccctgcagcagggctgaccacctccactgaaaatgcctaggcacagtgaaggcccagcaagtggatgacggcatcagctggtcctaaaacaaaaagacttgagtactatatggatgtaatgacctcaagatcccctatatttcctaagaaattagacatagcttcatcattttcacctatgaagacaaacttcaaaatatttttggcctgctttttacttaaaaaaatgcttatgaaaagggagtggacaaactttgtctatgcctttgtcttctgctctcttttgatgttcctggagcctatacccttaggaagaacttgatcttgaattacaatatcagtgtccttcaaattccacttcccgtgttatagtaagcaatgcctggactgtcatgtcacctagcttagctccagacatttgcagacatttattctggcccctttagactattccctgcactttagccagaaaaattatttgaaatcatgtgttatctgcaacagactatgtgttccaagggggtagtgaccattcctgcactccatgctgtatccctagcataagtccagacacatagccggtcttaaataaatatttctgaataaattactgaattcactgggattacctctcctcagtctcttctgtcttccactatcctttgttctaacatggcttatcaatcataattaacctctagaatacttatcaggcctcactcatgcttccagtttcttttccatgatccagacttactgaatttgccttctattcctttcaaatcctgctttttgctggcgaaaataggtagtcacagtagtgctcactttttttaatgcagtagaaaaagagaagcaatttgacattaatatttagatatggagttaacttccttcttgaaacttgacataatgactctctgctaatcatttgtagagatagtcaacaattctagtttaggtaggaaaattgagaataaaaaaaaagcataggcctgttaatctctttttaggaagagtttgagcattctgattagaaacagatgtcatataagctcttacacataaatgagtgcactattagtttgatattttatcgagaaagaagcaacatgaagaaaaataggcatattttatagcaacttggtacttaatagagtttatgccaaaggaggtcagtgcaatgcattttcttttttagtttttgtttgcacattttttaaggcctggaaagtatgagggtatgagtaggatcccagctgtgccaattaatgacacatataaccatagatgctttatttggctagtctttaaaataaacaaaaaaattataggttgccagattttttgaggaagaaattttctttgatgactgagctaagggaccccaacacagtatattatcaagagtacatcatttttaaaacattttatattatcactataatttaggtaaaattatagtatattagcactagatgatgtattcttcatcaaaaatgaaaagtttccttttagtagccatagaaggaagagttcccaatttaaatctcacgaaatcttgctttcttaaatatgtaaaatataacacaagatttatggaaaaaggtagtcaagtctatttgatttttatggaggctagaacattccagattcaaatatcatgaataaactcataaacaagttactatatcttctgtaaaatggggataatttatgaggttacttttaagaataatatgtaatgtctgtaaagttgctgggaacagtttctggcacatatatatgatggctactattgtttttatagattacatagaatcacagatccttagaaataaaaacaacttgagctagaatctggtgtaattcccatccaatgcaggatgatttgataatcttgacaaattggtctcttgagctctatagaattagaacagagtctaaaagttaccatagcccaggaagagttgaagtacattatcttataaaactactcttgttcatgctatttcctttctaaagtaaatgtaaaaagtatggaaagagcatcatcacaaattgtgaatacaatggagcttctcattttggtttgttttggtttggctatacatgaaataccttaattccattcagtcattatgcttagtttatcaagttagtggccttctggcatattcaatacatacaacggtaaagttcacagtgtgaaacttaaatgacaatacaatgaaaacacaaacagatctaatcctagatttcctattgcaagggcaagaaattgagaacactgtagtcaggaaaatgtatatcaggaaaatgagatttacaaacaatttatatgtatagaaacaaaacaattaaaatctgaaacagactccaaaatgtaaaatatctgacctcacagaaggactttgaaccctattatacacctttcttcatccatgcaaattctatttattctattagtctactttgacgagtcactgaagaattgagaggcaggaaaatatatgatgaaagcaattttaaaaagataaacatcttggctgcacaccagatggattaaaataatggagactggggaggaatatttattgtttatagctgataacaggaaaagaggcccaattgtgtaaaaagccttagatcattaaaataatgtcagcccaagaataaatgcctcaacaggaataaactgaacaccttatcataatcactaacttagactgagtctagtttctccaggtaaaattcaggcagtagtctcagctctaccagtaggcactgcatattacaggaggtgacaaatgttccagattgcctcaaatatcttggtttgttcctattatataggagtaactatcaatagtgcttctttttttatcagaattgtgtctgtttgaatgataatttttatgatcttctaattatcgaatgccactgtggaaatttaaaaaagaaaactttcctggattgttatagcttaagcaaaaggcttgggcaatcccaacgtgcttggtgacaaaggaaaaaaaaaacagctctactttcaggaaatctggctatgtacatgcacatgacttggagacccaagcacagactgtatttcagcctcgactcatcccctccgctgggactctggggcagcacccgagctgtctaactctacacagtgccctgtccaccagctagcatggtttctctaatgttcatttaccaaatttcaaatgaattccttagcacccagcccacattttactcttctgtgatatcagccttgattactgaacaccattctgttttctaaaattgtacagaacatatattttgtgccactcatttgaactatgtctttcttagtaatgtcttcatagtgttttgcttggagtgggtttggggacagaagcggtactgcacttaatgtctgccagggtcaggaggaacaatcttaagtttttggaaaggtttgtctccatttatgtgaactgaagtctgacagccaagagaaaataaatttgttcccagaaagaaatacaaactaatacggggaggttagtgactattgcagttgcaggattgcaaaactaaactattttgactaataatatagtggaattaacttttactcagcacttactacttaccaggtttttaccaatttctaactgttttgaaattaataactcatttaaacatcaaacaaccttatgaggtaagtactgtcattgtccccactttttagattaggaaaatgagattaaagaacttggcaaaaaatttcacatctcatcaatgtttgaactaggatttgaacccatgcagtctggcttttgaatgttccctctgaaccttcatgctaacctgcacacttaacttgcattaagtttgtagcatatgtctggtttgatcatttgatgtgtggtatatattcctacagcaattttagtcattaagaggagtattcaagttagacttggcactcacttctccatctagacaaagaataaccagcagacaggaagaacactattatgagaatgcttctaatcacaaaggacccctaaacagcccttacagatctgaatagaagaagtaataaccagtggtatcacaaccttagcacaacaaaggtctgagcatcatctgacctggtgaggaccaacaataacattttatgaattattttttaggggaattaagaattatttattaggcagcattgcataatcctacaaagcactggagtaggctttagaacctatggtgttggcaagtaaatgaatctccctgtgtttgctcatttatcacaaggagatactgtaagctgtcttataaagattctgtgagtgttaatgcaataatgtttgtaaataaggtatgtaaaataattagcatattgccccatatagagtgcccactacagactgcatgtctaacttattgtttcggatactagctcttacaaataggcaggaatttcaaaaggttctatgaatgtttggaattttggatgagttctgttacctcttcaccccaatgctggcgcaacatgaatttcctttattgaatcaatttgacagatttaacattctatttgaactccatttccataaagcacaggcctcatctaattatccccaggtctgccttctactgtgattgtgctcattctgcctttctttttttactaaagcaaatcttttcatttaaaaaagcttccttttgcttgtttcgcctctaaccacaaaatgcactctcgtccaagtcctctgccaacctgagcaataaaaataataaatgagacaactgaagactctacttggacctttaaaatgctccagcgaaggtgaccctgaaaaattattatggcatgttatcaattaggtgacactatcaagaaaaatgaaaccaaaatattcctttattctgcctgattttatatctcataaatcctgctaaaatacttcattggaaatgcatatggtaatatctagacaggcttatgttagatatattctttttggattctcagtggacattttacatattagggccaccaatatagataatatgcccaagatgacaaattacttcaataatacttaacatgaggaaagtctgtctcaactttgcggggaggggtaaacacagctgctttttaacacagttaaattcataaagctaaaaacaaaacagactttaaaatgtttaaaagtctgtctttgagaaatattctacccatgaggctaaatttgacacaaaatattcatcatcataatttaaattttaatatatggcctatttaaaggcttcatacttcaaaaggtttttacatttattttgtcattctgtcttaattaagaaccaactccagtattagattaagttacacctttggattgttagaaaaattaggttgctattcttctggaataaatctacttttccaataaacacatgaacatgtcaaaattttttttaacaacaaatgcatttgacttacaattacacaaaggcattatgtttaattatttttttctgaaatgttatatagaattgagtaaaaggtatttttaggtggaaaccatttctaaactcttatttcaaaaaaaaaaatcttatagaatgagagttccaaatacctttcattcagctttcctcctgttaataattaaataaccattaggcagttatcaaaaccaagaaagtaacactgataataaactgttgactaaagtatacactttattttgttttaccagttttcaactaatgtcctttttctattgcaggatctaacccagctcccacattgcattaaactgccatgtttcctttgtcccttcagatgtgtctttttttgtaattcgtgtagttaacacttttgaagaatactggccattttgtaaaatgtccctcaattttggtttgtcgtagttagatggaacttatggatttttgttgagaatatgaataccaaagaagtgaagagcctttcttagcatgaaggttcatgaagtcaatattttttattactggtgacatttaacttgatcacttaaggtgatctgctgagtttttctgaagaaagttactacttttacttggaggaaatatttttagactacataaattactaatttctactgaaaactttttcgcacttattttggtatctattagggaatcccgacttcaacaatttttacattgggattctaacgatgaattcctatttccatcatccttctacattattaattgtaatttttctgtatgggtgagctgtctctgcttccctatttatctatctgtatatctttctttctatctgttcagttacttgtttatatctctatgggttcatagatgtttattttactcttttggttataatcaaatgacatatctattagttttgttgctcaatttgatctagttctggcccttggaagttttttcggattagctcttacgctcctttgtcatgcttctctctcaggggtcaataaagtatgccctacaggtaaaatgtgtccactactatctatctaatattgtaaataaagatttattggatcacagccacacccattcattttcctattagctattgttgcttttgagctataatggcagaattgagtaattgtgaccatgtggttctcaaagccaaagatatttaatatttggccttctatgatgaaaatttcttgatctttgctctaggcgaattttctttttttaaattatgaactttgaatagtgcccaaaatgtatttaattgttatatctgaggtactttagaattcagactcttgaatgtatatttttcctatattctcctaacttcattagttgtaataattttgatgctagacatttattattttgtttgaagaaaacaaaatggattatcagtattctattgagtttaaaatactaaatcatacagaataagaaaataatggtgagacaaagttgaaaaattatctagtaagaggagcgaaagagaaaaattgtcctcttgcatgatatgttttaaagtttcctaaatacatgcaaaggcctttattaacttcttcccataataatgaacggtaatatggtagtctcctcttattctacagtttcagttacccacagtcgaatgcagtctgaaaatattaaatggaaaattttagaaataagcaattcatgccatttcagtaaatggcatgcaatttaaataataaagttttaaattgcatgccattctgagtagcaagataaaatctctggccatcccactctgtccctcatgacacatgaatcatcccgttttctagtgtatccacgttatatagtcggttagtcacttataagtagccacctgggttatcaaatcaacagatcacaagaagaagggtgagtatagtacaataagaaattttgggacaaggagagagagaggaagaggccacattcgcagaacttttattatggcatattgttacgattgttctattttattactagttattgtcactaatctcttatcatgtctaatttatacattaaattttatcatagggatatatgtatagggaaacacatagtatatataggttttggtactatctgtgatttctggcatccaatgagagtcttggaatgtattcctcaatggatacagggggattattgtactttccagagatgttatattgatagcaatttttatctttatgatattggacacagttatttcaccatcccacttcacaatcatgagatgattcactgagagacctttccaaatgaaactctgaaaccatgcattttggttttaaggatattcattatgtaatgccccaatgttataattatatcaagcatagtatcagtgcttaaaataaatttattagaaggataatggcattcttatgatcctattttggagaacaattgttttaaactggaagtacaaaagttggtcctattctgtgaaaaaaaaattatctgagctagtaaaggctacacccagagggctatgtcagtggttagaaggttattagcaggttagtaaagggcagccacatttcattggaagcatgtttaattaggggaggaggaggtttctcctcatatgttcattacacagactttattttttcctctaatatctcaatatcctcaaagatcacctagagcagaggttctgaattctaggtaaatgggcctaaggatgcaacccttaaacataacatacataattttgtatacaaatgtagatagatgtgtatttttctaaagatagaatgttctactttattggattcctatggaggcagagattcaaaggaagttaagaaaaactgatctagattaatgtctaaaactaaatacagttacctaagctttatactctacataggaccttgacaccagtgtatgatattttatcctttttgatactctgcctcctcttgacggcactttcatttgtttattagaagttaagtgacattaaaaccaacttattcctggccaggcgcagtggctcatgcctgtaatcccagcactttggggggctgaggcgggtggatcacgaggtcaagagatcgcgaccatcctggtcaacgtggtgaaaccccatccctactaaaatacaaaaattagctgggcatggtgttgtgaggctgaggcatgagaattgtttgaacccaggaagtggaggttgcagtgagccaaattcgggccactgcactccagcccggtgatagagcaagactctgcctcaaaaaacaaaacaaaacaacttattcttgagcttacaagatacgaaaagtgggtagacagtggacaaatataaatagcatgaaaatcatgagacttgttcatagttgacattcaaataatgacattaaagctgagaaggaacaaatcacatagtacagttttaaaaattgttcatcatacaccaaaatactagctattatgtattatcattataaaaatatataaataaatatgtctgtgctatttaataaaagctcctgaagatataagaactcagagtgtttgagaaagtattacgagaaaggcttgtcattgagttgggaatgtgacttcttcttccattaaagtcagctatttataaactataaactatatgataaaacaaagatacttttaggtaatagtcaaattataaaagcgactgttataaaatataaatattaaaatcaaccaaatacttgtaaataccatctgaagtttcctaaaaacctaatactctttaatatgtcattttttccggccttcagtgcttagctattcctataacttgtttccacctcatttcctaaaagctagatttctgcattgtagtgacaattaattttttatatctgacatgattaattcattttttgtaaccagtagttagattcattaacctgattacccgtatctttggtgaaaagtccttcaagacaatctcagccaatatctttagccacacttatttaaaatcatgataatgctattctctgtttaacgtgactacttttcaggagtgagaccagtataacccttcattatgataagaacttaaattgctaaacaaattgtatgttggaaacaataatggcagacaagaagttaaagggggaaattttatgaaattttatgaagggctgctatttgtatattacaacataagatatacttggcaaaagttcttaaacacagtaatgattaataaacatttctcaatttgatttgatgggttggtttctaagtaatttgttttcagaatctgagaacttttaaaagtaaaaagttcattaaaaactcgcaaaacagaataaatttttattgattaaatgtttcaaaatatatttaactcatttttaaataagcttaagtttagcttcaaatacgtaggaaactcatgagttgctatcctactttattgagctcttgttttctgatagtgataataaaggcacctatcctccccacacagttgcaaaaaggattaacttaagtgagagacaaaaaagtactaggagaaatcgggaaagaagaggtttgacttacatgtctctatgtcattcccaatagtatccaaatagcagatacccaacacgtatctgaagaaattaatttctcagattatttcaattttgtcagcaataaacatttaataatgcatttgttttgggggcaaaaaatcagcatattctgaaagcagaaaaaaagggcctgtttgggtttcactgagctttcagaattgcctggacaattatcaaattggccctgtgatactctgtatgttagcttctactacaagagaactttatgaaagtcactgataggtctcattgacaagtttcctgggatggaacaaagaacatttccataactacatagcaataatggaacaaaaatggcaacttacagacaaactacaagatttcaatttaaggaatgaagcagttaagcctagttgatataatatcctttacttctgttttaccacaactcttagaaaacatctgcattatctgtttgccaacctgtgtagtttaaatgatgccaaaacccatcaaaccatcagagaatcttgctctctcttttaacagaaaataaaaaaatgctaacatggttgtgtgtccagaattggtgggttcttggtctcactgacttcaagaatgaagcctcggaccctagcgctgagtgttatagttcttaaaggcagtgtggacccaaagagtgagcagcagcaagatttattgcaaacagcaaaagaacaaggcttccacaacacgcaagaggaccccagcaggtggccagggctggctcgggcagcctgcttttattctcttatctggccccacccacatcctgctgatcggtccattttacagagagccgattggtctgtttttcagagagctgactggtccgttttgagagggtgctgattggtacgtttacaatccctgagctagacacaaacgttctccacctccccactagataagctagatacagagtgctgattggtgtatttacaaaccctgagctagatacagagtgctgattggtgtattcacaatcccttaggtagacataaaggttctccaagtccgcaccagatcagctagacacagagcgcagattggtgcatttacaaaccttgagctagatagagtgccgattggtgtattcacaatcccttagctagacataaagattctccaagtccccaccagattagttagatacagagtgcagattggtgcatccacaaaccctgagctagacacaaggtgctgattgctgtgtttacaatcccttggctagacataaaggttctccaagtccccaccaaactcaggagcccagctggcttcacccagcgtatcccacacggggcggcagatggagctgcctgccagtccggcgccatgcccttgcgcggtggatgagactgggtgccgcggagcagggggccgcacaggagcccgtggcggggggacactggggaggggaggctcaggcatggcggactgcaggttccgagccctgccccgcagggaggcagctaaagcccagtgagaaatcgagcgcagtgccggtgggccggcactgatgggggaccctgcgcactctctgcatctgctggccctggtgctaagcccatcactgccggggcccacagggccggccggccgctgcaagtgcagggcccaccaagcccacgctcaccaggaactctaggtggcctgcaagcgccgcacgcagccccggttcccgcccgtgcctctccctccacaccccccgcaggctgagggaaccggctctggccttggccatcccaggaaggggctcccacagtgcagtggcaggctgaagggctcctcaagcgtggctgaatgggcgccgaggccgaggaggcaccgagagcgagggagggctgctagcacgctgtcaccttttagttgccttacagtaactgtaaaaattctgatatttaaaaaatccaagtcattgataaagtaagaacaagtgagaagtctgataatatatcatttctttccatctccttggacacaatttctcagaagctaagcttagaattttaggaagacacattcaatatactacttaataaaaaagttcattatgtttcatcatttggaataacctcaaattcccagcaaaattgaacactgtgaaaaaagataattaaacaggaaaagtcagagttttagacacttgtttaatttactcagctactgtatttgtggcttcagatttctcagagtaagatttattacagaaagttagtattagtaaacatttaatgatttccaatggaaaccaaacatttatatattgaaataaatattcatctatgcatgtaagtatattttggctaaaaaccaccagaaaaaaaatgctttgacctagaagtttaaggagggatgttgatttattcaacaactatttattaagcaccttctgtgtgtcacaccctgattattacgtcttttgttagactctactcaaaattggttatttaaacaataattcagatattccatatggtttatcagtttccacaagacttatattttcactattttacttttagaggaaggaaaaaaattagtcaaacatttcccatatctatacatttaatgagaacatgggcaagtcttcttttaacaaactttttctcccaaatgattcttaagtattctaatgttctaatggtccataataatttacttaatttgctaataaagtttctctagtaaagttagaaaataattagtgcttactaacgagtattattgattcaaaactttagtgaaaacaaaatatggttattataagataaattataatttatcatataaattataaattctatggttattataagaaaattttttttatgtgttactatgtttaaatacccataagatagtcttgtgtgtatatgtgtttgtgtgggtcagcagaaatagcagactgtgacatcgactgatacagttaggatcaatcatgtaagtaataacatttagttatgaagaataggctatgctatgtttaaagatgcatctaatgatctttgtatattttactttatgtttcccagactttataaaggaaggtgcatagcttgtagacagcagtccccaagtgtagtttttactctgccactaacgagcattgtgatcttgagcaaaccagttggtctcttcaaggttccattttgttgtttgataaatgaaggacgtggaatagaagaacgttgaagttccttccctccttcaaatgtaatgatcatgtaaggtagattgctttaattacatgatactttgaaaaattaaattaaacaaatattaaaaaatcattaaattaaccaacacttcagtaccaaccctgcaatctctaaataatagagtgacttaaataaataataaattactgatgacttgaattaaaaataaactaatcttagattaagctacactaaaggtttggaatttagggtaataatatgacttcctgagccctgaaatattttaccagatttcatggatgaaaacagagttaaggtttagatctaatactcataagctcttccagacaaattgcatgatcacgagaaaagatttacaccatctctatggagtcttagagcatttctctctttctctcagatcctcttatccctaaaggatctctttatcttaccactccagaccaccattttctattttccttaaacttaacagtaatcaaactcggcattttgaaagttaatacattttatctgacatgttcaggttttctggatcctccttatctcccaatcagactaatctgttggcaaacatgaataataatgtctttgacttctttgttccttcctacaactggtttccatttcattggtacctaatgctgtctggtgacacacagcagcattagaacattgaataattgctggttaaaagagagagagggggagaggcagagaagaatgagagagagagagagagagagagagagagcgagccgaaaatgcgggcatgtctctccttctattaagttgttcattagcttttacagtgtattttgcattcatcttgtttattttctcacattctactttagtactttatcttttgatacctggattggttagtagtttcctaaatagtttgtctgtctctatcatttcctgctaatccttcctaaatgaatgcatgcttgaaaagacctaaatctaatttgctactgatttcacaatcttactgcaccactcacttcaaaatggtctcttcttccttggaacgagttttccttttatatcttattcagaaattagccaaatatgatatgataactctagcactttctcacattttatatttctaatcttgaacttttttttgcctatctctgtaaccagactgtaaatttagtatgttacttttatgtagtatatatcctttaaatatttgttgatttaatatgttaacttgagtataaaacgaacatttgaccttgtgtagagtgtaaaagaaatcttttgacacactgtgataggaaaacaaattcaaaagtttattatcaaagataactgtgatttatctgaagcaatctttagtcagggtaagcaagatgatgttaggctttgtgaattaatgttatgagaaagaaagtctatttttgtggagagagaaaattttcccgcataactgtaattagggacaaatcagagattaatgatgcattatattctagagctttaactgataagcaccaagaaatggctttctcaactttaaatggtttgtaaaatattatctctgtactttgctctctatatagaaaataatggatactaggtcttctattcagaaaattcaatatttattctaaaatgtaaactgttgagttacaggaagatttcatatactcaaaaagagcataaaatctacctctactaattagtttctctatgaaagccttccaggcaattacagagcagtaccattggtcaatgctttggttgcttttcattaaaggtatagtgttgctaccagatgaattgcttcatataaaagcacttaccacaaagacctataatggaggttaagtgctatactaattactaatttcaatccttattacctatattttgcagtacaggcactttaaaggaaccatatatagtctgctggttcccgcttctctgagtataagacttggtggtaaaagctctaatttagctgttcttctaataaaaataaccccaaaaattaataaaaagagccataccacaaactgacataaaatacatatactagactttgctactgaactcgtatttacaatcaccgtgtcacaaaaactttaatcaaggtgacacactcttcaaaatttgtattcagccattatggcaccgttgcagatgaagttccaagagaaaaaggtatttgaaattttcatggcttatttcctacctcagcatcacactgaaatgaacacagagcagatgattaataaaacatctgatgacaatggtgactcccctgagttctttatatattgatcattaactttttatatgtatatattgaaattcttcatatgtgctttattttcttgagggccgactctgtgttttaccttgcgtatatccttcagaataattgcaactttgcccactcttggtttatttatattttctaaaatacatcttggtaaaagggcatttaaaatctctgattaaatgttgaaagttgtatctgaaataactatatgtaaagatttgcttcttattacgatactgctcatttctatttttaaacatcttttacattgtgtttcttattctgaacaattatttaattggcaaataaggtactatatgtgttaaacaaatattaatctagaaaaatatgtacaaatatttttttcaaataattaataagtactgcctcaatctcagctaccagattcaaattggacattagtctgctacaagaacacaggaaccatatcttttttgaactatattcagtacatggcatctggtatgtgcacagtcaaataaaatatagtaaaattggggcatatagacatttttgaaaacataaaatatttactaaaatgcaatgatgtttggctaatatatcctatatttattttctatcatctatgcttgggtaaagcatcctgtatttctcttttacagatacattatgcatattaataaagtccaagtatagatattttaacttagcttaacccagaatttcccaaactaatgggactttccctttctcaccataagtagtaataagctctaggtaaagataccagtttggaaattgctgattaagtgttaaaagttactaaataaagacattttcaagaattaactatgaacacaaaaccatgcctcaagaggcaaatgccacactgcaatagtaacaggatttatcattttgcacgttcaggtccactgttcacagctgacaacatcccatgagcaaagcctagaccttaccctactatatattttcatggcatccagtgtgatgactttctctcagcaaataggcagtgattaatccatattttaggaaaattaccaatacacctttctgttattttattaaggttttagctattacttttaaaagcacattttttaggctgggcatggtggctcatgcctgtaatcccagcactttgggaggccgaggcaggaagatcacttaaggtcaggtgttcaagaccagcctgagcaacatagcgagacccccatctctacaaaaaaattttaaaaattagccaggcatggtggtgtgcacctgtagtcctagctactagagaggccaaggaaggaggatcctgtgagcccaggagtttgaggttacagtgagctatgactgccactacatccagtctgggcaaaagagtgagaccttgcttcaaaaaaaaaaaaaaagttaaattgataaagaataaaaattgaaattgcacatttatactaggatttcagataatgcaataatctgggattagcaggggctatgtaacattgcatgcatattaagttacttggctttcaaatcttccattacttcaccttattgtatatggttcacataattgtagtgtaaaattgtggtaattcccaagacatcgattcagcaaatatttactgaatgcctactatttgccagtattataacaggcactggacatattaatttccttgcttcctaactttgtcatagagcagtttttttattacatttaattcagcaaatattggcagagtactaggcttgtggaataggtttgaactagggcttgaagatttagaattctataaaccagaaaaggtccagaagggtattatagacatttcattccacaattgtgagtcagtacttgggatatttgatatcaattgaatacattggttatgtcattaaattacttctttcaagaaccaaataagtgtgatagaagaatttaaatataaattttgattattatttttattgggtaaaatagaaatgtatttttatactttttctttatactgtgttataaattgtgtgctttgcaaaaaacatagttatatctaaaaggggaagagagaaatgagactgatgcttttagtaatagagacgataatgattgcagtaaaatatctttatacttttaatttatatattacttaaaaagcatatttgttttaaaattgaggatatatacaaccacaagtaacattgtttaaaatttctaatctaccacctttgtttcaataacataatattgataaaactcattcacaataaacaagataatttttattttatcaataacggcttgacatttattttatagacttaaaatgagtagtgctagtgtcaaagaatcctcatgaaactctatggttatatgaaagtgaaaacaaacttcttttatgtacatgttcttataactgctgatttatgctactattgttttctcactagttctctacttatctcacgggatccctacactttaatgtgtttcagctgtgcactaccatctgaggaagcgttaggtcttattttctctcagaaaaaaaaagtgttataatattctttcccttagttttaaattttaacttttttacttttgacaaagcctttcctttgtttaaatgcaaggatccagtaaaaagagctttgatatgttgtgctttttatgtgtgcatttttctgatttcattgatgtcctgaattttgaaaacgataatgtacaccttcacgttctcctataaaatggcatttgtacactgtagcaagaacagtttaggacagcattacattcacatgactctaaagtccaataaatagttgatggtttctcagaaaaccacaatttggtgaaacggatgcaaaacagtgctttttcttccagtttgtttttcataaaatcttcccccgatacatattcacttgcttacctgcagggtagcgctcgatcactggccagctgtccacctgcaacgtggcattgccaccactcctcgtgaaacgaactacatggtatttcccatcattaatgattgcattggattcttcaatggcgatgtcatctgtcccaacattaaacttaactccaatttttccctggtgctgtaagagaggaggggaaaaaagagttgaattaagttgactagtcaccatttaataaagattacatacaaggtattgttttaaaatgtgctttggacaacagctgctttcctccaattttacttctgaaaaactacatgtagtagaagcaagattcttgacatctgggtaaatttaagacatctctttcatggataattgatattccaaaaggcacactttcaagggaattgagccgccttcttcccagaggttgtcacagagaaggcgcacagctgcctgcacaaaggacatccttttgtgtactttaacacaacccctttaatccactctccccatttcacaagaaaaacggggctccaaattcttacttttaataactggtgaaatcagagcaatgatgtctgtttagagcccattgacaaatactcacaataggggaaatcattctaaagggtatggggcatttaatgagtgcagtcccttagtcagtattcacaaaaccatcaaatactaacagcttgaaagttattcaatgtttttattttattgatgatgaaacatcaacattttattgatgataacacaggaaggtacaagacttgttcaaggacacataatagagacgtacgaaaactaaaattcatttcccttattcttagattatatctaagctaagttgaagcaaagataccgttatccaaaatgaacgccctcttcacttcttcatatgcaaagcctcattatgaatcattctaactataaagttgttgctgttaactttagaatttcataatataaggtggcaaagagaaacatgtgctatgtcctctgcctctgagaagcattctttaacaggactgtcaactctaccatgaaatcagttgatttctaaagcatgtggatttgtccttaatcagttgcacagaatacctgtgctgtaggcccttgtcagaacacataacctcaaactgtctgtggttcacccttcttcaaacctcagttgagagaaatcacacggaggaagaagggtttaaagtacacacagtccatcctttcctgtagaagttttaaatcagaatgttagaaacctgaagatttgggccacattctcttgactctttgtggggttctcatcattatttgaactaggcagcaggagtatggaatcagcttacactaagaatccttacggaaaatctttttcaaaattgtattaatcaaaggaaaatatttgaggatgttattttgcagtattgctcattatctccttcatgtagagatcctaaaggtttctgttggttttcttccccctgggttcttattgtacataaagatctctttcttataagttagcatgcttacaattttttttggtttgattagctttaggcttgacggatggtttaacttttttaaaaaatcacattttaacactatatacatgtttgttaaataaagataacttattatgtctcttaaatgagattctttaaaatttttctgtagagttatatcacatgtgttaaaaatgtatgtactaaattaattactgaaaatgagcaaaaagtaattctgttaaaataagaaaataatgcatgcttacaaaaaggtctgagctaaaaaaaaatctttaaaaaaatctccataagtctttgaataacgtttgaattttcattggacttttgctgtttgtttattagctgagtcagtctacacaatactaaaatgccttacaatgacatgtatttaaaagtaagggtcatgagaaatatggtggaaaataataagtccaggggaaaatatatactaaagtctctgcagctattaaaattacccagccagaagtgatggcacacatgtataatcccagcagtttgggaggccaaggtgaagaggattgttcaagcccaggagttggagaccagcctgggaaacatagcaagatctcgtctttactattaaaaaaaaagaaaaagaaaaaaaaaagaaaatctgggcatggtggcacacacctgtattcccaactactcaggaggctgaggtgggaagatcacttgagccccggaggctgaggctgcagtgagccatgactgtgcactgaactcctgcctggttgacagcgtaagaccctgtctcaaaataaataaatattttaaaaattaccctatctacatggaccctgagtttcctaacaaccaaacacatacgtagggctctatacattttataaatactaactctggtattcttcataacagttccatgagggagatgctattttatcttcattttacagatgagaaaattaaggcacagggtgattaagcaatttggctaaggtcgcacagctggaaagagaaaagctatggttcagatccacacagttaggctccagagtctggtccttaatcattacaccaggctgagtttaggactgttgtgccatcctatagctgtagctagcagatttggtaaatctagctgtttttactacctgttttatctctcctgctagaatagcatcactaaggggccttgtattgttctttgaagttagtagacatgtatcaatcaatgtatgtttaaaataattttggaataaattgtaagcaactgatatgtggatataatagaatattaaaatgattctttttgtttcagtttcagctgagatgttaacatgataacataataagtcaaaaacacattactgtttccatcttacaaaatgaagcataaagttacttaagccagtcttgcaaaggagaacactgagaactgcttttagggtcctgaattaattacctacttctagtccatcaaaatgcagaaaaaggcaagaggagactgacaattagaagaggatttttggagacagttgagatgtgatgtgatttccacatactgcagggtggaagtctgcttttccctatctcaagtgcaggagaaagggacattagtggaacatctaagaaaatttgatatgtgtcttctgggacttggtgggtggcagcggtcaaggtagtgagcaaactagtatttgactataactgagaaatcttcaagggaagagactgtggcttgctgatgcccagtggccaagcaaagagatattgatgtaccaggagccacttgtgcattagggtttgttaggacaaaggacacttgtggaccctaggttagagtctgtgtagaattgtattgtatcctgtttagcagggttactaaagggattgggctgagtggtgaagaaaactgagaaaagaaaagaaaaaaaaaaaaagaacttggaattgcagtgatagatgaccagatggtgaggtgggaatcctaaatgaccatctgaaggaagtgcatttactacctcaatggaattgcaggtaaattctaataatggggttaaggtctgtaaagaaccaaatgcttccgaaaagtgcctccttaagaactttaagtataggctaagctcaactagatggctacaataatactagccaagtaaggtcatttctgccctttatgtcttctttcttctgcttcatccctggaggaataagagagggagaggaatagtgaaagccatggaaacaatcgtgctcctcccagtgcaagtgggggctccactgtggctgaagcagggataatgaagaggctttaactgacttctgctattacagaggagtaagctgattttactttttatgtctaaaagtgaacggatgacctttttactatccaagagggagcaaagcactgttgagactccctgtggacttccctggtggttagaaagaaatatttttacagaacaagtttaattcctgttacaccttgggaagtactttcaacacaacaagtacaggaagatatctgttactctagggttgcccattgttttagggtctcgtctattatagacctggttcttatccaggatacactggaaaaaattcttgcagtttcctacttattatgaaacttattatggaagtaggccataagagcctattttcatcagagtattaattattaagaaggtctagattcagtgaatagaagcattgcaatgttaaaggtgaaaaatgcactaaactctgaaataagtccctttaacttaaccttaaaactttctgcaatatgaaatgcaaaatgctcattttctaggtgcagaaatctccagatttcataggatttggtttttttgcaacacaataaaataaacaatttagaaacaatgagcatccgtgatgcttggagaacatccgactttttttttttttaattttatatatatatttttttattatactttaatttctagggtacatgtgcacaacgtgcaggtttgttacatatgtatacatgtgccatgttggtgtgctgcacccattaactcgtcattgacattaggtgtatctcctaacgctatccctcccccctccccccaccccacaacaggccccggtgtgtgatgttccccttcctgtgtccaagtgttctcatatcatttgacttttaaatgacgcccatctcttcttggagatgttcagttgttgcctcaacttcaaatgtctttgacatctcatggatttaaactctagagttagctagaatggaactgaaggctatcaaaataagggttcaaacaacaggcccgaccctaattcagacattatctacttcaccccaagttgcatcaggctttgaaaaacagtttaattataaatgatcgccaaagagttttccctgaaaacaataaatttaaaatacacataaagcacaaaatactaataacaagcatatttataagaccggtatttactatttaattcagaaactatagatattcttacaacacaaccatctcatgtttataggatagcaagtcatttaaattatataagcaataaaacgtgctaaactttcttgccaatgcgtaattacaatttaaaagaattcatttcaaactcttattctctgggattaaatatgattgtcttggcaaattctcatgaatattgcattagcaaaaccagaagtcatttcactggacatgtctttatctccctgtacatgtcttgatctccctgtactgtatattccttgaaatagataactggctcaaatcataatttcaaaaatctcttataagaatatcagtaacgaggcatttataatttaatgaagactttccatggattcattaaataaacagtgacaatggtaattattgatttttttacaaaagctcatttctgaataaagattatattattaaaccaagttaaagggaaacatcatgaaatatgacactgggaaggtccctgaaatttctagcaagtggcaccatagtttaatgcactgtctaattccatatgaaataacatatgcacttgtaagttttatgttttaactaagattaagatttaatggtgtaatcaatatcttgggtatacttcaagcaagatgtctgcatgttacagatgcatatataatatgtgcctatgaaatggataaagcagaatacacgtaagtaaagatttcggtctacatgtggcatacagacatgttacataagattttagtgcactgtttcccctcaccccattcttggattgttatatagaaatgtttggctcaactatgctcaggaacagagaccagtaacaaataaaaatgtctctctctgtgtctgtttactatactcctagagagaaggaccaaacattgtgagcaagtgtgcaactcaggagggcatgtagattagcagggagccctgtttacgttctgtaaacttctgtcatgcaccatagtacagtccagtactccagggccccactttggacagaactcaacaatgtctttaaatgctctctctatgcttgtactcatttcagaatacagaaagactcccatagtccaaatctacattgttgattgaaaccagagttgggtgaatggaatgttttgcttctccagagactaatcctcaccagggagcaaaggttttaaggcatgaaggggagtctggagcctatagtcacagttgttggactatgcaacactgcagacagtatcagagagccatctgttatctcacctaaaaacaaacacactcagataattgctaatttagcccaaacacttttttttttttttgagatggagtttcactcttattgcccaggctggagtgcaatggcacgatctcagctctctgcaacctttgcttcctttgttcaagtgattctcctgcctcagcctccgaagtagctgggattacaggtgcatgccaccacgcccagctaataatgtatttttggtagaggcagggtttttccatgttggtcaggctggtctcgaaatcctgacctcaggtgatctgcccaccttggcctctcagactgctgggattacacgtgtgagccactgcccccagccacccaaatacatttctaagtgaattacttagaggccctcttggctggtagagactctgtttaccaatttagatggcctataatggtaagaagtggttttaatctagttgttttaacctggcactgagatatacatgccatcctctaacccccaaaaagcaacaccaccacatcaaaaacaagaagttcctgctgccctgtctcctattttctccattaaatagcgtctgtttaaaattcattcaggtaactaataaaaagtatgtaatatgcacccagcattttcctactactgggaggagaataaaaacaggtaaagtctgttttctgctcctgggaaaactttcaatcaaattgggaaggtaaatcgtgcatgcaaatactcatacccacaaaagagttgagggagtggtggggaaaagcacaggtgcattgggggaagcatctgaaggatctctggaagcctcaaactgccatgggagcaaaccagcatttggacagctctaacactaccagcaggttctaatgcaactcccagggacatagaagttatgttctgtctaccttctatctctcctttcaggccccacataccagactactcactatgtgccaggtattgagctctatacaatgtatctcatctaaaactcccagcagacctgaaaggtaagtgccattgtctctatctccttggaaactttaatcttgctgaaatcacacagccaataattatgggtactgaaatatgaccaatttggtggggcattctaaaactgaataatgtcagttgtgtcagtgttccaggaaaatgtcttgaaactaaggcacccttagaggatgagtcaagaggagggttactacagggtgcatggttttgtttttggttttagttttttttttttttttttttttttttttttttttttttttttttttttttttggctagttacattttgtagcactacacaataaggaatcagaagtgggcaagatatgtgggcaataccacctcagaaacatctcatttaggagtaatacatttttaaaaaacagccttttcatttccccatcaaatcttcattaaggatagtgtatcttttctaatatgtctccatcctacaggatgctgtagctccttcaatgagactatattctggcagcgatattaacttcctggaggcttaaattcatctcttggtcctaagaatgtctaataaaattttctaagcctgtgccagtcctcctccacacactgccttaggtgttagtttttatatgcccatttcaacccctcaaacctattaaaaacaactttagggtaggaaaaaagcctggtgtattcctcattgtatccttcaccacacttcccagaatacctttctttacttttgcaaatttccaatattctttcacatcaattttcttttttttaattgagatataattcacatatcataacatttgcccttttaaagtatatggttcagtggttttagtatattcacaaggttgtgcaaccatcaccattatttaatttcagaacatttgcatcatgctccaattttcttttgatgagataatgcatacaaaattcttagcacatttaatggctacatagttcctgttagctattagcattattattattattgctacaattattgttgttattcatcactttgaaaaacaatgtttagcttcaccgtagtttgatggaagttaattaaaatattgcttcaattatatagacatttcggttttgctagaggatacatttttaatgattacaacttgtgaagcagggtatctattttgtaaatgggaaagctaaagctcagaaaggctgagacttggccaaagtcagagcatctatctatgacttggatcaagagaggatattctaaaatctacctgtgctcaactgtaagataagtggttctcccgttgattatgctgaggcagagcatgcttgattagacaacatccatgtcccctcccatctcaatattatggttctagggaaatcctaaatgtaaggcaaagcagttctcacggaaaaaatttagatattactagttgagttttttgaaacacattgaaggtgcctaagtttgaatttgagtctctcttagatttccttcaaaatttaaaaaaatagaaaaactctaagattttattgtgtttttaaatcagagattctccaatttaggaggagaaagaggactttgcattaggttgaagtatcagtaatctgtgaagccttttgtgaaccatgtatgtttcttcccaagaaagtataatctctgatggaagcgcttgccattattgggaagagcccctgccttgtcaggtatgtaggatttagtggtcgtaaagtgagaaaaaggatggacagatcttgagctccagtgataacatcaaaacacttcagtgcttctatttcctcattgtctctccttagatgaaattaaataaaaaatcaaaacaatgtcaagatgaatttagtccactaagtgactggctgctggatctttgaatggggtaataatcttgatatcggtattttaagatattctcaattttgtttcactaataaagccaatactggattattctttacacagtatttgagaagacattctcaaaccattatgaagttctccagtgtggccatgggtacagacatatcatcaagccttttcgtgatacttcccccttccaaatagcatacgtttgcagatatcacgatagctgtagaataaaataaagctaccttagcctcttgtgaatcagagtcatctcattgagataattaattctgtatctccatccactgagacaacaactactatgaagttgaaatagttgcctttaaatgtgtccttatgtgtaaagaatgtcttttattatttttctccctgaataatcaatgagcagaaatcaaatagaacaagaaagaggcattgacttggtggcctatggaaccttcttaatttttcacaggtaatactttccatttggatagttagcctagtggtctggcatcataacaaatactttaggttgctgtatgaaaatctcagcgtcacactgaattaagttaagccttttccaaagtgtaatgagctgatcagatgtgtattacttgtttttgttcatttttttatatttaaaaattattgttgctttaaagacccttgttggaatgttaaattactttttcttgtacagtcacattgtacagtaattcaggaaactatgggcaatacattgtgtttcaggtgctgattaaaaccacaatctttgtttattctgcatctgcctgaatccttgtctttggaccattgcactctttgatattacctccaccaggaactgaacaggaaaggggcattctatcaattctgctaattgttgacattttttatgtaaaaaggttttcctataaaagagctttgggattatttgtggatttcatttacttgttatatcccaggatcatcattttccaggagacctgactatataattacaatctaactctaatgttccaaatttccatagcacaaagcccaacatttttcagacaaatagacagaacatccttggattgtaattttagtcctctgcatggcaaatgtaaccttagtaactcggttataggtaaaacaaaatgaaccttcgtattttagaaaatccttaaaagacgtgaaaacatatcaagagattaatgtaattattttcagtgcttccattgatataagccataagctacatacagtaaactgggaatggaaagatcagtttggaaggagcactatttttttaaattctatttgtgaatcatgacttgcaacctaaaaacaagagtgaggaaatgttttcaagtgtgtttgatggactgacttcctaatgatgctatgttagttttcacaagcctcaagaagagccctaccttgaaatgcatcccaagagaaaagctgacagtgctaacttttttcttttcgttttctctttcttattgacttctagtccaggactagctgtccgacatccttaggaaaaaaatgtgtgtatatgggcatagaaatgcatttaccaatgaatattttctaaagaatcagcaaaactctgttatccctgaagtggtaagtaataattcctacagccatcaaaaataaatctatgttcatgtgtgtgattgtggcacaacagaggagaatatggaatctctaaggcagaaattcctaatgattataacttttttcatcttcacaaaacagtaatacctccacaaaaatgaagtaatgcagaaaaatatttatcaagtgccttttagctgcagtgaattttgtaaaacaccataccactcatcccatgactcaaaactgataaaatgtgtgttgctggttatatttatatacatttattttcctcaattgcatggttttctggcataaatgacactaaaattttggaactaccataacacatgaagttcagtattcaccaatatttatgtacttattcaaaaaccacagactttttactatactcctggcactctgttaagttctggataaatatggttaacaaaccagatggtgctgctgtcattatgaagcttaagtctcacattattcgttacacattaaaacttactgtagcatatacagcatgctaagtttcaagaaggcaaagagtaaggatagcatgagaggaactgaataatttaagcaaagtctccttgagaagctgaagatgagaagaaatcaataatgaacatttagcattttccaggcagagaaaacagcatgtgcacatagcccagggagggattgtacaaagacagatccttttatgaacaaatgcagacacagatataaatatgtggactctttatagctattaagatgtgcaaattatatgtgaacatgtacaggtattcaaaatatttgtataagatataaaactaggttatggaataatgcgtaacaaaagtaaaatatattatttgcacaaatagagcaattgaaaaatagatggtgaagcacatttaaaaaattttccaatcagagaacagaaaattgttgaatatatgtagaacctaacagtatgcaacctgacattcatctaattgtttattcctaagtgtcattcatcaatgtgcattatgaaatgcaatttataaaagacttcctgaatcaacagggactcacatctttttcaaaagtcacttacttctacaatgtcaaaaaagattcatcattctacgctcatatttctaaactaatgtaacatgtttagtttctttgtgtggtggaatgtcttgttaacttatttatccagagagcccttttatctcaagatgtagtaaagagttatccataaaatttctgccttaagatttatgtctgaaatcacttgactggtttttcaagtaccctccttaaattggtagaagaatgcaaagttttcacccttgaccctttcaccttcctgttcactcagaagagcagatgaacagggtttaatgcctgtgtcccaaaatgcagtcttccaggcagtcaaccaatcacttcaaatgagacgaaggattctctatccaattctacttccagaaaaattttaaataaatgaagttaaatgagcatttgccctgaaatttggccaggaatcgtgaagccaaaaacacgcgaagtgctcaaattcaagtaactcatggacgttttgaacttgagataaaagttcacttgtaacttctccagagcagtaaccactggaggctctttgaggtcatcccttcccattgtttgcctggaaaagcaagagaatattttgaagacagttgtggacgtttagctcagtaaagacagccgaaggaataaatacctggagcaatgtcaacttagcagccattgaccaaacaaacaaacaaacaaacacactttctctcttactgctccatcacactagcttttcatttccataaatgtctcatgttctgacccatctcaggcccattgctcttccttctgcctggttagctgtttccttgccttccccatcccaaaataattgataccctatattgtttggagataattttgagaacttaaggatagatttgggcattgaatctgctgaataagggatagtgtttgtgaaatatcatttcgtgaagcaaaaactcattagtggtcatctactggagtacaaaagacatctacttaaaagtctgggctgacaatagttgaaaagcaagagacatactgggaggccatttctcttctgattagcagaattatttggtggactctgactatttctgataaatctttaagtactaaatatcatagcaagaaatatactgttgtgatcttgcattccatttatacacttcccctgccaaacatgtccactgttttaaaataaacatgaacaaaacctaatagagaaggtaaaaatgcactgagagattaatcagaaacatcattctaaggccaagtggaaaccatatgtaacttattcagtgtttggtaataccagtgtcagagctctgaaatgagtgtggatattccagaagggcaggatttggcagcagatgcgtgatgatgataatgatgatgatagccatccttcttgccatgtgtcagacactccttctaagcactttacaggcaataatacgtatgaatatatatgattattttcatttaaatgatgaggaagctgagcctcaaaagcttgtcctaaatcacatggctaataagtatcagagctgtgatttttcaagcagtccaattccagattttgtgtgctaaactataccattgctcctctgaggaagtccaacatgcttacaagaggttgcagcttgtttagctgtggtattaataaggctctttgaaaaagagagacactaacatcctcattattgtatatatcaagtaaaacatcaagtacttttcagacctccactcctttaattctcacaataactcattttgccagcctaccaatctccatgttgaggatgtttaaaactcaaagcaaggaggtacttttctgaagtcacgcagctaaaacatcaatctagttacattcaatccaggtctatctggttccaaactaagagctttcaaccacatcatgctactccttctgcagagtcttcatgatcccctagaagtagtaggggccagatgagagtatcctagagctctagacgcttaccattttaggaggtttgtatactgataagttttccaagatgggggtggacagacgcagcaattcctctttcatgagcattaaattagtccagttgtttagaactgctagtaagtgaaatattaatctccattagggccagagcagactttgtcatacttcaagagccagaaatggaagtactatcttttaggtttaattgagattctggagtgtcagcctattttcagagtctgtaagagaggaacactcagagaaatagccagtgtctttcctctacccaaccccttcccacctagtttacatccagtttttctctagtatgttttttgtttatagccaacagatttatttaaatcatatttatcattgcttgctattttgaaagatgtgcctcaagcttccaatcaaatccaaaagaatacataatcatcaaaacaaggttagtcatggagttttctactaaataacatttgtgactgaaataggcaaggaaatgagagatttagttgtagtttcccaaaggtaataaacctaatatttaaaaagaaatagtaataacttaccagcagctcaggtgttccatgtgtcatgatcaataaccaagtaaatatagatctgaattttgtagccactttggttgtatcaaaaaagccactgcatggtactattacatacatagtttatatggtttagaagaaccatataaaccaccattaactattccttttatcataataataaaaataataggtggagttgctgatatataaaatatgaattgatccattagaagtaattttctattataatttttcaactttcttagtcaatttcagattatgattagaaatgttaatgttaatcttgtttctctaccatttaacccctctcttaaaaacataatgaccacttcttagacccttttctactctccttccatgtatatttcaagttttctacttataatttgtaattatttaaattgttttatttttatcttagttgtttgaaatcaacctctacattattaccatcttttctttctccccaagcttataagcattggtctagcatttaatgataacttttaatttgggatgattatatccaagatgctgccccagaatgagagttttatgaatgcttaatgcaaggaatcataaagcttataccagtgctgccctgaaaaattaaccaaagaaaaccccaaaactctttctccttaatcaaagaatatgctttgatgtgaacaaaagagagaagaatatttaatatcagctttggttgcactgcaattagcaattaacaagtaataacctatgattagttcacaaactccaacaaatacacttaatgacaggtgactaagagatgtgggaaacatttaagttagggccaagatgaacaaatgtgaacctagcacaatttggtttggtaacattaagcttttgataaactttcctagtcaaaattaaattattccatattactttgaagtaattataatacaattttctactttaatcagctgtctcaaactttgtgatcacaagttattttatgcaaaaaaaaccctaaaagaaattatgaaagatttttcaagaaagatttataaacttaatctttcaaagtatctcataaatgtaaatgcatgcttagcatttttaatggattatttactcatcatttagcttaaacatcataatgtttccaatctatgttacaagagctaagccatttcaatgctttttgaacaagttactctgttgacattggcacagaccaccaaaatgcactgattatggaagatatacggttaatgcatacagtatctgagcattgatagagcatcaaggcaaaagcaggcaatacttaagttctccaaataaatacacaaaaaagagagcttgatgaccacctaaaataacttttcaacatggaaaggtgagccttgcggcattccacatacagattagctgagcctttcaaaggtattgttgaatttatctatttctgagcatatcttacttttaacccaacttaattctttggaaggacatgcattacttctgatacattaaaaaaaaaaaaaaaaagacccttttcatgctcttgcttgctaaaactctactagaactttcaatgacaccatattgcctctcagactattcaactggaaattgtatcaggtaaactctcattcattattgcactacccatcttttaaatttttaaagagattattaggggctgtttaaaattattactattcttccacttcttactttttttaggtttactctcccatcacaattattgtcacatgctacattccagactacatatatatatatatatatattttttttttttacccaagtactacaatagaaatgtgatacatcaatggattgtaagaaaaaaaaactacccagctatgtacctggttatattcacacattgttacagagctgaaacggattaattaggcagttaataaaactattacaacaataattgcagaaattactaacgtaaaagtatcttggcctagatagtttatgtctcagttaataataatgttgatagtaatactaataagttctaattatcaatgaccatttgctatgttcccaatttagtcttttaaatatacctctgaacagtatttggctcataatggtcacaaaacaagtgtttgctaaatattgactaaattcttatattaactctgtgtgagacagatgccattattaccttcacttaataggtaaggaaactgagtcataaaaatgtcacttgctcacagtcactccactaacatttgaaggatcaggatttgaatccagatctgtctatctccaaagtaggtgttcttaaccactactgttttatgttgcctttggaaaaatatccaagaactagataattaccagtgatgaaatctgtttcagaatatagaaaagtataactcccctctaactccataaaattaaaacaaaattacaatccctcctaaatgtataaaattagaacttccttatacaaaagccaattaaatgtagcacacacacacaaatccattgaccaatgtatattttaatcataactcactataataaagatggctgctgcatatattgccatttaccatgagtcagtccttttgtggtgcttatataataaccgattttagctttacaactctgaggtaaccattattaagatcattttacagagaaaaagaagtggcacaaatttgcacagtcactgtgttaacctaaggactcaaacttggtccttttttacttcaaatgctacataaagccagataaagtgtatgtcaaaaactctgagatatttcaaaattgagaaatctattaacatgcatcattaggacaaatgagaaaaaagcaaaatactaagataaattctataaaggtatttgttaagttcactatgcatttttgagatatttttaaaaatcacttggtaaactagaacaatccgttgcatgataaaactatttctacctcaaaccaactgccaacatcatgcttaacactaaaagcgttcccaatgaagtaaaacagttttacattgtcaccaataggtcttagcgttggtttaaacatgtcaatcaatgcaatatgacaggaaataaaaataacagtttaaattattgatagagaagaaaacaaaaacacactacttgctgtaaaccgaaaccacactgttggatgcaaatatagccatttaaaataaaatgagagagctagccttcagaaaaccattctaaaaataagataaacataaatgcatacattctcataaggagtggcaaagatattgagcaaaatgttttggaataaagaattaaaatgtgagtttaatgaaactatataattttttggcaagtgtttctaaatatagactctgtgtgatggatacattaaaaattattatgttattttctttgtgttagaaaatgtccataatggaaagaatgaacaatggcagtctgcgaaacaagagtactgcaatttttgtctctaactatatttgtaatcttgaacaaattacataactcctctctcttgctttactttcctcatttagttcatctttttctagatcatcctttctggttctgtaattctattttattttcagttgccttctcaattttctatattgcaatatattttaattcataatggttcaatttgtgataatcactgctcagccacaaattgaaaatttagccaaaaaaaccccacagaaatggcattgctttgactttaaaatagcatactcttcctgtcttttttgagatctaaaattgtttatcagtttgcggggttctcttgggtttattgtactattagacactgacacgttttaaaggatccttaaaaaaaaaaagaaacaaatgaaaagaaaaagaaaacaaccaaatctggcttgttctgggatgctgagatgtcttgacagcaattactgcagtagagactggtgaataccctattttcacagctgatgttttccttcaaaattgcagctaccttcactttggttgaggccagggtactatatttagatagtataaatgtatccagagagcaatctttcacgtttatttgtagagtgggtttatttttatttattgatgtcacacaaaatgatgtttcctcggtttctgctgtatataacataccaaaaaataaagacggtctagaacacaaagtaagaatatattctgtgtgattatattgacaatggtttcgatttttatgcaattatactcccataatgttgaaattgttaacacaagtctatgtttactatgtaagaggaaactttattatgcataatgaagatggcatgggaataagggagtctcttatccttcctgtcaacctaaggccaatgtgtaatgcaagaaacaagtaggacacagggaaaagcaatagccataaccaagagaacatcagctatccctccctcctcacttagaaataaagaatgttggccgggcgcggtggctcaggcctgtaatcccagcactttgggaggctgaggtgggcagatcacgaggtcaggaaatcgagaccatcctgtctaacacggtgaaaccgcgtctctactaaaaatacaaaaaaaaatagccgggtgtcgtggcaggtgcctgtagtcccagctgctcgggaggctgaggcaagagaatggcgtgaagccgggaggcggagcttgcagtgagctgagatcgcgccaccgcactccagcctgggcgacagagtgagactctgtctcaaaaaaaaaaaaaaaaaaaaagaaagaaagaatgttgagaaagcaaagcattagtttatacaaccttcaaaataaaaaataatttcaagtcaaattctttttccaactttatatgtggggtgtgtgtgcgtatgtgcgtgcaaattaataagtcctagacaataaaaaattgatagcacataaatggaggggccaattctagcacttctttttgtcttttttctccattattggataatagtggttaccaaatagaattcaacaacagaactgattaaatattttccccctaggttttaatttagactacacaacatgtatttcagtacttcacattattagttataaaatttttctattgttcccctattgaaagtttaagagaatgcccataaactgagtttccttttagaaaaaaatcaaataatgtcaacatcctttgcatctcatttcttctctttcagacttatgacttaatcctcattagttataatactttattttcatcttttttatttgattatttaaaactttaaggtgcaaatgggttcattttggagacgataaacaggaaattttaagatttctcttggcccgttattttagattgtcccgtgatacactgggggcaactagcgaaagaaatgataatttgccaatgactcttaaaatactgaatagtaaaataacaaaattcttagaattgggaagtgatcttaggcccaaactctcatgtgataacagaagcccttctaaaaatatctctgacaaagggtcacttaagttcaacttgaaacatgccagtgatgttattagttctcaaagcagcctattcattattaaaatccttttgaattgaaagttactctcatgcggcatggtggtcactcccgtaatcccagcacttttggaggttgaggcgggcagatcacttgaggtcaggagtgagaccgcctggccaacacggtgaaaccccttctctactaaaaatacaaaaattagcagggcctggtggtatgcacctgtaattccagctactctggggactgaagcaggagaatagctatagcctgtgaggcagaggttgcagtgagccaagatcgccccactgaattccagcctgggtgacagagtgacactctgtctcaaaaaaaagaaaaaaaaaagttactctcatgggtctgcactatggatcattttagtgtaatctgcaccctcttgccaaatcacagccctttgaatatttaaaaacagttattaggccacattttccccacagtcagcccaggttttctgctggaaaaatcaccttccattctttaactatcaatccttaaagtttttataaccattcacctttcagctatctagtttgttaataagcttagatgctaatggaccttagcacaatacactaacttcaatgcaacgtgtaagatgggtaccaaaccgtaagatataaaatgggtactcaacagtgtaatatgtttcttaattagggcaccacttttccatcaaaattgtctgagtttttttttttcctttaatagctgcactcactagttgatgatctcagcttttagcaaactaaaattctcagacctttgcacattatgtattagctagatatctccctgtacttattcttgtggatttgaaaatgcaattataggactttaaccaccccctccagatctcccatctgtgttgcctttgcttaaacctttttcttcatccaaaatactcctacctctgctgtgcaaaacactttatcttgggcttaaactcccttgggtccttattacccctgctactgtatcactatgcttaatggagaagatgaaatttacataggaggcaaacaatccaggtttctctcttcatctgtcattacaccatcttactgaagctggtcccttcgttgttcagccttctccggtagacagagacaaatccgtgttacacaagtctgcttattccgactttagtcttgatgagtccacatttactggctcagtgcattctcgctctctctcactcaaattatttttggttttgcaggcatcctttgaaatacacttttaaaatattttgagttgtgaacttttagatggagataggattccatgagggtgcaagggctgtttcatggctttggtatgcagtgtaagactcagagtcaaatgtgtctgggggtgtgtcccaggcccatgtggggcaagccactgtttcctttactaaaatgcagcataaaattcatacctgcctcagaggtcaaggaagaattacataagattaaaaaaataaaatgtttaaaataatatctttatcaaattaagtactcaataaatataatctattaatatattaattatactattctagatataaaatgatcatcaaaagaaatcagaaaatgacaaactctttgctttttggaacacaagacatctggtgcctatgccatttctgttgccaacatttggaatgtgcctcccctctcattgctcattatctccaaatatccaaaccctaccttccctttgatgccaagtcaaaatgtgacctcttcttctgaagccctcattacccctagatttgattcctgctcagtgacgatcttgaaggtatggcatttttgcaacacatccttcaatccctatcatctggcataaacctggatcacagtaggtacttaataaatgtctgttatatgaatcaatgactacctttcccgcagccatcattaatttcttcctctcctgattttgtatatccttattgcacataaatatttaccatgcatcataattatttgtgcatgtgtctcttctgccttgcaggactataaagctttttgagcactccatgtcaaattgacctctggctaccttgcaattccttaatacatactagacactgaaaaatacttttgaatgaattaatatctgcttttctctattgctacagtattttttgtccatggaagttctgtaatctgtaccaggaaaataattaaccataactcacctttgtaggaaaaggattaaccataaactgcctttttctgagacatctgttccataatctaatgaccaacgctatttatacagttgatctatctacaaccccttcaactgtaaaaagcatatggaaaatgtatgttcaattctagaggaggaatattttggctatccttttgtgactccctttatctttgatgctcacgtataatccaccttaaaaggctgtgagtgaggcagaaggaggatcacatcacttagatgagatcttgcctgacaccactagatttgggccttcctatgaaactcccaagtttcagttattattatatcgaaatgacttctattgaacactaatcattcaatggtcagttaatttttattgagtatctctatgtacacaggagactatgtgggatgctatagaagatacaaaacaaactaagggtctgttccctgtttggaaggtaagatctatatatacaagtatatacacaccagtgaaaagtaatatacaaactgaaccctaaaattacagatgtaaaaaaatatataccacagactgggagaaactatttgcaaaagatatatctgataaagggctgtgatccagaatagttgtgagatccacacaaagaactcttgaaactcaacaaaaagaaaacaagatagatttaaaaatgggcaaaatatctgaaattaccaaaatgagatatacaaatggcaaatacatacatgaaagatacatagcatcatatatcattaaggaattgcaagttaaaactacagtgatacaccactataaacctagtagaatggccaaaacctgggacactgacaacaccaaaggctggtgagaatgtagagcaacaggaactcattcattgtcagtggaaatgcaaagcaatacagttactttggaagacattgtagtagtttcttactaaatcaaacatactcttactacatgattcagcaactgaactccttggtatttaaccagaagagctgagaatttatgtccacacaataatctgtacatggatgtttatagcagctttattcaaaattgccaaaacttataggcaaccaagatgtccttcagtaggtgaatgaataaataaactgtggtacatccaagcaatggaatatcattcagtgctaaaagaaatgggctatcaagccatgaaaaaacatggggaagtcttaaatgcatattattatactaagctaaagaaactaatctgagaagcctacacactgtatgatttcaactgtgtgacattctggaaaaggataaactatagagacataaaagaacacattggttgccaggatctagtggggagagagggatgaataggtagagtacagaggatttttagggcaatgaatgtactccgtgtgatattataatggttagtactagtcattatacatttgccaaaacccacagaatgaacaccaggagtaaaccctaacgtaaactatggactttgtgtgataatgatgcaccaatgtaggttcatcgattataacaaattaccactctagtgagggatgttgatggtggggagactgtgcatgtgtaggagcagagagtatttggaaaatctttgtaatttcgctcaattttttttttttgtgaacctaaaactactctaaagaataaaacttacaaaaaaacatatatatgttatgtgtatatatatatatatatatatatacacacacacacatatatataataatacatattttatataccaaagaaagctgattaaaactttgtttagaagtacagtaggaccacagaagaaacaaatttctgggggtactcaggagtttacccgagattacgtaataccaacaggaatcaatgtttcttcagcacaaactgattttggaatgatcgaaacaatgtatatgtactttctcatttaatatccacaacaaactaataaaggaaatactattattatctctattttgtaaatggcttgaaacttattatggtgaataacttcctcaaggtcacagaaccagtgaggggtataagtgagatacgaacccagtcctgtccaactgcacagctgaggttcaccaatatcctatacttccagtcttgggaaaagaaaaaaaataaaaattcagttggacaaaagcaacagaaagagaagtccaggtgggagaagtctgattaacttctggaaactttgcaatctatgacagttttatgattcacttatttttatttaatatttcttcaacactactagtctatctccaatgtgaacagaggcaacagtctttctgttacataagaatcatgtacatatgtatgtttatattcaatttataagcagtctgtctttttaagaagacttattaaggagaagtaatttttcataggatcagtcttggggctaagcaattatatttgctatctttttaatactagtagtcatatttcttccctaattgattattgaacctttctaaatatgtctgaagacatagattgaaattatcctaaggctcgacctctttttttaattgtgactaacaaattttaatacaaggcaaacagcaaaacatggcaggctgaaggagtaatttcttgcacctatagccggagtttttttaaagagctacgcaatttttgttgatcttccactggcttatctacagcaattgaagtttatcagaaagatttatgacatggtattgcaggccctaataaatgactttgggaagctgggaaaactcactaaagttaaagttattatctgaacctcatagggctaattagagatacaacctgaagtgttgagtcagcagtaagaaacacaacacgttatcaattaaagcctccatctaggcttggagaagaggtggggaaaagaaaagatttgcaatgaaaatgaatcatatgtttaaacaccagagccaaaaattagtcctcaaaagcatttcctgaactctctggaaatgtcgatggggtcagctctctgcttaaaaagggacccttccaaggcattctcaaagtaagttaccaaagttgctttgcatatgtataacaggaagatctgaacatatacagatgtgggggttccagaaagcaagaaaaaactctacctcttccccacatctcttcttctgaggaataggcaaaatcttccttccccaacacagctctgtgacactgtcaatttaaaacattttcatgcaaatcaagttaacatttaaaaaacaaacaaacaaaacttgcactatgaatgacgtaaccccttctcaaatactggactttaactactgccattgaaaacagggtggtttttcttaagcatttctgacttgatgctgctgttttcctgagatgcgaccaactaaaaatgacttaaaaatccctgcaccttcctggtattaatggaaagaggtagtggggtgttacagggagctaacttttttcatggttttcttaactgagttacaaaaataacagaaaattgcctctgtgcacatgtgtttaatgtgtctatgcatgaaaagccttggggataaagggagaagtagatattttcagaatgtttgattatgattgtttgtatcagaatctgtttagacaagaaaatcagaactgaaagtagacatatgttaaaacattttcagcccatatccttctgctttcatgttgaaaattgagggccataaaataataaacatgtattagatttattgagttcctttaagtcggcaagatccccagagtgttgtgcaaaataacagcaacttttgaattacaaaattattacatgttcccatgaagattatttaacccagagatgaataaggagaatgggtaataaagagacctgagagggattttccacacccttctcctcaatccataatttaaatacagtcataaactgtgagtaagcaatataagcatttgtgtgcagcatatatttgagcctgaaaggtagaaggcagtgtttaaaaatatgtttttaataaagcctataatacagaatagacaaacaccaaggtaaagatggattagaagaacaagtattaaatgaatacaccttctagcaaaaatcatttcttgttatgtgcctcaaaaaagaacaatcttctttagatagtattttaagcaactgactagtgtgtatgtctttacacagccatagaagagtttcaatgagtacttctcaccgattcagtgagccaaatcataaagcctcaggctgtcagaaaaaaaaaaaaacaaccaactgtaaattttgacaagaatgtgacaaaaatatataagatagattcactagcatttctagagtgaaaaattactagaattggcccacggcctctattgctgaaaaatttaatgtaattactttttttatgatattgtctagactctccagcattggcagaatttttgttctatgtctatgctggaaataaattaaataaagacctaggttttcttccttctattgtaagaactatgtcctcttcaagatgaatgtgattatggtttagcaaatgaatgtgaaggtaaaggtgtttaggagaaaatacaaaagtaagatcttaacgttgtacttaacagaatgtgtccgttagtaagaatactaaaaagcaggattgtaaggaagaaattctccaatgtaaaacagcttgcatgtcttctgggaatcttgtaaaaatatagaatctgattcagtagatctggagtgggcctaagagtctgcattcctcacaagctcccaggtgatgctgatgccgccagtctgcaggttaacaccttaagtagcaaggttataatgtatggggaagattcgtggatagggtcagtcttttaaaaatctttaaataatttgaatgtaaattatatgaaatttctctgtctcctggtttcataagtgttttcttttttttttctttagacaaaattggaatagcagtttgactatgacattctaattggtgtgtgtttcagctagaggaagattataacaaaagagtatttctccaaaataaagttttcctttattttgcttttgtaagtagctcaacaaaaaagagagtgtggctctgtgtttgattttacttcctttaaattcaaaagcaggcactaaaaatacctttgaaaactatagtaatgaactactgtggtactaggctcaagaaatctggggcgttcctatggacttagtggcaattgaagcagtcagattttcagatttagctgccatcagctgtggattggacagtgacatagtctaggacagatgtcaattttagccttcttctaacataagtctggaatacattttaattcaccagcaggaaggattttgttgcatgtaagttagagtttaaagccaggtttatttttgtttgggaaaaattctgtgcatctcaaaaggcacaatacctgtgtgttaacctgtctttttttttttttcggttggtattacagaattgctgataaagctttacatttacattggccagtagactagaacagattcctcacgtctctgtaagagctttgtgctgctcacttgatccaagttaaaatctctccacatcttaagttgaaaattaacatacgggaatttaatcctgacatagccactgcatcaacttttgtctagtttacgctttgccagaatgtcttaccattatgtgtctttatcttttggaaggctaggtatattgaaaatcttttaaaaataattttaagaaaagaatgtaaacaatagaaatttattcactttcttatgggacacatttcctgccaaatgctccccacaaagtaaacaccttagggtcttttttatttggaaaatgtaaggagatacgtaagtgtggatatagattcttctaaaatgtcctaaaagaaataaaattgcaagttttcctttgtctttcatcagagctttctttgtcatgtctaaagccccgcggcagggattagggagatgcaaaaccttactgtaaacagggaagggttgaaagaaaaggttcattaaaaaagaaaaaaaaaaaaactatcatttgaatgtaatatgtgaaaaatgtttcttccaggttgagtgaaaaatatactaaaaaagtgtaatcctagcttaagagattttgttttaaaatcctaattctgctaacaaggcaaaaggaacttaagatacggatgtatataaagcctcccggttcacccatcagtctttgaaactgccacacctaaactatctgttttagtgccattctcctatatttactccagtcatttttatatttcagttttgctcttaattttttttcccaacagtattcaagaagaaggataccaaaaaaagcattcccataagtattgtaaaaagtctctctcatgggtttgtttttagaaaaatgttaagccatgtttttggttcagtggaagaaggagcctgtgatagttttaacacgtgtacccaattagttgttctggacttcagcaaatgttctgcttggagcagctgttaacagattcttgctctattgttaatcaaaaagccaataataaaaaggcaaattaaaaggcaatttaatattatacttgtaattattcactttgtttctcatataagtgcaatctcatttcaatgcaatgctttcaaagaaaacatatataaggtagaggaaaatatcaatataaaattaaaattttaaaaaatggtactatatacacctttataaaatatgactagggaactccaaaaaaatgttcaaggactaagttccaaatacatacgtatgcacacacaccaacatgcacacatgcacacacacataaatgaatgcatatattctcaggcaaaaagtagaccttaggcccagaaacaagatatttgcaaagtattgatcagaatactatttatagtttatttttagggataaacacattaatgtaacttcatcttcaaaactttttaaaaataattacttttcaaaataggcaatgtgctatgcaatggagacgcatctatctacaacaggaaatgaaagtacaaacatccattcccacagtcttagattgttgtttaaatatagatatatatttcattaaagtataaaaattaagtcattgacctttactgatttgataatagtacttagtctctatttattaaatattgtcatctttctggaatttactataatacataccggttaagttattaaaatttaatcttttcacatattattaaacaaaacctctcacttattctgtccttactgtggcaacaactgatgccacaaaagttatatttccactaaagcattttaagggaattttgagtaagttacttactgatcatttgatgagatctgttgactaaatgtggctttaattgctgatacttgaacttagagtgcgatactaacaggatttattattcactaagcacttacaatatgccagacaatgttttaagcactttagttatctcgtctgtttttttgtttattttttgagaccgactcctactctgtcactgaggctggagtgcagtggcacgatgtcagctgactgcaacctctgcctccgggttcaagcgattctcctgcctcagcctcccaagtagctgggattagaggtgtgccaccaaacctagctaattttttgtatttttagtggagaccgggtttcgccatgttggccaggctggtctcgaactcctgaccttaagatccgcctgcctcagcctcccaaagtgctgggattataggcatgagccactgcccactgcgcccagccttatttcacctcatttaatccttacaattactttaaaaagtaggtagaataataaactccattttacatatgatgaaactaaggcacaaagaacaatgatcacacagctagtcagtggtagaactctgtaatctgtgggttccacatctgccagaggatgtatgtaagtgatgtgcaaacactactccattttatataagggacttaaatatcaacactatggattttgttgtgtgtctgtgtgcaggggaatgtttctggaaccaatccttggaggaacaactgtaccttatacactacattgaaggctcacaataaaagtctttcaaccaggagaacatagagtaagatacaaaactgtgggatatagactatgactcttttgattagtatggaagaaaacatcctagtattttgttattggaagaaaacatcctagtactttgttattaaggattagcgagattgaatcattgatgtacttacagcaaatctaaagtaaaccatacaaaatagaactttcctcaagatgactagaggtcaataaagctatgggttatttacagtgtaatatgaaacagcatacaaccgcaagggagaaggacatactaaataaacaaaacctgcaaaggcaattttcttcagagaatctcctcatgtacaaaaatatatttcaagagaaagtagtatagttactgcgttttcataaaaagtctgtttggtgataacatatgctgaatacaactaaaggcagttcttcaagtctaggcagacaagctgcagtacagcagatacacttgctgtttaaatatcccttcaaaaaaaaaattccatttgtttaccaaaatctattcacacttgttgaaaagcatctttcttcacttatctgaatgtgacaatgaatcaaaagtaccttctcttctgttaccagaggtgataagggagaaactgagatcctcaccagaggctgaaagatgtcttttcagtgctcttgaaagcaaaggctaatttttccaaacaaaaatttctccctaaggagctgtattaatgaggtccaaagtaatgcttaacccttgactactctaattaactcaagctgactggccagaagccctctttcctgtggcctatatgggagagatcacaaaagtgcatggtaaccctatccccacttgctgttttcacaaaacatggggctttgttctttgtttggcggttgtgaagacatttcagtctcatctgacatcacctcctcacatggaagaagtgtgcatagaaacacctagcagcaggctgcttgtctcagtgtgttccataacccttgctagcacaaagactcatttccagctcccagaggtagcatccattaacacatgttccttgagaaatctgacttttcttttcaaaaatgggaacgagtgtattcttgctatacttttttccaaatgctccaaatacacaataaattatcaagtaatcaggcctagttatgcgattcccagctttcaatacaggtatattagaggaattcatttattcactcatttgtctagcacatctattgaaaaccttctacatggtagatacaaggctaatttggtttcattgaatctttcctaagcaattaagcccagaaaaatttgtcttctctctgtttgctagagcgatagatactaaagtatctataatactcaatttattagtagtaaatttaaaatgtaattacatttatttcaacttacatttaccaatgagtacctttgatatgccaggcacttttctaaatgccagggatacagtagtgaaacaaacagacaaaaacctctgccctcctgtagctttaattctacaatggaggaacagaaaataacttcaataagtgaatgaaatatataatgtgagagagaggtaaaagaagtgagcaggtggcactgaaagagtggacagagaaagcctcactagaaaggtgaacttgtaaagatgaaaggaggtaacgaaccatgttaatgtctgggaaaaaagcattcagggcaaggaaagactacatagaaaggcttggaggtgaaagcaaacatggtatttggttggagcaaatgggtcatgtggttggaggaaagtaaataagggttaaagtgtgtgaggggtgcagtcaatggtaaacttttggattttactctggggaagataggtactcattagaaggttttgaacagataattgacacagtctgatttagggttttaaaaagctcattctcagagtctttgggaataggttgaaaagcatctaaaacacaagttcagagaacaattagcagactattgaaatactatgaagtgattaaactttattgaattttaattataatcaagcacattatggtagaggcaatgagatttactgatagattggatgtgagatgcaggatgaaggaactgcaccttgaactcaagatgatttcaaggtttttggaaaaggcaacaggcagtatgaattgctatcccttcagatggatattgtggaaggagtaaattttgaaaggaatatcagattaattgttgacaaccaaaatttgtataaaatcaggtaataaaaaggggatgtgagtttagaatataaaagtaaaatgtggacgtatcacatacagatggtattaaaagccgtgagagagaatgggatatccaggggagtggctataaatagaaaaaggaagaggcccagacctgagctctcagggtattgaggaagaaccagagaaggagaccaaggagaaagaacaggaaaaacagaagaaaacccaggaaagtgtatagctctagaagtcaagtgaacaagtgttttgctgaggagggaatgatcaacgatataaaatgctgcttgtagtccatgaatatgaagactgagaattgacattgatggttactgttcaccttaataagaatattgaatacattatttacctaattaaattctagactcctggtagtcaggacttgtcttaagcagggaattgagactgagtcaaatttgaaagttattttatacttaagttgtctagaactctgaacatcatttttcatatcacatacgatatttcattatagattctagtgacttctcaagaaagcctactttttcccattgttaatacgtagaaccagaccaaaataatagaaccataaaatgttaaagtatccagtttggtgattattacaaatgcatacagttgtattcaccatagcagcaacatataaaatatttccatcacccccaaaacttccattgtgccctgctgtgctcagttcccttcctccaccccaacccctgacaatcattcatcagacttacctccctgcaattttgacttttctagaatgccttagaagtaaaatcatttaagaatttaacttttacactattatttaaaaataatttcatcagtaaatatataccaaccataacttaaatgtttaaaatatatcttttcttctcactaccacatctttagtcttaaaatggtcctcagagatcccagttcctcctgctgtgaccttagcttctagaagttctttagcccctttgagtttataaatacattgatttataattcatcatacatttattaataattatttcaaggaatagtcagaactcatttgcatatatatacaaacatagatatgtatgtaagtaatatgtatacaaacatatacatgtacgtacatgagtaacaacagaaaatgagttctgactactccttgaaatagtaaattattaatttattgttttggaactgtctctaatcctttatattctgaacactgagcacaataacagtaactgtaatggtcctataatcaattattgatatgtagaaaatgttgcagctacattacctatgaaatcacaatgttacttctcagtagtcctaaatttcagaagtagcatttgaatgtaaaaattggcacatttgaatacaatctatataatctttgtcgttgttgctgttgttgttgttttaattcagtctcttagtaacacagaaatgtatttccagagttttccctcttatgtgcctttaagcatataagattacacatctggctttgtaccaaaaacagggcccaacaggatatgaaatcctggggataacagcaacctagctatttctttttcaagaatttttttcaaactgagccagaaactgaaaagacagatgaaaatggcacaacccggtgacaagagagcaaagataaatcacgtttccttccataaaaacattaagatcttggctttaatattaatatttttggttacagttaagctttaaagttaatgaaattctcatttgtatgctgatcttgggacatgaataccaagttgtagatgggatagagattagcaataaagaaaattaaggaaaagaaaatgaaaaattcccatagagtttaacatgcatacacatatgcccacactcatatgtgggtaatatgagagaacctgcatattttttggaggttgcctttttgcaggagttgaaactattcatcattttgctgcactttcctgtggtataacctaactaagatttttgagcaaaagatagtttttgtttttggaaaattatgagtaacttatacgtgacctgtttactccattaggaaatatgctgttttattcaatggatcataggaacagaacgaagcagaacaatagcaggaaagaaaaaattacagtcttagaaataaaaacgtatttcatccattttggcaccaggactgaattaaaatgctgccactaggcaggattttaaacatacacccttttcggcatacaattttaatacagaaattgagatattaggcatgcagcgcatattagaacattgctctttctgctgcaggtgtgtttgactgaccctgaataaatgtcaagaaaaacacctttcctatcttttttttctggctataattcaccttctcttaatatttaactattgctccatcattataacaggcactctgtttaagtcgtgggtacaggtaaaattcagcagataaaaaataatcatattggaacatactaaatgtaatggagatttttggttgagaaaaataattggtactgctaatataactgatatagtcatcatatttcctatggatttacaaaaaaaaatttaaaaaagcaagtaagatataatagaagcaaaaataggaggtgaataattttctgtctttggaatcagtgtactttattattacacattcattctaagcctacgtcagaaaatacttgaagcaaataaatagagaacagttttcttttcttttttcgtcccttttcttcaagagaacatctcattaacattaacagaaactgtgcccagaaaaagccattaacattaatggaaactatgcatagaaaaacccctagattagtttttggtcttttaaggagcttatgcattgctgcctgtcccaaaaagacaggatgggaagatagtaatcacatttttgccccatctttttaaattatatatttcattaaattatatttaataaatcctgagttggaaacagcacaaggaaactcaagctgcaataatatttactctcccaataaacctggagctttcacaaaccatgtgtcttactgagagtcactgaacaagttatacgaccatgattctcatgaacatcctctttgtgcttgcaattaggctgcctgccaggagttgaaatgattagcagtaaatataaatttaatagctttgctttgcagttccccagtcactcttggtgcctccattcactagggagataatgtgaatcagaccctatcaactaaacatacgacaatagttgaatctgaattaaatatgagggaatcttaaaagggcaaggtaaaataaaaagaaaaattaaaatatgttctctatttaatagccactttacatttacaccaaaacactgcgctattttttataaatatcagccaaactcaaagtattagtacataaatcatatataatctaaaatttttaaaaacctgataaaaagaatgcttgaaaaagtataggttttcttttttttgtcacttgaaatagaattgtgaaaaatatttacatttcaaatatcattttgcttagctgttagagttccttagagttcggttttctgaaatttaccaatactttctcatcctctttcacatcatcatcagggctccacaggaaactgtcaataggtatcaatttaatgtgccttctttactaggtgccttactatatgtcttatcacttatctctcaatttaggagacacaaaactagaagacagcaatgaccaggaagtcttgtggctatgctgtagaatgatgatgacgtatataaaatatggaaagtctttatgctttgcttttgttctcatcagaaatagtccctaagtcttaaattgtgataaaatactccttcacattttctttcaggtacaataaaggtcagataaataagaagcaaaagaaaaagagtcagggaagagaagaacagttttcggcttagcctgatggcaaagggcttttaaacactcctcaaggaacattaagcaaaaatgagcctactgaaaacaactttccttgattttactccccagttactttcgttcttctctataacttcccttatcctttcatcatagatgtcttccttcatcactattcaatatttaaaacagctgaaagattggttactgggtaagaaaaaaagatacgatagctaccaggttgagcagagatatctttgagctctaccatgatagctgagatgtttgtcctgctcagcactgcctggcacatggtaggagctataggtgaaaagatatctctgagaagatatgagtttgttggtactagggcaaagcatggaggaaaaaagaaaaaagagatagagaaagaccatgagtcataatgacatctttcgtcccttcgaaccaacttttcttgagtccatagtattatatgctccgatgctttagccaattaagttaaatccatccttatgcattttaaagtattcgaactaaaataatatcatcaggaaacatgtgagtaaaagaagggccacctcattaccttttggcaataaaaggcagagtttaaattataaatatttacagaaatatatacaccaatggatttccaagaaaatgtgaatgatatgccacttaggaaaataaaacgatctcccagtataaaattaatctcactggaattgctgaatacacatctgatgctcaaaaagaatactccaagaaaatataaattgtttaaatataagtcttaataagcaggatgttaaaaactaaataaagtgacaggggatgcggtggctcaagcctgcaattccagctctttgggggagctgaggggggtggatcgcctgagatcaggagtttgagaccagcctggccaacatggcgaaaccacatctctattaaaactacaaaaattaaccgggcatggtggcgggcgcctgtaatcccagctactcagagggccaaggcaggagaatcacttgaacctgggaggtgcaggttgcagtgagccgagatcacaccactgcactccatcatgagcgacaagagtgagactccatctcaataaataaataaataaataaataaataaataaataaagttatgatgaataacaaatcaaacggaagcaaactgatcctcaaggtggtaaaactcaagaaaaaccctatgattttgctgatctcttagctgatgccacagaaagccaaacacaaacaaacaagagaaattatcctatctgaatacatcagttttatgatatttatgtaactactaaagcatttttttttaagtataactgatgcaaaactggaggaacgcaaagtcagctttctttgatcaaagctcctataacttctgattaaaataataattggatatagttcggactactccacatacattctttcactgaaattggacataatttagtgaagcaagatgctgagaagtctactgccttggcagatttccactgaaatatgtttaaaagcatagtttttctccacatggaaaataaattgtagaaaattaaatgtgagtttatataggattactttttttaataaaataattatcagatatccaaaaagggaagagaattagcaagttaaagaaattttattttgcttgaacaacaactaagtttcataaaccatgctccatgtgtcctaatataaaaacaaaactattaattttaatgtacagggctatgaaatggaatttggaaattatgttgctagaccaatttggttcctttaaaaaaggcaatctttatagatgcccagcaaaaagaaaggagggcctatttagagccatgttagaatcatgtactgtccaggtattaagaaagccactttggccactccaaaaaacaacaataaaattatttactttaaggcaaggcagaaagtctccacattaaatttttgaatttttacttgaattgactccaaaacaaatcaaactgaattacagttgaaagttaagtgaagctaaatataatttatattttctatatcctattccaaaacaaatattttctatgtaatactccaaactataaacgccagacactatgatcagcacatgttatctcattttttcttccataactaatatataagcaggttattattcccgttttacagataagaaaacctagagactgtaattaagttttcaaaggcctctcacagttttgtcgcttctttccactgatgtcctccctagtcttgttctgatgtgtgcaggagtaaagatttctatttttccatctggaggaatttcttagtggcacactccctttaatctgtgtagagagctcaaaatttccctcaattctcttgatccactccaaaataaggatgttctgaagatggtcacagacaaacaagcagggggcagcttttggtagaaggagcaataatgtccttcttaggcatcctcttctcagaaggaatcaacatgtagcccataaaaaacagaacccccatctccatggctgcttcccagagctcagagaaccaatccacctcctcaagtacaagagcagcaaaagaattggggttaaaatcttaactagaaattaaggaggtatcttctacttaagcagatttcaaaccgtgctccaaggaatgctgttacataatatattctatattctgcctctattggaaagaaaaacatgcaaacaaacaaacaacatcccaagtatccaaaaccaaaacaaagtactctgcatgtgagcaagtttggaaactctagattaaataaagttcagcttttatactgttttcattattaaccatttatatgttaatcagcattatgacctccgaaaaggctttaagttcatttatcatctgctgaagtagttcggaaatcctgcttcatatatcctccaggtgaagacttgaaaagagcagctgcagcccaaggcatttggttgaggattcagggacttggaaggccaattcttttccggatgtaacgactaataatatttaatatacaattttgaccaaaaatatttttgcatgaacatggcctaatgtattttacttaagtatatctttattggtaccatattaagaaaagcttattccttcttgaaaccatgtttaggcatcagttgagcacctctgaaactcattttaattttgcaggactctcagattattaggaagcaaatattcaatggggtcaacttagacaagatttccaaaaatgtgttcctcagcttgggttgaaagctgtaaacatgttcattattaatcttcaagagaataatatttatgcggcccttttccacttaattaatcattaacacctttgtcccagagcatcttaaaaggctagtgtttcaaggactatccatctgtttgaataccattgataaaaccttactgtttaagtttattcaattatcatgaataatgaattagagttttctttggtcagtttatctcttcaagatatcactaagctcagtcttgtaaaccctaacaaggtccagttttgaactagttacaatttaggaggtttaactgtcattaagatgcgaatgactcttccagaggacatggaccttgtcttgtacatctctgtgatctccaaagagctgtgcacagaattgacactaagttcaataaatgtttcttcaatatacgaagaaatgctctgttgccacttaaagtgcagagcagttttcatcttcaaagcactttattcacattaattcagctatttacattttgctgatgggtaaacggctggagaggctaaatgggctgttttaaaggctagagagagaaaatcctgcctgtcaggaataaaaatttgcaattactgattaccagtcatatgtccctggacttttgtaggaaaaaaacagagggacaaacaaaggccacctaggtagtggttatcctactgtcaggacaagtcaatagcaggtaaagaaacaagtacactagacggtccaacagctctattgaacaagtatgggggaaaaaaagttatttttgttgtggttttcagtgagtgtgtgcgtgtgtatgtgtgtgtgagcagtgttgatacacactgtgatgcagaattacctttttccatttgcaattctaaaacaacttccaggtgccatgtgctgtttacaaaggaattgaaatacatttgacctcaagcgtattttgctctggcaaagtgtgctaattgtatagatctaaaggcagcagcaacatcatcatttcaaaatagacattaagacaattaaaaaccccatgtaactctactgcaaagtaaagttctcatggagactgtgaggtgtgtacagatatgctgtgtcatacgtttctttatgcgatagtttatgtcccaaaactctttttttttttttttttaagatggagtcttgctctgtcgcccaggctggagtgcagtggcacaatcttggctcactgcaacctccgcctcctgtgttcacgccattctcctgcctcagccttccgagtatctgggactacaagggcccgccaccacacctggctaattttttatatttttagtagagacagggtttcatcgtgttagccaggatggtcttgatctcttgactttgtgatcttcccgcctcggcctcccaaagcgctgagattacaggcatgagccaccgcgaccggcccagctcttatctttttaaaatgacttttttgatgtgaattgggggaggacagagacaagacttcttggccatgtattgcttcagttctcagttgtgtttctctctattccttggaaaccttgactttcttccagtagcttcctggaaggaaaatttgaggaaacgtctaatgtacatagatactgtgtgtatagagaatagtccagttaggaaagtactctatgtaagttctgaaagtctggatttagggtcttttttttttttttttaccttgccatctacttctttccaccctgctaaaatcttagtaattaagtcataagagacatcttccttttatacccaaaaaaacacttgatgagatagaaaggagctgcgtaacattatacttcgtttgggtgtatcttaggaagagatcctgttcccttaggaagtgcaagggaggtggtgaggacataggcaatcaggaccaaaagtgtaggtgctattctaaaagcagtaatttagtagtcaggtgtcagatgaagacagcaaaaaatgcagttttgagtaactggagatggcaaatccccatgtagctggcttaggcttgaactggcaggtacctgacattcaatgcttgaagatgtagggaaagtggctgaggcagagtgctgggtaagggcaggactgagttggttggaaatgggcgtaagtacagcctccagtgtggaggttgctgacaactcagcaatctggtttcagaggaggtctgaagaaaacttaatgcaagatagtttgttagatcagaacaaccactgaaaattctccagaggaaataattgtgcttataacataggtggagtagatatgccacacccatttgacacccaaatcttcatcagcttggatagtaccagacagactcttctttaggtccacagggatttttttaatttctgacaatttctagattctaatccaaggtgacaactcaagaaaaaaattagtaaactagttgtgttctggaaaagaaaaataaattaaagccacagacaagggagaagaaaaacttctatgcttggccaggtaaaggcaagctttctctaggaagtacttatagtcacataaatactcaagaaatcatagacttctggagcaagaagggtcttggttatcatctggactaacagttgctattaacagattaaaaaactaaagccatgaggaattattttatgaaatcatacatctaactgacaaaatgaagactaggatacatttatttgcttgtgtctaatactcctcttcaatttggaaacctccagtgaagcagaacacctaataaaagttaattaggaacaggtactgctgagaccttctctaaaccccaggagcagatgcatctctttcactcgcctggttacctgaatgtaactaaacatgccatctgattgaacaaacaaacctattcttgtatttcctgggaagatgagcccctggatatgaaaatctcacacttttaaggcaaaggacttcaaagtagtccaagggtaagtcaatcagtaaaggaatataactatagacatgcactgtgtgatctggtgttaatctagaactatgacattttttgaaaagcaacaaaaagggtgttgaggtatagctgccaaaaccaattaaaagtaaccagaaaaaaaaaaaaaaaaaaagagaacactaagcaaacaggttttccctcaccatatttctaacagaaatgcatggccatcattaaggatattctgcagaacctattcaagaaagactgcacgtggtggataaccaaataaaatttccttgtacagtcaatgtcttggcatgcaatgggtcccgaggcataaatgcaaaccattaacaaagctttattaagaaagccttcaccatgctttgggaagatgtttgatacaattcaggttaagtgctgatcaataacctggaaatcaaaagaaccgatcacagaagcaaaaaaagcagatttaggcagattcccagccccatcccaaatgtgagatactgacaccaagcataagaaatcatcgctttttctctcccctccttcccccatcacacataccaatgccttttcctcttaagtcccctagctgcaaatatttcttagtgaagtctattttaccccttttacactcacaaactgagtcgcaggttgtacattttgtgataccatcattgatgaaattgatgaaagcctctaatggcattagaaaatcctgaaatagcacggctgatatatacctggcaggtaattgcttaaaactccagcagagatggatgtctaatctattcttaaaaatatgagcagacagatagcagttcacccctccactgcctctttcttgttctcccccaacaattctgctagttcatttgagtgtttcagacaagaaagcaagaatattatgcaccagaatataatgtggcctttcttgcacagcttctctttgcaatcccaaagctgccatttgcagcttcaagcaacagaaaagcatgcttactgttacttaagattaaattcttgataataagcagatttattgactcatgttttgaatacatatttattgaggcactctactagatgctgggcaaagtgataaccagaaatagccagccagaaacactttccacaagtcattaccagagatttaagccacagtaaaaaggtggaggagaatagacgaaaggttttagggggaaccccatactcaaactctccctcagaaaaacaattattaagtcttttcttacaaactgtagagtaaaagaagctgcccaatcgcggtggctcacgcctgtaatcccagcactttgggaggctgaggtaggtggatcacgaggtcaggagatccagaccatcctggctaacacagtgaaacccatctctactaaaaatacaaaaaattagccaggcatggtggcgggcgcctgtagacccagctactcaggaggctgaggcgggagactggcgtgaacctgggagtcagagcttgcagtgagctgagattgcaccattgcactccagcctgggcgacagagcaagactccatctcaaaaaacaaaaaacgaaaaacaaaacaaaacaaaacaaaaaaagaagctgcccaataatgtctgagcaaaatggaggccatgattattttggctgtagtgttttagactttcatgtaggagagaaggattcgctaattggttttcagtcaaataattctactgaggaaaaagaagtattcctgaaagaaaattgagacataacatggataatgtaaagcctatatttaatcttggtcaattccattgtctcattttcatgtagatgtcaaacataccagcaaggagaaaatggttcaaaaatgcaacccagggaattgccctacttttcctacttgcccagtcttcaatacaatagatctttattctgttctcattttctctaacaaaatctccttgttcggaagagtcaaaggaataaatggttggaaggttaatctcctaattactttctcccttcataaaataatttatttaattgtggaaattattatgcagctgtagagggagagcatattcattttttttcaggaagtagttgagcaagcctgacttacgccaagagaaaaaataaaaattcctgagaaaaataacaaattgttcaaaatgagctgggttaagtatccaaaccaaggaacaagttcatttaaatggttactcaggaaatcttgacggtgatctaaattcaaagttgcttttgtttttctaggaggcctggcttacagaaagaacatgataggttcctaggatatatcttaattttgtacttcatttaatattgttaaaataattttgtctctaatatcacagcttgtaatatctcaaacaacactgattactgattggtaatgcaccatactctaacagatatttaatctctatcctctccttccctagaaaaggtgtcatggaccccgggatgtattatacattgcttatagcattttgctgcaactttaaggcaaaaagaaaaaaaggtctctgtcctaatcaggcataacagccatgaaatcctatgtgcaaattgaatatcaaactaatactgtttttactaaccaaaatccattatctaaaagtttgaacaagtgaaaaataatttatttatttgttatggtcccaattaataagatgagaaacttaacagaataaacatatgactatccatttgtacacatctaggaatggaaaaatgacccactttaagtacaaaaaaatgagaataatctataaaaactaatgaatcagtccctttaactttgtttattggaattacaatatcaaagcatttctaatttgggttaagtaaaacatacaccaaagaatctatagacagtacttacaacactgtcagttgagtatttggctttgatatagctttgaaaggtaaaagacaaaccaagtagatttttttttacttggggaagaatgtgagaatgtgttaagtagctcagagtaatcattccataatgtgaacagataccaaaacatcacaatctaccccataaacatataatatataaaaatattatttgtcaattataaaaagcctatgttaattaaactcagctgaaccctgatatatacaaaccagtgatgcaaatggtgttcaccaagcgcatactcttagttggtgagcatctgtaaacatgctcgttctcagcctacagctactaccgtttggagatcacggtcagtaatgatgaccagtctagggaaagttcatggatagattaagtcactgggctagtatggatttgcactgaaattccaagcaaagcctctttcatttagtccaaatcttgttctacttgactgcaactagatttcccaatagggtctgtcaatcaaaattaaaaagaagaaatgtaataactttaatttctttctaaatctagagtcaggacaaaacttctaagtcattattaactggtactctaccaagaatatagctctcaattattcatttcagttcttaattattccctgtttcaaaaaatagcctgcctgccgctcataaaatcattagctggagagaaaagtgggttcaattttgattggaagtaaaagatatggtaggatgtttgtgaaataatgcttgaaaagtaatgttttaaaaagaaaaaaataaaaactttgttttgttgtacttcttgtttatagctttcatgtaaaacaaactatggttgtttcaagatggagcctcacgttcttagatttggtatgtacaaacaatttctcctttgacggaaaatgagacattttactttgccagttactttggtttacttgactggacttgtataattttaatgcaagctaagccaattgttttctaacaaaagctgtcataaaaaaatttatgcagccttggaaatgtaaacgtaaaaaagaaatgtaaaaaagtaaaacgtattcatcattttcctgcaaattgaagctaattacacttagaattacttgcccttccacatatttcatttacaacccatatgatcttctcagagtctcatacttaagttaataaattcagttggaatttttaaacacatttataagtatgtatatattggaaatagcaccacatgtaaggcatctctgaattttgatgagttgggggttaggtggggacattacacaattattctggtttctaagattaaaaaaacaatcttcctacaagaaaataatgcaaactgaagagagagagattctctaccactcttgaagaaaactttgggccttggggctgagaaggaaaagtaactcaatgagccatttgtaacacattaacactaattcttaaatgctatttgtggttaaaaagagatgaaatagacaaataacctggaaaaatctgtgacaatagaattcaaatgtaaattatcatgtctcactgccccgttagctatccaaaggcaaaactccattatttcattccccttctcacatctattacttattttcctttctcaattagttttaattaattgtttcttaaagtgtacttacacatttaacagtggttactgtgggctgtgccgccctctgattattagtcttgaagccatcttatgttattgttccattcctcacactcaaaaggtccccaaagaacaacctcctgaagttaggaccaatggtccctttagtttgtcataaaaccaaagtgatacatgtgtttaataacacagaatgtgtgccataaaaccctgatttgaatagttcttggaaatgtaggccaaagacgtcagatgaaacgtgccaagttgagaggtgcagataaaaggtaaaggtttattttgtaaatgtgtaatattttgatagtcaccagggaagaaataatgttactgcatgtggacgggcaaggtggctcatacctgtaatcccagcactttgggaggccaaggtgggcagatcacctgaggtcaggcatttgagactagcctaaccaacatggtgaaacgccatctctactaaaaatacaaaaattagccgggcgtggtggcgtgtgccagtaatcccagctacttgggaggccgagacaggagagttgcttgatcctgggaggcagaggttgcagtgatctgagattgtgccactgcactccagccaggcaacagagcgagacttggtatcaaaaaaaaaaaaaaaaaaaaaaggtactgcatgggccatcatgtgaacctgaactaatgttattccatcacgtaggatgatggcagtcacatcattaatctaaaatattcactagtttcttgcaaggacattaagtagacagattcaacaattacttttgctagataaagttagggcaaaagtatgacggacagctgaaaagttccattcttttcaatgtcccagcagataaattagtagcttaccagtaacatcaagcattttaaaaagagaggaaaaaacaaaacaaaacaaaacaaaacaccaccagtaatgatccagtttaataacctcatatatttggcttggggtaaatatcaagtggtgctgatcagtggaattacagatgtaattggaaatgttaaattttcttcttactcgactagtcacatagactattctatctatactaaggaaacatttataagattttttgcaaatcgacagaaaagagtcatcaaggaaaaaatatgataatttataattctgtttgttttaatgaggaataatatatgtgggagctgaaaatgttaaaatatatcaaatatttcaaatataacaaaatatttaatcaaagcaaaaattagttttttttaaagactgatacattctttcacctccatttcaatatatattaactctcctaaagcaaattagttaatacacagagcatttttaaatgaattataaggatagccattcaagaattgtttatcctggaaaaatatcagtcacaaattaaatgtaaaatagtgagcaaatggattaaaatatatacagcatgaaagattgctttgtctcttaggacttcacactttaaaatgattattattaacattgaaatgatttatatcagtgaaggcagacatacacctgacttcagggaccaatacaatagagagtatttttgaaaaatgtatattctctagacttgctgatttaaacctcagcttgtgaccaagaattttcatttttcagaacctgaccatgttactcttcttatcaccgaaatctgataaccactgcagtaccaacttcaggatgttcctagatacctttggatatgttaaaggaatcctaagatggttgagggcactccacatttatctaagcctttagaacaacaatcacaaagtccagtgactacagaggccagactttaaaaaggaatagggagaaataaagtattgccgacaggagagagccttccctgtttcaaggcagtagcaactattcacttccattcgatactctcctacagaaatgtagaccactttgttcgatattctgagcttttttctctctcttttttttttttaatagtagagatgttgatgtttatgtgaaacattctgattttcaaatgttggcaaccagtttcgaatattttcagtgtgcaaccaagcactatgcttgcaaataaaacacaggtatgggaaggctctgactgaaggacaattaatttacaatatctgattgtggtaaactatctgaaagatatagaatattatgttctgcatatatatgtgttcgtgtgtgtgtgtatatatatatataaaacaactacaaaaaattatattcatatgtatatacgtataattttcttctttctgtgtttacatatataaagcacagattgacaagctggcttattaatactaggtgtagatattttgaaagagataaacaaatagtattgaacgtatctaaacagacagccaaatcaacaagttgaatggcaacaagtaagacgtacactctatgacagtgactaaattaaccaagagttacagataagagagtgattagcatgcgataagaacattatagaggactacctagagaaggcaaggtttaaattgggccatgtgctgggaaacctggatatctatatgcagaagaattacattagatccctatctctcatcatatacaaaattcaactctaaaaacaataaagatttaaaggcaagacctgaaaatatgaaactactagaaaaaaacatagggaaaacactctaagacattggtctaggcaaagattttacggctaagtcctcagaaacacagggaacaaaaacaaaaagagataactgggactgtattaaactaaaagcttctgtataccaaaggaaaaaatcaatagaatgaagagacaacctgctgaatggaagaaaatatttgcaaactattcatccaagggactaatatccagaataaacaaggagctgaaacaattcaatagcaaaaagccaaataaacacgttaaagagtggacaaagaatctgaaaagacatttacttaaagaagacatacaaacagccaacaggtatatgaaaaagtgttcaatataactaatcatcagggaaatatgaaaatccaaacctccatcagatatccttacccccgttagaatgtctaccatctaaaagacaaaacagatgctggtgaggatgtggagaaaaggcaattcttacacattgttggtggggatgtaaattagtacagccattatggaaaacaatacgtagatttctcaaacactaaaaagagagctattacatgattcagcaatcccactactgggtatttatccaaaggaaaggaaatcagttcaaaggaatacctgtccccctatcaccatgtttgttgcagtaatattcacaatagcaaagacatggaatcaatcaaagtatccgtcaacaggtaaatggataaagaagtggtggtatatgtacacagtggaatactcttgggtcataaaaaagaatcaaaacctgtcttttgcagcaacatgaatgaaactgaagggcattatgttaggtgaaataagctaggcacagatagacaaatatcacatgttctcacacatatgtgggagctaaaaaagttgatcttatggaggtggagagtataatgatagataccagaggctgagaagggtgttcatgtgtagaaagggggtgaagagaggtaggacagggggtataaacatacagttagatggaagaaatatgttctaatgtttgatagcacagtagggtgactatagttaataaaattgcattttatatttcaaaatagctagaagagaggatttgaaacattcccaacacataaaaatgataaaagctcaaggtgatgaatatcataaatccccctgacttgatcgttacacattctatacatataacaaaatatcacatgtacccagtaaatatgtataaaaatgtatatcaattaaaaaaatcaaaccatgaaagctaattaagtttaaaaaatgatttcatataactttagtaagaaatactttaaaattccttaatgctaaaaaatttatcagaccagttaatatataaattttagttatataagcatttaaaaatttagaaatattaaaaactggaaataattaaaaatcaagataggttggacttaagaggtgtggcattaagggagatcagatacaacagactgagcaaaagcaagaaggtgagaataaagcgaaacccaggcatagaacctacaaagaatacagtaagaagtcaccagaaatgtcaagcagactgtttgccagtctgaactatcaccctatccccgtaacagaattccatgaaaaactaagaaaaaataatatgacaaaatatatgttttatttccttctttatgagcctgtttggttaacattttataccatgcaatgttaggttgagaactaaaccaagaaatatgaacacaggaatggaaaatagaaagaaggaaagaaggaaaggagaggaagagaaaggtagtaaggagggaaggaaggaatgaagaaagaaaaataaaagagaatgaggaaataaagaagaaaaatgtaatgcaccatgaaaaggagatacatatacaaatatgcaaagggacatgcagaaaagaaacattgaccaattaatctcattaatgggtacagctcgaaaactaatgtgcttaagtacagagggaacaatttaggataaataatatgaaagaactttatagttatgtaagaacactcaggcaatggatcatgctatcgagggaatttagagacactcttggctggaagacactaatttattatgcgctgatttaagtataattaaaatcaacctagatattaaacaagggaaacgatatgtaacttttagatatccatttattacctaaggacagagagagcagcaaatgtgcaaatgttctacagccagattaatcttcctttaaaaagctcccattcataatatcactcccttttgaaaatactttaattgactctacatgatccatccaaattcataagtggagtattcaatatccatagtctggctttaccctactgtttcaatcatgcctcccacttcttctagatgctggccatctacactcattaggttgatctactccccatactttagggtgcacaatgtttgcccagcgtaattgctcagtgattttttaatggatttactgattaagcttcaaaggcatttccaactccacagaatgtatgctaattctaacgttacccgtatagaatactaaaaaaaaattttaacattctccaaaactatggctatatttttctcctcttccattttcatccttaggatggttttccaaagtaaaacactggcctgtgaaagctactgaaataatcttggtttcttcagtaagaaataaattattcactatcatccccactccaatgcaatcatagcagaattatctttcaaattatagccacatggtttctgaagactaatgaagaggctcagcccaggagacagttttgggatccaaaaaatacctttcagtttctgctctttctaattcggacagtagcaatgaggccacactgattcaactggtaagcttccttcatatttttcattgttgttttttcccttagtttcaagccctacctgagccttgcccacgctaccaccactctgtctgaatttttgcacctttatttcatccaggttgatactcacagcccctgagttttcctgactgtctaagacaacagtctaaaagtgaaaccagaaagctaggggggagaaacagtgtcacacaaaaattctggcagatactgccacctacagggattataaggtcatccccaactcaatctcctaaaaaatcactcatttataatagagggggaaactgggcatatttgaactacacggataaagaagaagccaatttcatcaaatgataacctttgatttagtgtatggaataattatatatgtatatatgtatgtatgtatatgcatatgtaaatcaatcattaaacagggccaataaaaacagggctgtaagaaagaaaattaaaggagaaatatcaggttgtgccagtcgataatttctgttactagaaattattaaaaatcatattggacgagttgattacctatttttggttctatatgctcttgaaaagtttatgtaacactgtatacaacatgatagaatatttacctataaccaaggtgtctaggggttgacatttttatcctataatatttgaaacttaaaattatattttagttattcacaaataattcattaaaattcataaactaaatgataaactatatcattcctgaaataactaatataaatgtagctatttaaaatatgagatgctggctatttctgtgatgatttaatgccatgttaacaaatatagagaagaaaatagtataaaagcatatttttagtatttactgtttaaaaaacctttagatctatgatttttaaaaactgcatttgaaaataattacaaacatatagaaaaggtgcaaaaaaagcacaaaacatccctttacccaagttcacctattactaaaatttaacactaggatttttctcaatttatttaatttttttctctctctgtccacacaaatacacacacacacacagaaattgttttttttcctgaaccatttgatggtgaattacatacatcatggcgctttacctcttaaatattgtgtatttcctaataataatatcgtcttacataatcataatgttaccaaccaaataatctaatctaaaaagtagattatttgatctcatctacaatctatttccccatttcctgtcaattgatccagaaatatcttcacgctatctccccctccagaacaagacccagtctaggaaagctataatctttgaatctgcttttttaggggagaagaaggaagagattccttattttttagctgcgtaggctcttagctgtgtcaccattgcaaccaaatggcttgagtgtgacaactcccattcatctttttggtctaccttttcctttaatacatcttggagtcagaagatggataataaattattttggaattatagatgggtaatatttaatgcccaatataagaaggactgaagacttctaaggtttgagggcagatgattttttttgcatgcatttgacagctcaattgatttttacttcttcataagttacctaagtgctatggataggtgatatggtactactttaggtgttgataactgaattatgtcagtagtctagggatgacaaatagccagaaaaaaaaaattcattagtttccccaaattggtaaacagtttttgggaaattggaagaataatatgagtgtcatggagacactatcggctaaattgacaatcagtaagaattaggtaactgaaaacctagctctttaagtgtgtatgagaggagagaaggcgggttaaactggcagttataattaccatgattcattcaaaagtatgaactgcagtagttactatgcatttccaagtagattttcaaaactcctaaattggtgggagtctaaattcgttcaaccattgtggaagagagtgtggtgattcctcaaggatctagaactagaaataccatttgacccagcaatcccattactgggtatatacccaaaggattacaaatcatccttctataaagacacatgcacatggatgtttactgcagcactattcacaatagcaaagacttggaaccaatccaattgcccatcaatgatagactggataaagaaaatatggcacacatttgttagattatatagagtaatgctaaatatttaaatcagcaaatcatctgttccattatagttttttaaatgattattttgccactacccaaggatgctgtgaaaataaatgataagatattctatcaacaaacaatgaggctttcaattaaagctgattataacttacttttaatgtatattgctattatacttaggctaaaaaaccagtttacgttaacatagtttttatgttaggctaaacatcaatatacacaggccaagttttctttgaataatcttcttttgttaatgaatggtccaaatctttaccccacctaaaattcctttctttgtgttttttacccattgaaattctgtatcgtcatacttaggtcagtcttctgggaagtcttttctgaaggtttcaatttattcctcttaagaatttattttgcatttatgcattctaacactcattttcacattaccacttcatgttgtaaaattttcaagtaattttagaccctacataaataattccctaagaataattttgttaattttatcctattttgtttcccctgtaacactcagtacaaatgctctctgattggtgggtcctctataatagttggctatttcagatgaatggtaaaagacccctctcacatctgggatcatcaggaggtcagagtttcagcaagcattgcagttatgcaaatttctatttgttactattacaataattgctagcagctagaagaagctagagtaatgatgtattttttcaaataagtgccttagaagattcctaggaaaagctaattgcaaacacctaggagagaaggcatatgcattatctttatctgtatagccagagtcctactagttacagagtggcaaagaagcagcatccaaataacttgtcttaggtatttgtgaataactaaaaatttagataattgcatttgaaaataccatattttagtgcattctatatgtggggtccacctctgaacacttgcatccctagagttaaagagagctagaaaggacaaatggacaacagacagcgtctctgcagacgaggtgattctttgagatgttattaaaatgagtgctgttcaactacgtgattgactgtaatatgaagtcacgtgtggaaaaaacaaaactacaccctgcattataaacaccattctagtgataagacatcctctaacccacttgtaaaattaagaagataaaaaccacttagttagatttggcttaaccatagttaaaacaagtttctaacatgaagtaaaccttaaccacaggcttcttctttcagaaaagcaaatacaaaacagttatagctagaaatcccatggtgtcttttaaagtactgaaagttttcagactatattgctgaagcctgttgcatgtagcctatgcatgtagctgcttgtctcctgtaggaatcctagcttacaaagtctagatgtgaaataggtcctgggttgagtggggcatctataagttaaaaatattttcaactgtgtagagttctacaggttctccagtcttatgattgggagaatggtgcttgctgactgtcagatgcttctattctcacatccatcttaataatatattcacacaagcatatgctgttaaataaacaaaagcagtactgatgatgatctggtatctgtgagtgtgaaactaatttttttttaagttgtaagtcatttgcaacctagacacttacagagattattggggtaaaattgtggactctagaggcaacagctccaccatttattgattacatgactagcaagttacttaacctctgtttatgtcagtttcctcatttataaatccaaagctaatattagcttctacttcatgaagtctctataaggagtatgctttttactcaagcagagcacttgctacattgctcaaacaatattagcttgtcttaataccattacacaaatacatgaagggcaaaaaaaaacaaagtctaatttctccaataaacaaattgctcatgtcatcaatctaatcaccatttgattgagtttagttgtttttcttttcctgaacacaggtccattgctagacatgcacttgcttatccagagggccaatcagatttctgaaaaagttccaagttttggcatattcctctctttctctttgactgactgacccatgattcagaattgcaatcacaaagtgcccctgatgctactgttcacactgtcagaggatagaaacacacaaagtttaatcagattctcagtagcaatgtgatgtcaatcgggatgattaaataccagccattctaagcctgccttgcaattgttgtctgagaattcacctgagtcctaaggaatgtgataatcctaggtctgcagagtacactgacccagagaaagaccactgacaacatctacatctacctttcttttggtatgggggtgccagagagggttaaatttacagtgtgtataatcatctctgggttgaaagtctatttgccaggttcatattaacaatatgttttctctaagagcatagcataaagtagtgaaaatagaggtctttcagcaatgcatggcttttgcctacagcagcagagagggaaggtggaaagtcattgctatgaaagaggctatttgttgtttataaagcataatttttaaagataaattgctggaaacatcgatgccatgaacataagtagacattgttcactttatggaatccattttatatccatttgcgctgcctgcttatgaaaggaataaagggagaatttcagaaatggctaagcaaaaaagacaaagggtggccattttgttaaagttttaccatccaagaaagtgctggcaaagaagtggagatatatccacaccaaattgtcaccactactgataaataactcagagaactgatctatataggtgacaaatcaaaatggatatttgcatacaaagagaagcaaatgatatggaataccatatcatatcctcatgacctagtgtcaatgtgactatgatggaagccataagtgacaccctcagcaaaataattcgaattcattctagtgctcctgggctcccatagcaccttgtatatacctctttgataaaacttactatgttttactcttcctccttacccagctagcttttacactaaactgtgagctatttgggaatagagattttactttccttatctttatatatacatagatttatctcagtgccaagcacataataaacaccaaaaatgttgaatattgattggattctgtgctttcatctttggtgactagtttaattgaaaaaaaaagcagtagttctgactcaagagaagacttgagcccccagaaataggcttgttttcattattatctgtaagtattccagtatgttaaccatgccatttaactcactgcctgtatgtagccatatgcatatcagctgaactattgatgccaaatgaaagtgggattatataattcaaaccaccccttgggtttaaatttggtccaagacttgcactctttatatttcttattttttttccttctattagtgaatttctccattactcctggggaaatagataattctcctttaagtagattcaattactgtaaagaaatcacacttgatcactttgaggagatctaagctttgctcaaactacaattcaatgagctgacctagagttaatcaccttttactcattcatttatcaaagagacaagcacaacaatggatggattttggcatgcagtcttcatgcatgcaccacattaattaattcctattaaggaggttttaccagcacttgcaatgaacactaacacttataaagacagcacagtccacattcttgctgttctgtctacacttagacatcagaactagcaaaggatgtattgtctatttttttctacataaaataaagcttactactttgtgcaaaccacttacctactgataagtccacactctgctagtttcagtgttctcctaaagaagcaaaagtatattactgctaaatgttcctgtaaggactaatttccagtgaggtgtatctgtcattttgtacatctttacaatttctgaactgcagaaagataacaggttttgtagaataaagaagaatcatttaggaattaggtgttagatacctatctatatttttttgtttctactcagtatcacatttatcttctgcgatttataaaactatacctccttttacaggaacatgatgcttcccatatcacatccaaatggagcccatagggattgctatgttcttacatgaccatacacccctggccagagttggtagattgaggagtaggctcaaactgggccaaacacagtaccttacctccctgaacacatttgattggtccaggagtgggtacctcacttagcccactgcatctagagccaagtgtctattcccatctttatcctgggatatttggattttagatggtatcttcaaaaaactcagatttgtttcccacaggggctaaagatttatgcaataaaacttaagagttctcagaaactaagtttttcacctcaaggaaaagcctagtctgcagtgaaaccaaatgaagctgacaagctgagagaggcaaagaggaaaaccagattgatttctgacagtgcctgaatcccgagggctggacttcaccactcttctttcctcagctttgttatttaaggtttctttccattctgggagccaataaatctccccctttgcttaaatacttcaggctgcctttctgacagttacaaaccaaacaattctaatcatattcattaatagtgcacactaaaacacactgtcaaagacagttacatttcagactcttcaaaaaaaaatcaatgaaagtgacagaagtttaaaataggatatcagtatgcaccagtatagcattcttatttccccatgtttcttctctaatcaccctactagattttcatagagtgtttaatatgagggaaacaggggaggttaggcctcaggcttctagtttctaatgtatttatagggaaagaaacaattgtaaactagtaccaaaagctccaaagctttaaaacaagcaaataaaaaaaaatcaataaataatatgggatagaaacagaaagtagattagtggctgcctgggactgggtgtgggaactgagaatgactaaaaatgggtatgaggtttctttttgcctgatggatacattctaaagttggattgtggcaatggttgcaattacttagtaagtttactaaaaattagataactgtatactttaaaaattagtgagttttatggtatgaaaactatacttcaatgcagctgtaaaataggcaaataaagcaaacaaaaatagaaataaagagtatgagcaattctacagattttaagcagctagagaaaatgattaccaataataatctttaggaattaaaattaacaccaatagaagcagcatgctgtaaatgtaaatatagttcaatatttcatttttaattttttcttattgtggtataatatacataacataaaatatactgtcttaaccattttaagtatacagttcagtggtactaagtgcactcatattgttgtacaacggtcaccaccatgcatctcaataactctttctatctggcaaaactctattcccactaaacaataactacccatttcctctctctccagcctctggcaatcatcattctaccttctgtttctataattttcactactctaggtacattatataagtagaatcatacagtatttgtcttttcatgactagattattttacttatgacaatgttctcaaggttcatccatgaaccctgcatatgtcagaatttctttccttttaaaggctgaataatgttccattgtatgtatacagtagtccctccttaaccacagggaatatgttccaaggcccccagtgcacacctgaaataaggcatagtaacaaaccctacttacactatgtttcccgcagcttttatttatctgggaatatcttaatttctccttcactttcaaagaacagttttgccagatataggattcttggttcacagttttgttttgctttatttttttattttggcactttgaatatatcagcccattgccttctggccttcaaagtttctgaagagaaatcttagctaatcttattaaggatgacatgtatgaatgacttgcttctctctcactacttttaagatcctctctttgtcttttgacggtttgattctaatatgactcagtggtttccctttgaattcatcctactttacatgttttgaatttcttggagttttatatttatgttttcattgaacttgggaaattttcaggtattatttttttcaaataatctctgtccctttctccttctcttctccctctgagacttccaaaatgtgtgtgttcatttgtttgatggtgttctataggttccttaggcactatttacttttctccaatcattttttactttctgttcctcagactcagtaatttcaataggtaaaaatcttgacctatcttcaagctcagtagttcttcctcctgtctgctcagttctgtattttattccctctagtaaatttttcatgttagttattttatttttcagctctagaacttgtttgcaatttttaagattttctacgtctttgttgctatttccattttgttcattcatagtttttttcttaatttcttcctttattcttagagcatttttaagacaattgttttaaagtctttgtctagtaagtttgccatctggtttttctctggcacagtttctatttttttttcctttaaatgagtcatactttttcccaattctttatatgtaattttttttttgttgaaaaatggacatttgaatttaatgatatggcaactctggaaatcagattacctcccttcctaaggattgctgttttttggtttgacttttcatttttgttcttttgggttcttctgattgttgcaggctgtctttgagccagggatcagcctgagctataaatttgaggtcttctcaagtttattctgggctcatgcctttccctgagtatgcacaccgactttctaatttcctctgcatatgcagttgcttttgaatgtctaaatctttattttctggctccaaaaaaagaaagaagaaaagaaaagaagaaaaataaagtgtgtgtgggaaagttaccaggcctttaaatcctcctcttagctggagggaagaagggtttgcaacaatgaggagagggtgaaatgatgagtccccacctctgtatctgcacctacatggtcagagacagtagtcagaaatcaaaacacaggtctctggtatttgacactttgagtcttatttgtccatcatggcttctacaagctgcatgcaagcctaacacagtatggggagtagagaagatagatagttgctgctaaactaaaactgactaaaattaaccataatttatcatccaagtcttcccttagaagttatacacctttaatagactccagagattaaaaatagttacttcagacagattgtatcagtgcaattattgtctatataaaaagacagattcctggtgcttcctttttttagatcttcccagactcctctttgaagattattttttatcctaatctacatatagtttcttcagataaagatctgaataaaaaaaagactacgcattgagtacaatgtatactgctcgggtgatgagtgcaccaaaatctcagaaatcatcactaaatcattattaagaacttattcatgtaaccaaataccacctgctccctaaaaacctattaaaattaaacaaaaaaaacagtgtggaaaaaattaagaagcatgggaattgtaaataatcaaggatgtataatatctatgaattttataagatacaatgagataaatagaaaaccttagacagctttctatccggtaaaaacaaatggaattgaccatctattgttaaaaaaaggacagttctaaagatcagaggtcaactgtgagtgatgtgagaatataattagccacagaatattatagtacttcaataaagaaaggctcctatagttaaaaacatacaagtcagacaaaggaagaacaatacatctatgatccataaagaattaataaagcagaacaaaaaggtattctgcagatataatttgcctggatgttttgcaaaaacttttatgaagaatttttcaaaagaaagtcatggaaaataaagaccaaggaggattttgaatacaaattaaaatttcattgtttgagatcaaagagtatacctctaataagcattaagaaaaaaaagcatttaaatgtaagcattttaatgtattaaaattattaagatcactgttgcccaatagattatattaaacaaccttaacttaaaatgaaaaaattgaataaaagtataaaatcattcaaaattgtatctatagtggaatttcatcaaagctgtaaaataactctaattaccaaaattatatctattttttaaacctgttttcctatttaagttgattactccgtgaggtaatttttactgccccagtaatgcgattcaagttttttacatctttccacagattcttttattatggaaagaagacactaaaatactatccagttgaaaatgtaattcctttcttaatatatcccaggttatttttgttagtaagtgaagtattcagggaaaatatctctagcatccccaagtctatagagtagtgtgggtaatgaccaataaggaactattttggggtacattcatttattattttgcttggggccctcaggcatacatatacacttccctatccctaaaatacaaaatctgctacccaagaacaattaagaaaaaaaaaaagaagaaaggagggacgaattatgataatttaattacaatgctgacaaatgtatacatgaagttcaaaggttattctcatatgctccttctaagagtacaaattgttatataatttggtaagatccttctctagaataaaaaacaatacaagtttaaagctttaagattggatagtatttttgatcctgtttttttccaccctgacatttattttaataaatacatgatgcatatgtagaatattttatctaaaaagatgttagccacctttttccttataacagtgaaaaacggaaacctctgcctataagtaagagatgcataaaataagtatggtgtattcatataaactatatgcaactaataaaaatgatggccaaagttttcacagtagactgagcaaaaaactatgagacagtacacacatttctactgtttaaaaaaaagtagacatttgtaaatttgtacaaaaagtagaatgttcttaaaaaagtagaaatttatttgcatatttaagttgacaaatttgttaacttaaaaatctaagttaattcacatgcaaataaatacatctagaattatatatatatcaatatgtttttagcatttatctctggatggtgagattataaattattttactttgttctttgcttctctttgtattctataaagttcctacaataaatacatattacttttggaataaaaaaggaataaaggttatttctaaagttaaagtaaaaaaattaacagtcatataatgtaaaatgaatgtgaagataccctgaaaatacagagtaaagggatctctctctaggtagtaaaaccaagggctaagtctttttagaggccccattaaataagtaggatagcaagtaatacagtgtatgagaaagggcaaaggtctcagcactagcgtgcctgtgttttaggttaggttttaccatttagtggttaaagactttgggtaatcattgtttgacttttcttactttattttttgtccacctataaaaaattacgtaaatggttccttgccttttatcttacgggttacctcaatgttcaaacatgtgcatgaatgtggacacattttataactataaagcaataatgtaagtttattaaaaagttgttaaaataacattaaggagaaaagcagacaaccaaataatagcacaattcagtgaaaaaagaaaaaaataaaccaatacaatgtaaagtttcacacgccatgttttaatccttatctagttccttcattgaaaggaaattatatgagtatgtaagataactatcaaatcctacccttttcctaaaacatcccctttcaagtcagttgcaagtaaactcttaacaacaaccacagtactgctattggtttgaattacctgcaacatgtaaagcatatatgcgattcacaaaccactaaagtgctataagaaaatgtccttttggttgtctcttatgtaccacacaaatgctaaaagaacaataacaactaatattttcattgaaagtctattatgtccctggggctgtactaagtgctttgtatgtattatcttagttaaaccatttaaccatcttcttaagtaggtgttattaagtagccaattcaaagacacatagaggtacacaggtggggcaggcattaaagcctatgtgcttaatcactacataaaatgccttctgttttgcaatatgaatggatattgtggtgaataagatatgggctctgtctctaaggctactgacatttaacagtggaggtaagatatgcatgcattcccaaacaaaattcaagttgagatcatttggacttctctctaagagtagttggcattgtatctgcgtcttaactttaagcgttttcaccagtcattcaggcacagaaagttatatatgtaaagacagaatataaaaaagataagcataggcgtttataatatttacatatgaaattatgtatgcaatatacacattacatattattccaggaatacgtattttattcatgagccaacattatgctacttgagggcagaatgtgaccaattcttattacaagactttcacataatataggacttacacactcagaggcagatgctgaataaatgccctgagctgtgtttttaagaatatttgtttcaaggtacgaacatgacagatttggccatagggaaggtgaagcaggggaaaggctagtaagatagacgaaatgttgtccagcagcagaaatggaggcagtaagaatggagaggaagaaacaatgcaaataaagtccaccagcgttgggcagtctgtagtgagaaaagtttaaagatctcttttaaagtggcactctggatttccaaggaaaacactctattgtcaagtaaagtgaatgtgttgcttggtaggatgatcttctgaacacattgaatttgaggtattgaggggccatttcatgactgggattagagctggggatatggatttaggagtaatcccccgagagtggatagatgaaaccttgggagtagctagtaggggagagaaacaaggagggcaattataaaaaaaaagaaatgaagctgctggagaaagatccttcaggaatatttataagaagttgagtgtgtgtgtgtgtgtgtgtgtgtgtgtgtgtgtgtgtgtgtgtagggggagtcaaattagaggaaggaattaaagggtcacaagaatctatccattttccaccacatctgatccataatttctaaaagcttaaatagaatccacatcattgatagatttgtctttctataagtctgtggagcgttcatcagagcccacaggatgcaaaagtagtacaaaatgcccatcaaaatattctccagcttcaatccatttaacataatttaactaaggtaacataccttagttaagacaatcatcactatttgctgacattcatagacagtacattttcttacaagcatttacttcataaaacaccaagagaaattaaactatgttggaacagagtgatgtctaacacaactggaaaaggaaaaaaagggttctggacattgttatcccaatgttaatgtcctaatcttgatttttcttacaaagcaactggttttctttgaaatgtctaattgatgaatacaattaaaaactaaagttctttgtgaaggaaaaaaaacattatcttcagaaaccaggaagctgagtgttaagccattgctttgtttcaaatgcagctgtatcttgttgcatgatagcatttatggcatcaccagtggaatattgtttttaataagtgcaaaactggtgaagacattggtctcctttagaaagaaaaagttaataatttcttctccaccacatattggctaccctgtttattaaaagatagacatttttgacatttggaaagcaataattgattctacaatattattaggagtccatatagatagtgaacctttcctgtcaggatacgacaaaaaacgcgtaagatagggacatccaaggatcacctaccattcatcacacgcaaggtaactgctttcccctaagttcactcaagcagaaaatgaacagttgccaatgatgatcagagagatagaaaatgctgcttccaggaatgaaagtctctttgttgttgttgttgttgttgttgttttaaagttaaaccaatattctatatacttttgctgaaatagcaagagggccagatttgataagatcacagtcctggaactgatcagttgctccttgatgtgtttacagaattttacaatcatataaccaacagatgctcaaaagtagcctcaaaaccaacaaagacaaacattctgttttcaatctttggtgaattattttgaagtttcaaagcatattgctcagaatggaattttacaaagataatctttagatcttagttatttggaggattataaactataccaatttactgttctatcattggaagaactgcaagtattttttgctccccacaaaactaaatctcctctgaaaatagaaacctatttcaataattcaatttgtattgcaatcaatacaaattgattgggtgcaataaaaagtacagctaattcttagaaataagcatgcttatgtcattaaggctaaaactgctagcatgagaagctcaagtgaaataaataaagtgtattcttataataagcattgccaagccattggtagttgaagacactattcaaagatgcaaccttgtctttcattggtgttctctgtctgcatagaaagggctgtgaaaggagagatgcaaaagaggcaaagaaataggaaaaatgtcttgggagaaggaaggatgttccaatgatatggaataacaacaaaaaagttaacttgggacaagttattatttaataatactggagacaattccaaaaatattttgaatcacataattatgctgtggaagaaaaaaaaattattcaacgtccaagactttgtgtttgtgaaaaaactgtcctctttattttatagcccatatattctaaatgtttacaaagataaacaacattgtttttgtgaccattaaaatatgatatgtgaggaagtatgcagggcttgggacttgaagattctgcatcaaattcagaataaataacctgtgatttagctacaattcgggccaaaccttcatggctttttgacatcaagaactagtacatagtgagggatcaaaggatgcaaaattgagtgtaatcaaggatatatgattttttcttctatcaggtaaggtacaactgctagtattgatgaaatgacaacttaaaaaaaggctttctgggccagacgcagttgctaacgtctgtaatcccagcactttgggaggtcgaggtgggcagatcaccttaggtcaggagttcgaaaccagcctgaccaacatggtgaaaacccgtctctactaaaaatacaaaaattagctgggcatggtgatgcatgcctgtaatcccagctactcaggaggctgaggcaggaaaattgcttgaacccaggaggtggaagttgcagtgagctgagattgcgccattgcactccagtctgggcaacaagagcgaaatttcgtctccaaaaaaaaaaatggctttctgttacaaaaatgacaggtcagtaatctgttacagaaaaatttataataagaaaatgtgagtaggtaaacacacctaaatataccttaaagattgctcaaaaaaagactcaagtggattaaggacttcccaaagtattcttagtggtgcttgtcaaacactatccagaaagccctcggtcaggtttgtaatcttttcggtagtgttcatttgttgcaataaaataagtcagcagttttaacaaagaaaaaaattctataatgtttactgtttaatactaaacacaacagtgtgagattatttcctgggcttttaaaaattatacatatcttttttttagaaacctttacaaggaatagtagcatcctatgaaaagttggcttaatatttgattatatatggtgtgtatgattatctccataatttgagacattaggctattggtcagaaatgtgatctccactgtaacagcattttaggggaacaattatatttgatatttctgttttcaatttatagtgtctattctagaaatataatctgccataatctgtcaaaactgccaagactgtttgtagtacttcaatggtactttacagctaatatcaccaccacccaacacccatctgcataatgcatttaaccttacaaagaatacttttatctattatattacttcattttcaaaatggtcttataaaacaggtagagcagggattttaactgaatttccattatgaggaaaataaggtaacaacccattcctggcaaaatctggactagaattcaaatcatttggctccaaactaacacatgcttctccaaaaagcagcccagtatttccagcgacttaatttaatgaacagattcaagacatgggttaaaaatgttgaggatgtcaggctgactgtcactgagtatacttcttgggtaaggggcatccttactcctgttaagatgatcttactaacagctaaagcagactgggagaattttgacaggagaactactattcttttcagacacagatagttcccttttggtgaaacttgttgcaatgttccacaaagtgttaccgcatctggaaagtccataataattttgatttatctgcactgacagtcagcagtatgttatattcactgttgcataatattattatctgttgatcttcccagtagataatatattcctcaaaggaagaatcttgcttattttttaactctgtttagtgccagccatgttgaagttgctcagtaaaatttgtgggaggaatgaaggcaggaaggcaggcaggcaggaaggaaaggaaagaagggaggggatgacgaagttttggaattttcttttgcaaaacactctgctaattgaatttatgacacaaaagagttcagggacaacaacaagaaaaatgtttgaagtcattgtagcgaaagagtatctcaaaaacaagtaagagaatgacttaatccaaccacttgatatgaaaattaccagtaattagcctgtgttaaagagatcaacttttttacacaactcagcagcaaattggttaacttaaccaaagttatgcccaaattgctccttatccaaactgatttctatgttttggtttcatgaaactgatctatcattcaggacaataaactaaataagaactaggcgttttatatagtgttaaggaaaaaacatcattactggcactagtatcaaataatattgctttctttggcaagcaactcaaactaggaaaatgaatttattaaaactcttcatggaccttatatcaagtctgcaatctcctaaatgtaaaactctgcctataaacattgtcagggtaaaattttgccttaaaacagagtaattgcttctatttcctgtgatgtttacacagcaactccttcagaattactcttaaaaagaaatagaaaagaaaatcaatagcaacagtgcactatgaaataaactttgtggcagaaatggaaccagaagattaagataaaaccataaaagtatgaaataataaaaagggcaccaaattcactccataaaaaagactaaacatgatttcaaatgtatattacacacacacacaatggaatatagacattttgtatttcacaagaacatttttataaaaaataatttgcaaaaattaatccagtagcaattaatactattctgcctaacctcatggtattgacaaaccttaatcagatattatttgtaaaaatatactttacagcattattacaaatgtttcattttccaaataaattatctttgaaatatttttactttgtataaaatttttaaaattcaagaatcatatactctctcttgttaaaaatgtcaactactaattacacaacttactataactgcttttactatttgtatgcaacattcttcttcattatttgtgttctactttgcttgttttccaaagtctctggagatattcttgtaagacaaatttaaaacatttatcaatttttatcttaaatattaatttgagttgaaaattagacatgtttaccttaaatactgagcaaaaataatttcaactatatataacagttatagatctatcaatccaaaatgtatatatatatatatatatataaaacaatactaaatgtagtatcttaagtaattttgaaactaacatgaatttccaaatgcttctttagcctagcagacgtccaatgatacacggttgaaggtaactgcttcaatggcaatcaatcattaaccatcaaatccactcaagactagaatcaaactttcttctattaaattacccgcgcaaaacaactgagttttcccatccaaaccattggcctctgcaacttgtaagagtagagggaaaacagacagatctacttgataatcaatttaaaggttatcaaggctttctttacttttgctaacacagtttctattttgagccttcttggccaatgtgcttctgcctaagtgtcacaatctgttttaggtcttagctaagaaaatgtcttatatggtttttacagttaaggattgacaactgccttttgcttttgttggtaagcactcctctaaagttctcttgcctgatcaaacctcacaaaaatagaaattggtccttattctgaatgtttaaaagtccagtaagcatttactttttcttgacgtgtgttaacatatacacgttttgatctactcttgaagtaattaatttaggaaagtgaattaccaatactgtacaaacacatgatgccatatggattttcagggctgaaccaagttcataagcaagatggcaatgaggagacatctatactttatcttattgcaactaccactttgagctaagtacacagagcttgaaggagaaatcattacttgcttctttggaaaccaaatccatcctctcaaaccctatggttttcccttccctttgttaggccatactgatttacattgtatttcagtattgaaatttacatcagaccaatttcacattgtttagtaacttgtgatttatgtagtattaagattaattccattatgaccaatatcctgtcatatcatttaattacattgacatttattgtaattacatctaataaattagatacatttaaatacattccagctaagaatttaaacaaatgagagccacctggcacaatgagagaaactgtttcagtacagagacggcaaagacactctctgctccccaagttaaaatgatttagtttgacacaacctggaggaatttattctgtgatcacgatattttctcttttgcataagatacacaaagtttgagatggaatttggtggtaattagaaggcagagaagaccataagaaatatgggaggtcatgcttttctcttttcattaaaaagttatctaaaatgatagcataatccttgatagtcatttttaattggcaattattgagtacacacagtgcagccagaattgaactgaagtgtcacattgtcaaatgtgacttttcctgttgcatttgctttggcagcttgaacataactattaggaccaagaagaaataaatacttcacattctaaagaatatggggccagatcctctttccagagctatgatcaatagcaacccccaccgcctaatcctccttccctaacacactttctaatctacataaggtgatctgaggatcagaaaagagaaagagacaacgcattcttaatggagaatacagaggttgtgttctccgttctccgtcaaaacacccaatttaagtgcgattgaactccaaaataaataaagacagggacactggcatgtcacttccagggctctgtacttactgtcagtggagtgaagcaaagaacttttaactcaatttaatacatgatccctgtggcttgaggctatacatgaggagagagaggtgtctactcctcacctggaggtttctgaaagcaagagactctccaaacaatctatcctagggtgaaagaacctaaaaagccaaggagaaaagccctctctgatcctcacaaccccctgaggttgctgaagaagacctcaatgggtaactgacctcagtgggtaactgagcttcatgtggagaagtatgaagtagaaggtggaagaagaacgacaaggtggtctagataacagtcatattaacggatcctcatggaggagtgagggacattagctgcttatagaaagtacggtagcaggagcaacagcatgttgtgtttacacactttgacatcatatatttctggatgaagcctcagcactatttttttttctttttctttagacacagtctcactctgtcacccaggctggagtgcagtggcgcaatctcagctcaccgcaacctccgcctgccgagttcaagcgattctcttgcctcagcctcccgactaggtgggattataggtatgcaccaccacgtctggctaacttttgtatttttagtagaaacgaggtttcagcatgttggccaggctggtctccaactcctgacctcaggtgatacacccacctcagcctcccgaagtgctgggattacaggcgtgagccacccaccgcgcccagccagcactgtcaactcatttaaggtctctgagccttactttcctcctctgcaaaatgagaacaatgtgctctacctcacagggcttttatgatgaacaaatcggacaatacttttagaaatgatgtcaaatgattacactatgcaaacaatgatattattacttaacctatatattacattcaacttcactgcttgctcatattatcttactatattatatatattcttaggacagctggagtcttgtactactttatgtcttgtgtattctccaggtgtgctatatttagcataatctaagaatgatttgcaatgacccttatctttgtataattctcttccctttgagtgtgtgtgtaacctgtaaatatgacaatatatctcaccaatgatacaggctgagcaagccaaatctaaaaatttgaaatccaaaatgctccataatctgaaactttgcagccaatatgacactcaaaagaaatgctcattgaaacattttggattttggattttcagatttgggatgctcaacttggtaagtgcaatgcaaatatttcaaaatctgaagaaaatccaaaatctgaaacatttctggtcctaggcattttggataggagtactcaacgtatgtgtgtgtgtgtgtgtgtgtgtgtgtgtgtgtgtgtgtgtgtgtttgtgtgtgtgtgtgtgttcaagaatggaaaagccactaagaatgccctccagctgacaaccagcaagaaactgggacctcagtcctacagcctcacagaactgaatactggtaacattctgaagaagcttggaagcagtttcatcttcaaatcctcaagataaagagcccagtcaactggctccttaatattagccttcttgagaccctaagcagagaagcaagttgagctcccacagacatgtgatctacagaaatgtaagctaaaaaaatatatgtgttttttggctactaactttgtagtaatctattatttagtgattgaaaactgatacagatgctaaaacctatttattaaatgcatactatttattaaatgaaagccattgattgaatgttcatgaagcaattaatatataatatctgagaacatttcatgtgaggtcttgtctgaaaattcttctgaagaattttgaatccttattagaatctgaaaaaaaatctcagaggctaatcacaactaggattaattggaagacatgaataagcacccctggtgatgtttaaaacatttgttgagggtagagtggtagagtttagcaaaacctgtagtcaagtaggatggaggctcggcaccaatataatttggccaaaaacttccatggtttactcataggctgatggcatgtagattacatacaatgaaatgataatttttatgttaaggagagaattctcaaaatatttgtaaaaatgggcagtttgggatggctttatggaaaagtggggttcatgttaagtctcaacaccgagtactaatgactaaagtaaaagaacactgatgaggaactaaaagaaaactacagagataatcaaatctgctcccctgcctcaccccttatgcattataatatgtcatcattccctgccaaaaatagaattccttttattttagtatatctctagggaataagatcgaagaacactctcctaggaatttaattatccttcgttggaggaaatcctctcgctcaacatgaaggcaaaaagtaaaggccatttcatcttgtcctgcctcccccccgcctgttaattttaaaacacatgtttagatactagaatattttaagaaaacagctaccatactggcatctggtgctattggcaaccagtgcaaggataagctccagtgagaatttaaaaatgccttttcctaaggagaaactgttaaaaaaaaaaaacaacctgattatcaattgttccccaattcatgaggaaaaagaacaagtattatcaaagagctaatttataaatacctggatttacaactcttttccactaagtatttccaaaataattgttctcaaagttaactgtacactagagttaactagggacctttaacaaattttgatgcctagtttctatgcctttaaaaattctgaactaattggtctggagttcagtttgtttattgtgataatttcaagagctcccaggtaattctaatttatggcctctgagctatggtccaggattacatgcatagtagacttctgaagaaagacaaccatgagttcagtttatttctccactagaaggactggattttagagatctctgaagtaaaatatccatgcatatttgctctgaaataaaaatgttacagaacaatgcttttatttcaaggtttgcatttttccaaaggttttttttttcaattcctctgtttgcaatgcagcaatatcttgtttgaatgcaaattaaatcttcctcttaataagaaggatgtgtctctgcctcaggaccatgtacaaacagtctggtgatggcaggcagtgacccagggatgttcatgatggactgagagagacatggcaaacattacaagcatgcattgcaaatactggactgtggaaaattaatagttttaacccttaagccaacttcacctggcacagtagcatattttagcaataatttacctacattttacactaacttgggggaattacagacacaaagttggaaataaaccatactgaagatagcattatactttaccttggctgaaacttgggaagcaacacaatttggcctttatatttaaaaatcacggttcatttgacgtcacataaatgtagagagaagagtggaaatttgagtgagaaaagctattaggaagtatatttactagagaaggaatagaattaacagaacttagtttttttcatcttacattttcttttgttgataacgaatcaattggaacatttttgaggttgccagaatcttctgattctggagcctaaataaggttttttactggcaggttgaccgaataatagaaatttcatggccagaggccaaccaacactttataaaagccctctggaccaggtggttgacaagcccaggacttacatgaatgcaaccccagaagaaaaacttgcaagtgcctcttcaatagccatccaagactcttgcttgaaattcaaggcagctgatggtgatttcgtcttccatttacaacttctttattcttataaaaagaatgctgtatccttttctttcctccccaacaccaacagttcactcgttcaaaaactctaaggcattcagttaaaagtagatgaaaatattgtttgccagaaacatcttcaaacagaatatgagttttcacacacggaatgctcattagaagcagaagcaaacgtatcactgtaacataataatagctcatattgagcaagtactctgggctgtgtgcctaacatacaatagctcatttaattaaccataatgttgggtggaagctattattttcatttcacaaattaggaatctcagacacatagaacttaaatcacttgctgaaagccgtacagaaagcagtaaaagatccagtattcaaaagtaggtaatttggccaaaagtgtccactcttaattataccactctattgtagctattgtgtaaagtggcccatgagaacaagcaatgggtaccttgccccagtggaaaaagataaattcagggaagtttcttgggtaagtttatttctgcactaagtgaaaatgttaaataaaaaaatatatggatgaggtaggcagggcccagtggctcatgctagtaatcccagcactttgggaggccaaggagggcggattacgaggtcaggagttcgagaccagtctggccaacacagtgaaaccccatctctactaaaaatacgaaaattagctggtcatggtagtgggcacctgtaatcccagctactcgggaggctgaggaaggagaattgcttgaacccaggagcggaggttgcagtgagcggagaatgcgccactgcactccaggctgggcaacagagcaagcttccatctcaaaaaaaaaaaaaaaaagaaagaaagaaattatatggatgaggtagatggaggacgggggatggaattcctggcataggggatagcataactgaaatcaaaaaggttgaaacaaagcaaaacaaaaaaacaaacttacattgtgtgttgggcagtttggtacagtaaagagataatataaaaatcaaggagatggcactggagaggtgaactaggagaagatcatggcagtcttagtatcacaccaagaactttgactttgttctacaggtcagaaaatctcaaatatttctgatcatgacccacagaaaaaaatatattttacttggtgacaaatacttttttaagcatgtattttacttctatataataaaagtttatatatctttattatacatgttatttataatacgtcatattatagataatatcacacacacacacacacacacacatatgtacactcaaactggttgagcaccctaaatccaaaaatttgaagtttgaaatgctccaaaatccaaaattttttgaacaccagaatgatgctcaaggaaatactcattagaacattttgttttgttttgttttgttttgttttttttgagacagtctcactctattgcccagtctggagtgcagtggcacgatctcagctcactgcaacctccgcctcctggattcaagcaattctcctacctcagcatcctgagtagctgggactacaggtgtgcaccaccacatccagataattttttgcagttttactagagacagggtttcacgatgttgaccatgctggtctcatactcctgtcctcaagtgattcgcccaccttggcctcccaaaattctgggattacaggagtaagacacgatgcacagccatcattagagctgggctctaatcatcattcatattttatattttcatatttgggatgctcaaatagtgcaaatattccacaaacaaaaaaaccctgaaatctgaaacacttccggttcaagcattttggataagggacattgagtctctctctgtctgtcgtgtgtgtgtgtgtgtgtgtgtgtgtgtgtgtgtgtgtatgcatctgtatagttggcccttgaacaatgtgggggttggggtacccatacactctcagttgaaaatctgtgcataacttttggcacccccaaattttaacaaccagtagcctactgttgaccagaagccttactaataacaataagcagttgataacacatattttgtgtgttatatgtagtatatactgcattcttacaataaagtaagctagacaaaagaaaatgttatttagaaaatcataaagaaaatacattgacttcattaggtggaaattaatcatcataacagtttcatccttgtcaacttcacattcagtaggctgaggaagagaaggaagaggaggggctgatcttgctgtctcatgggtggcagaggcagaagaaactctatgtataagtggacctgtacagttcaatcctgtattgttcaagactcaagtgtgtgtgtgtgtgtgtttgtgtgtgtaagagagagcattttatatatatatatatttgcaattgaatgaaaattttcaagaaaattaatgaatcttactattcaaatattcatattttctattctatttcatatcagttctagactatttaggaaatgagtaggcctctcaattcatttttaggccccattaatgagctataatactgtttaaataacactgttatgggtgttggaaatatatgcgctatcatcaaaggattttgattacaggagacatagtttagagtgttacttcaactgggtcactctgatagcagtcattagctgtctgaagatgattttgagtcatttgccaagctcaggcaaaagagaaaaggggagacaaaatcaagtctacttagatgccacaaaaaataaattgaataacttagagtctccactaaaattataattctttattagaagaatgttaaagaaatgatccgaggaccactattcttgaatatccttaaaagtgcaatacaaagccagttagattagcagggttactgacatacccgcctgaaggaaaggaaacaaacaggcgaccactggtgccctccagctctagatttatttccctggtcactgactatctgaaaactaattttggttgcctgagaataaaaagtcaaaagtacatgagattgctctgaagaggagtctacagaaatgtattagaaacagatgaatagtcatgaccctctttactcaatccactcttacacaaatgtctatgcaactacagaagagaattcagtacctatttatcaataaaagaatatgagaatgtttctgcaggctcctaaaaaaaacctttcctatgaacagaagataatggggttattatagacaaggcaacagcgccttctgaaatattgcaaactaattaagaataattattaataacatttttggtggtattgtcttatgcttgactaatttgtaaatattctggtatatttgaactttcactattttagcctgtaccctattttttagcacagattttaattagaaaaatagaagtaataacaagggaaatcacatgttaactaatgaactgagcctaacaacaaaaaagacacagggaggcccttgaaggactctctagcttgatgttcttcttggaatctagggcagggcaaaagtcctaacatcactctatggacaacagagatgaaccacatgagccaggtgctagaactgtgatatttatctctgtttccctgtgtgtaccaccaccccacaactccaaaaaagaaaaaaattataaacacatccactaaaattggcaattctagagaaactggatggcctgttaacatctggctttcccaaaactcaatttttctgtaactcattcattttttagcctttgattctgaagaaattacttgcctcctggccagccacagaggctgacgcctgcaatcccagcactttatggggcaaggcaggtggataacctgaggtcaggagttcgagaccagcctaataaatatagtgaaaccccgtctctactaaaaatacaaaaattagccaggcgtggtagtgggcgcctgtagtcccagccacttgggaggctgagacaggagaattgcttgaacttgggaggtggaggttacagtgagctgagattgtgccactgcactccagcctgggcaacagagggagactccgtctcaaaaaaataaataaataaaaataaatgaaattacttgcctccttccaggcttgctatagataaataaacatatacgcgcaatctatatttctccattacactgcaatcatttccttgtcactagaattgtatcttgtagtccaagaggtaagtaatcggaactgtcaggacaaactcttgggactgtaaatgtgctatctggagcataactatcctaagaataaaatccaaaagcaaaaactcatcagaaaagatttgaaactcatttcagacaagatgcagactataaacaaataaatacacaatatgaaagcaacttaagtctcatgatggaaagattttgatccaactgattattattgttcctagttcaaaatattttaggccttatcaatggcaatgcataacaggaatgactaaggttagcttttcagtgaatcatcagagtagtgattaaactgatgacatacaagactcctaactggattttgaagattgagtacagtatccaaaactagcactggaacaagacaacaacgttcattcagcccacaagaaaaccagtttaaaactctgaaacaatgacaccatgagtatatttgtgataattatttgccatgccaattatattaaatcatgaggaggtagtacacatctacatgcataacgagcccatttttatgttagcatatctccaaggactttcctgctgtgtattttatactgctactgccttatattttatgttagcattaatgttttaattttcatatacatatccttaggccattttacgaagggcgtggctttaaaaattcagttgatatattaaattaatgttaaaaaaaggtcatgtaacaagtagtcctaaatcagttctttgtgttccctctgtacattcaaaccttctaatatggtttatttattatgggtaatacagaagtaagatctgggctctaaactctgaccatctgtcaggttaacatgcatatgcactaagtgtctttcttcagatgatggatcctaccacaagtcctccctaaaacaatatatcaatccccttccccacaaaaataaaaaaaattgatttatatcaaaataaatacataaaatagagcttctctctaaattggccttctgattagaatactacttcatcacctcagaaaacctgtcttaatattatacaggtagaataatttaccaaggtgtaaagaattttttaaaaaatacaaaaaagagacaaaatagtgtagtgattaggaataaaagttctagaacaagacgatctctatcagacccagttcggccattgactgtcttgtgagtctggtccagttatttcaccttttagagctttagttttctcaattcaaataagagtattcaccacaaggtttatttaaaaaaataaaagatccatgtaaagcatttgtatcaaattcaacatatttattaatattactattgttactaatacacagatgacttcaaaagctgctattaaaaaccaagtaaggatgtgggtggcatgctgtattttagattcagattcaacagccactatactagttacattcatatgacattcatatcacattaacgtcatagcacagcacagcaattaagaataagggtctgtctggttttaaaccttagttctatcacttattagctgtatttaattcagtaatcttcttaacagttctataaaacagataatagtattacataccttataatgttgttggaaggattaaataaattactatatgtcaagctcttagaaaaaaaaatttgctgttgtaattatggattttatttcagaacggaaaatgtccaaatatttaaaaagccagaagaacaacagaaccagtcttgtagtcactgaagtaatgataatttaaaaaatcataataataaccattaaaacagtaacatgctatacttagctcaagcgtagcatgctatcatttgcctacaatttcactatattacccacatgacctctcaacaagcctgtaatgtgggtaggctatagattattgccttcaaattatatttcatgaacttgaggttcagaaatcagtgacttgctaagccacataatagtaggtgttcgagccagtgctagcatctaagcatgggcctcatgatccaatgccctttccacttcactccttcacaatggccgaagaaccaaattcaaggcaaggccatccaacaggccatcctgataagaacccctcctgaaataagacaacacggtcacacaaatcaagtgcacatgctttctaactcaatggttataaagaagttataggtaacaactgatacatctgcacaaaccataaggccattaacacaaagatgcattttaaagctaaccagttccagcagattatattcatgtaaagagaatttggttttcctttccttctgacacttcattttccctttgtctcccaaatctgttaataactatttttaggcagatggagcatttcatgaatgggtcactcttaaaaatctcatttggtttccaatttttcttcaagcattaagacttactacttttagattttttggttattatacacaaaagaatatatgtggatagaatatacacacatttatgcaaatatatatatatatatagcatgcatatatatgcacatgcatgtctatctatacatatacatttacaacaaagaaaaactgcttaattttatgtataagagattcagagaactagaccaggtaacactcagaatatacacattattaaggagaaagcaaaaaataaaagagaaatcagtaaacacacaaatcttcccattgacaaggttccctttctgagcttcctttcactttacttctgattttcttctcatattatgtgcttcaggtaattctgcacattttcttctcctgaagagaagccatcaccagaagaaaaagccatgaggtctttttagagagaagaaattcacaaatactgttaggcagggaggcagtcaacaagcacttactgaatccctagccccctaagcactgtactaggtgcttagaactgagtccctcctgctattcagttagaaggatggaaaagctatgacttctagtattagcactgacctagttaagccatgaataaagaattaaaaggttttcatcttccaccatacaagttaagaaaacaaaaccagaaaccttgatatatgtttttcagcccaatgcattatggtttcacatatgtttcagctcttattgaaattttttagctcaatttcttttggtctagaaagttaaaaaatgtccaagtcaacaactcagtaagaaatttagaaagtttccaaacaactcagttttggaaactttttagttcagcatttcccaaactctttgctattgacattttaggctagaaaattctttcttggaaggagcaggggcctttcctgtgaattttagagtgtttaatggcatgcctggcctcgactcattagatgcctgttatcacctctccaaccgagtggtgacaaccaaaaatgtcttcagacattgtcaaatataccctgggagcaacataattcctgagtgaaaactatctaggccaaaacttcacctaacacataactctattagatggatagcatgaaaggatggcatataaaggtctggaaatagaatgacattaaacttaaaataatcagcctttttcctaaaggtatttttattcaccttgtacataacattgagaaaacatcacttgtccaatatcaaaaattggggaccttaaagcaatacacccctggtcttcccaaatcactgctctggcttgctttagtttgtaacattaaggctctgtttcctagaaagtccagagctaagacatacaggttgctttcagttcttcagaggcaaggaaactaagaaaggtggtaatcataagaacaccacacataaaaagaaagggaagagtaaaccgagtttctgttcttaaaagaaacagtgggaaaaaagagaagacatacattatcatttcaaagcaatttatcttaacaataattgggcaaaagacattgtttttagttgtgttcttgcagaagtaatgtcaaatttacttgaaagttagagttttagaaaattttagatgcagggagtacatgtgcttgttacatggatattacttgtgtaatagcggggattgggtttcttgtgcacccatcacccaaatgttgaacattatacccaataggtaatttttcaactctcattcccctcccaccatcctcccttttggagtttccagtgtctgtcatctccagaaaatcagataacttaaaaggtttcatgcacgttaaatagttaatagttgttttattacaccaaaggaaaaatgaaaaactgtttttcccaaaacagcataaatgtttattttctgtatgtttactttgctgtcccatttctataatatagaaaagtatattatttgaatagctaaatgtatttatcataaatatattacttttatataaatatagtaaatatatcttttactttgggatgtaaacagagctaaaatattatattctcaaaagccccaaaatagtccttaaaaatcattgaattaatgtggttatttaatcttgctcagcaatttgatgcaaacgcctaaatacaaaaagtggtttagtaggtactacaaaggaaggaagaaggaaggaaaagacttaatactctagaatgtttcctgaaaatcagaaaacaagtagcattcaattgtagctaaactaactaactaactctctctctctctctctctctctctctctctctctcctcctctccctccctccctccctctctgtcacacacaaaaacacacaccacaaccctgattaaatacctgttggaagaaaggaaggaagcatatgaggcagcatggaagagagaaagagagtgacaacctcaagagacatcattgacttgagttctagtcctatgatggatttcagaaagtggtcataatctctttaggcctcagtttctcatatgtaaaatttgagggtttactagaagatacatgtattctcttcaatttaaacagtccctgattcatagtgtgtttcagattagggtagtaggaggaagattctgagtttcagaatctaagaaaaattaaatgatctaagttacattctaaaatcgatatgagctgcaattctgagaacaacttggccagctagcccgaatatttttggcaatgccagcaacagattggctggatggcactgcacaagagaatctttttaacacagtctgctcaatctggtctatccaatgttctgcttgggataactttaaatttgggttgacttagaacttgtccttggtatctcactggctgttaagaggacagtccatgataaatgtcttcttcattaaaagtcaattcttgccaactttttcatgctactttttttctacaataccacatataatttgagacatactgcccacaaaacagaacctacagaaggttggaaacaatattctattctctctttcagagacatgtaacattaaacagggttcaaagggaatgcattagaagtttacagaggaatttggattacaaatggttcacaggaacagtaagtacttttttttggcttaccagctagaagtgggacataaggtaaacaagctatgagtagatttctatagaggtaaaacacctcatgttacatatcaccacacccctgctgtataatacataccataaagtattattacaagatttaaatatttacatcaaggtttgccaatgaaaagagctttgagaaccatgttagcttgtagctgccaaagacacaagtaacagcagtagttgaaatcaggcagtagtctggggaaaatggggaatccaagaacaaagccatgtatgaatttctccctgtcttccatttcaaagtgctctttgtaaagagaaatacctaacaatgcttgagaacagtttatatttataattgtaataaaaaagaaaatactgaagactgtatttttaggtgtcttagttcaaaggagcaaaacactttgtcatcctaatcagaaaagacatttaagataacaactggagaaaagtagctttagaaataagtaggaaacatgtcctaagatattttaataatgtcaagcagctatttgcacaaaaatatggagctgctccacatttcactacatcttccagggagacggtagtagatatgagtaggtaaacatccctaacctgtctagtcacatcagcatattagccacagagaaacaagatacataaattctgggaccacctaaagtgatttgttgatcagctctgtgcataattactgcttttgtttaattacttttaattacctgtttttcttttgtccttatgccctgaggtgagtttttcatcagtaatgggcatgattttatgaatatcacatgcaaacaagcaaattagacccactgaacttgggaaaccatttttccccatcccttctctaaaggttagctgctattttctgaaaatgatattgattctatggtaacatgcacaaaggcactaatcaggagaacaggagcttttgtgaattcagtaaagcttataaaatacctcattataacatgctaccaatctatgaccccaataatagcagtcccaaaattataaataaattagatgtttaaattgttacccttttttatactacatagtgtaacacacattataatttccagaagagctcttaaagaaaaaaaatgtggagaatgaaaattgaaaagcagcagctgcttaggagtgcttaacctagagctagacgtccaggcagatcgaaactgcctgctgctcctccttcccttttcctatactgcctacaaataatcggtttgatttttcataccacgattttgattaagcactgtgtcattatttctgggtaataaacagtttttattattttcagtttaaagcaattattgccaaaaggaatttttaattttaatattaatttatttagagacaggctctcactctgttgtccaggctggctggagtgcagtggttcaatcagacctcactgtagccttgaactcctgggctcaagcaatcctcctgcctcagcctcctgagtagctaagaatacagggcggtgcccccacatctggctaatttaaaaaaaaaaatttgtagagacacggtcttgctgtgctgcccaggctggtcttgaactcctgacttcaaggaattctcctgcctcagcctcccaaagttctgggattacaggggtgagccactgtgccaggctcaatttttgtttttaatgataatagctaattctgatgagaatccttgaagcaaaactctcacaccttgctagtgttccagcatgtataatcccctgttatagcctgaatgtgtcccccagaatatgtgtgttggatacttaatccccagtgtaacagtgttgggagatggtgtctaatgggaggtgtttagataatgagagctctaccctcaaaaatggattaacactgcaatataaagagctttggggagaagggttctgcccctctgctcttctgccttatgaggaaaaggattccttccctctgggggatacagcactcgaggccccatcctaaagcagagaccaaacccttaccatcagacaccagatgctggagctttggtcttgaacttcccagcctctagacccatgaggaaaataattctattctttataaactacctggttttaggtattctgttatagcagcaaaaatggactagagacatctccttttaaaagtcttgcatgcactgataattgttgatgtggtaaattgaattaaataaaagaatctaaaatgactgtcttaatttttttaaaaacagttttccattgacaggtgttcaaaacagcattatttttaacttttgggtttgtgtagtaaattaattaggggttttcttttatatttgtgttttccaatttttctttaaggaggatttagtatttataattacaataatttttagaaaaacattctcatttaaccatgaaaagagttttaaggtattcacaataacgtattagagctcagtagctttaacacatttctttctacaggtacatgacataagtgcatgatgatatttactaaaggatagaaagagaagtcttaactatcttgaaaacatgaaacaatttaatggtgagtttaaaaaaaacctatgtattgcaattaattgacaaataaaatattgagacatgggctttaggttcctctgaggcaaaaaaaaaataccctgtttattaattttttgtccccttctccttgctgttgtagaatatatgaacatggtcttataataggttcagaaccatggatagcagatccatgcttttaggtagatgcggcattatcttaagagacaaagtatctgctgatcttcagtctgctttgtagtggcctcgttatgagggcaaatcagttaccttctctgggcctcctttgcctcactggtaaagcaattcattgccttgcctttccaataggggaaaattagactaaataaattttggccatttacagctgaggactaggacttttttttaatcgttctgatacacaaataaatatgctctgacattattccacggatgagttttactttttttgtttacttgaatgagaataatggataagaaaaacattttcaataaggttaatttatcaatatatctacttccctattgtcttcagtccatagttctagtaatgagcgcaccacaaaattgataattccatcagattatcatggaaaacgagcattgttgtatgaacgtttttgtgactactgcaaaggtcaggaacaggtctgctttgaaaacttcagataaagatagtttttaaaaagttccttaacacacagtcctaggagtacgctattaatttttcaacttaaaaaactaaggtttccatatcttttttggtagcttcaagggaaaggaaaaaaaaaatgccttcacattcctaattattttgaaatatttttcattggttactacttcttaaaaattcattatccttttttttttttttacttttagattttatcaaaaccatatagctatttcctctctgattgacaaataaagccactatcggtttggcacaaaatctagaatatggtagactctcaataaatgttagatcctctttttcttctctcctattctttcctatttctataaggtacatttcataagattttacatgtggcattcatcttctagatcaaaaaatgtatcatttaatggaaaagaataaagtttaaaatcctagattagtgtctgcgggtgttggtaaagctgaatggctcccacgttttggataatctcattcaatttttcttccatatttttccttgaatttgccactttctttctttcaaaagccaaggctctcaatatgtttggattctctgttaagttatgctgtttattcaatggaggcatgaattcaaatttgtccacataaatttgacctcctaatgctacacgttgttattggatttctgttgtttctcttttaagtggccctggttgtcttaaaacctgctcattccttcttcgagctgtcgccatcctctacaatgctggaaattcacaatcatgaatattatacagggagatacaataaaaatctatgtctttataatagagtcaacaggtataaaaagaaagttatttcaaataaaaagtttaatattctacatttcataattattgggaagctttgagagtcgatcccaggaatgctcttatcacattattcattgtggagaaaaagttcagtaaagtaaatatagtaattagagctcatgcaagaccatcagatggtaaaatatctaaattatctcactagaaggctgtttatagcaagggaaactaaaatatcattctaacaatgtatacataccatagagagaatgatattgagtctaaacctccaattaagtataggcattaaggatgcacatcattagaaatatgctgtgacttttgtttcagccaattatagaaggaagttagagctaagaatttcttgaaaggtgattttagatgtgagtgaagaggaaaagacaggaaataaagctatcatttattttttgtcttaggacaacactgaatatttgtcagaagcatctgctccttaaataacacaattgaataaaaattggcatctgaggtttgaaagttaatttcaaaggtttattataccacagggttcatatttagcagctgtcaatttgttatcgacaagtgtaataaaattcagcaaaacttgaaatcttcccttgccaaagagacagctgtttctgaatgttggagatttggggagtttttttttaaaccaacctctatttgaaaaagaccttacttttatttatcaaaaaagtcatttgatgataaaatattgatattctttaactgtgtttgtaaaaaaaatatatatttttaaatgtgggattttgttgttcttgctgattcaatatttgtagacagtgtttcaacctgggtaatgtggaccctccatgggatatctggcaatatctaaaagtgtttctgtttgtcacaactagatactattggcatctagtgtgcaaagaccagggatgctgctaaacattcaataaaatgcaggacagctcccacaacaaaggattatttggctcaacatgtaaattgtaacaaccttgagaaaatttgttttaaggaaactgatacaatggatttagattaaagattagtttgcatttacagactttctaaaccatggttttcacctggtggggagctgcaggcaggcaccggttgtgctttaagtaagtgttatttgaacaacagagtaaaactccttagctcgaaattatagcaagtacattcgcactgatgtaattaagtttgtgtcagttacactgaatatatttctatgtacaacattttgtaactgtgctataaaaataaatctgtaaaaagttcgacaggaagtttctttaggtagtaattgttttctacagatgcattagctaatattctacacagactccataattcatattaaacaaaaaacttgaatattgttttagtcctaccttttaccccattattttctcaacttgacaatactaataagcaaatctatattttcaaacaatatctctagatcacacattccttaaataattattttaagtatgctacataaccaaaacagacattttcagggccgaaataaggaccagggatccacattttgttgaatgtctactcagtcattgagaaaagtactttttatttaatatcaatttacttcaataaaaatgtcacctaacatgtaaaaatacttaaagagagagtactatttaacccatgaaaaataaaagaacagaatgagacagctgcaaaatcaaatgtatttaggtgttttagctaaaagtatacattattccaataaaattaccttttgcaaataatattactaagaagaaatttaaagaaaacatactccactatcataatggtgattttcatttaaattagaaacacatttcaaaattcatgaccttggaaactctcatttcatttgagcctccagagtagtgtgctgtctctctctgtctctctgtctctctcaatcttttaatttaacaaatacttatatagcatttacaatatacttgataattgtagaaatattttacaagtattaactcctgatgaccctataatgtaggcacacatattatcgacattttgctaacagtggaaccgagtcatgcagggattaagtaattggccaaggtcccatagctagtaagtgacagaggtaggatttgaattaaggaagtctggttccaaaagccttcctctttagcgccacgtaggtggcctcccctcttcattacatagtattacaccttttatttatctcaaacttgcccaggtagtgtgaccttggaggagacatatgtgaaaggtttcaagtcaagtcaaagcctgtgggaaagtgatggggagaatgagagaaactgaatgatctcaccagctaatccatccatggagatgctttgttcagaaatctcttagaattagaagtacaaacatagttagatctgagttgaatgcatctgatctataacttccatttgtttatggcacacattttatatcactgacaatttcttttttctctacaaggagaggcagtatagaatggtgtttaagagcacaaactcaggagttaaatctcctgggttccgtttccagatttaacttgctattaccatatttgtattgtatctcttgaatggtgaacagagaaaatatgatgtagtcaagaagttctctccttcctgagcacactgtcagattacacttccccacttcttcctaagtggggccatgtcattagttttcaccaataatgtaagagtagaaataaatgcatgatacctgaagcctcagatgcattgagagccagtgtactttgtctttgctcttgttcctgccttgtctagcatctggatgcagaagatctggatgcagtgaaagactcaaaggcctaaatgatggtggagtcacaatatgggaggagtctgcatccttgaatcatcacagggattaaagcctccaccctgatactgaactatatttgactgtacaataaacatttataataactcactgaaattttgcattatttcttacaacaactagcttttattatactactatgactgcacatcattcatgtgagcaaaatggtcactcttttaaacttcaaattaccttggtttaaaatagttttactcagtgtgtgttcctcttcaaaagagctttgataagcctcattacctataaatatttttctgtatagttccaaatgttaaaataacttagtagagatgcagatatttatagcagttaaatactgatttataaaaccacacaatactagtacaattgatggaaaaactcataaactaagtaaaatatattgaaactatctgccagaaaacctgcattttccatgatttgaatgggccacttcaatgaacagaacaaataaaatggctcttgtggccataactctcacaaagaaaattatttctgataacaataccatccttttctgtaaatgtatactacgctcaactaacaagggaatctttactttgctacatcattaccaaattggtaaataaatctaagtcttcatgtcaacatttcaagaagggctccctaaagcttgtaaattgtcaaagatatcagattttaaaggatatgaacctcttaaaaagtacttggatgaaatgttatgttcagaatctcaaatatgaattcattgtgttcttgtcagaagttacatcatcagggtcctgagctggtgctggttcagtcccaaggaaaagaggaaacttgtgtattactcagccctggcagatgagtagattcttctataaccttttcatcaccaaatgtctcaacgaatttaaaaactaaagattatttcttgatttggccaggttccttgtaatcttgacagtaagaagctcagaaaaatttcctttgctgtgcatcatgtatgctttactcaaaggccgaaaagacatagaatgcttcttctgaactttcatttaaccagcggaatttgtgagggtataatattcatatattttattgaggagatataagcaatatctcttaacatgtagtttttaattgactattaagatacacaatcttttaaaaatttcaaaatgactcaacccaaattatttagaatatgatttatttcaaaacatttttaaaattccttccttccacaattgtttattttgtctatccagttttgtaataaatgctatatatataaagatggttcctggcattaaacaacatctgcaaaacagtgagcaagaacaagatatttctagaggtaagtaaggtccactaaaacaacataaaatcatagttaataacatcataaagtcaatggctgattctatgttttaaaatcagacaaacaaaccaataaagatcacacctaaaacatgtgcaactgtatagcataaaggagttcagaatgagactcaaccaaattattgcgatcatgaatattacacatcctgagaaacaggaactgtcatagcagtcttgaccacatgttcacatactcaagttggataaaaggaaaagtccaaaatcttggcacaccaaggtaaaaaggtggatatatatttaattaacatttaaaacaaattttcccatttctccacaaagagctcattttttaaatcttaaggtttagtgaagaagagatttcaagcccactgcaaaatgaataacattcttttattatgctgttgatctccaaatatgcaaatgcctttttctttaaaaaaaatagtggtagtttgaaatcaggtagcatgatgcctccagctttgttctttttgtttagggttgtcttggctataaggagctcttttttggatccatataaaatttaaagcagagtttttttctaattctgtgaagaaagtcaatggtagcttcatggggatggcattgaatctatacattaccttgggcagtatggccattttcgcaatattgattcttcttatccatgagcatggttccatttgtgtcctctcttatttccttgagcagtggtttgtagttttccttgaagaggtccttcacatcccttgtaagttggattcctaggtattttattctctttgtggcaattgtgaatgggagttcactcatgatttggcactttgtttgtctattgctggtgtattagaatgcttgtgatttttgcacattgattttgtatcctgagactttgctgaagttgcttattaaggagattttgagctgagatgatggggttttctaaatatacaaacatgtcatctgcaaacagagaaaatttgacttcctctcttcctatttgaataccctatgtttctttctcttgcctgactgccctggccagaagttccaacactatattgaataagagtacaaggctacagtaacaaaaccagcttgatactgataccaaaacagatatatagaccaatggaacagaatggaggcctcagaaataacaccgcacatctacaaccatttgatctttgacaaacctgacaaaaacaagcaacggggaaaggattccctatttagtaaatggtgttgggaaaactggctagccatatgcagaaaactgaaactggatcccttccttataccttatacaaaaattaactcaagatggattaaagactgaaatgtaagacctaaaaccataaaaaccctacaagaaaacctaggcaacaccattcaggacataagcatgggcaaaaacttcataactaaaacactaaaagcaatggcaacaaatgccaaaattgacaaatgggatctaattaaactaaacagcttctgcatagcaaaataaactatcattagagtgaataggtaacctacagaatgggagaaaatttttgcaagctatccagctgacaaatagctaatatccagaatctacaaggaacttaaacaaatttacaagaaaaaaaaaacatcaaaaagtggatgaagaatatgaacagacacttctcaaaagaaggtatttatgtggccaacaaacatattttaaaaagctcatcatcactggtcattagaaaaatgcaaatcaacaccacaatgagataccatctcatgccagtcagaacagagatcattgaaaagtcagcaaacaacagatgctggagaggatgtggagaaataggatcgctcttaaactgtttttgggagtgtaaattagttcaaccattgtggaagacagtgtggcgattcctcaaggatctagagccagaaatatcatttgacccagcaatcccattactgggtatatacccaaaggattataaatcattctactataaagacacatgcacacgtatgtttattgcagcactgttcacaatagcaaagacttggaaccaacccaaatgatcatcaatgatagagtggataaagaaaatgtggcacatatacacaatggaatactatgaagtcataaaaagaattacttcatgtcctttccagggacatggatggagctggaaaccatcattctcaggaaactaacacagggacagaaaaccaaacactccgtgttctcactcataagtgggagttgaacaatgagaacacatggacacagggaggggaatatcacacacctgagcctgctgggggttggggggtaggggagggatagcattaggaaaaatacctaatgtagatgacaggttaatgggtgcagcaaaccaccatggcacacgtatacttatgtaacaaacctgcatgttctgcacatgtatccaagaacttaaagtataataattaaaaaagtggtaaaataaaatgaaaatcaaagtatttcttagctagtatatttcatattatgtgtaaggccatagcaaaataaatcagtatatcttggtggcaaatgatcaattgacaaagccttctagaatgagtcatctcaaaactggtaagaaggaagtcactcagtataagcagaaagggaatatggatttgacagagtattcaaactacaccgaagcttaaacaccactttactgttcattttatatacaatagatctgaactctaagaggcctgcaatcatttaaagttattgaattagtttatcaatagattttaagcattaatttggttgagtctcattctgaactccttcatgctatacagtttgcacatggatgatactcagatgaagtattctgattgacttttctacatttcacaaatcaaactcaaacaatatacaatcatcttgaatgaagtggtatgagattagtagcaaaaggctgaaagaatcagaaatgagttctaatactatgtcattgataaacaatggacattttaacttcaggatactaattttgaaaatggagacactacattctgttcaactattgggactataaagaaactagagtaagatcatgaaaatggtaaatatcataagttattatctccaattatcacaggaaagtttgcaattaaataccattttccttaaaagagtaagaatatatttcaactatgaaaagtttttttctatatatgtatttttttcttaaagtggaggtacaattacactacataaattagttgagaatgccacaccaaatattgtatatgcttttctcagggatgcataaaagtttattcttgggtgtgttctaacttcaaagagaattttgtctgaaatatatgggacatttttacatctcaagcatataggcaatcatcataaaaaagttatttagtttctagtattaactaaggctttatttgatagcttaatgatctttaaaataaaaacaaaacattgccattttctgttgatttagcctctcttctatgaaagtctccaagccccattatcacaccttctaactttttttttcttttttttttttttttgagacagagtttcactcttgttgcctaggctggagtgcaatggcgtgatcttggctcatggcaacctccacctcccaagttcaagcgattctcctgcctcagccttctgagtagctgggattacaggcatgcgccaccatggccggctaattttgtatttttagtagagacggggttttttccatgttggtcaggctggtctcaaactcccgactgcaggtgatccacctgccttggcctcacaaagtgctgggattacaggcatgagccaccacacccggcctacacctcctaacattttaaagtgttaacacaattcttttatttacaaaccttttattttgaaatacagaatcacagaaagttgtgaaaatgtaccagaaattcttgtgtgtccttcactcagtttctttctttgagacggagtctcactctgtggcccaggctggagtgcactggcgtgatctcagctcactataacctccgcctcccaggttcaagcttttctcctacctcagcctcctaggtagctgggattacaggcacatgccatcatgctcagctaattgttttttgttttttttttttttagtagagacggggtttcactatgttggccaggctgatctctaactcctgacctcaaatgatccacctgcctcagcctcccaaagttttgggaacacaggtgtgagccaccatgaccggcaatttcttacaatgataatatcctgtctagctatagtacaatatctaaattaggaaattgactttggtctagagattattccgacttcactggttttatatgtactcatttgtgtgtttgtatagttataggtagttttatcatatgtgtagatatatgtggccaccaccacagttaaaatacagaactgattccatcatcataaggatccctcttgctacctctctttggcttacacaacccctctccccactccatccttgagacttgtcaaatcaataatctattctccatctctataattttgccatttcaagaatgtcttctaactggaatcatatttatgtaacttcttctgttggactttttcattcagcatagttcccctgagatccatctaagttgttgtgtgtatcaatagtttattcctttttattgttgcatagtattccatggcataccatgtaatatgttatacactgtgcataacacattttaatacatgtattaacttaatacagtgttattaactctggaaacaaatttttgtttgtgtttcttcaaacatacagcttctaaaactgaaaatattggctaggaagacatatctaaattataaagaaccaattgttcatatgctatataaaaatgtttggagtaagagggcatactttcataaagtttttttttaagtcctaaaaagaggattttatctaaaatagaatgcagcttctaagttctaaaaatattatatatcctattgagtagctcagtttgtagctggaagaattgtgcctgtatcccagaaggtcttataaataatttattcaatttcagtatttaatttaattcatttacaaatgagatgaggttagattattcagtgtaataagaaatctgttagagaaaatagtatttttcatagttgattattatagtatcattttctttaaagcatgaaatgcatcttttaaaatattgattagagactataatgtaactttgctgtaattacaatacttgtcttccagatacgtcctgaaaatagttggattaaacaaattagtgaacatccattcaataaaatactatgtagcaatttataatgatgataaagatatacaatttaatgacatggggatatattccttagatgttagtaatttgcatagcaggttacaaaatagtttacataatataattatatttttgtaaaatgatacctatatatccacacaggcatacaaatcggaagaatatatacttttttttggggggggcggtgggggacagagtcctgccctgtcacccaggctagagtgtagtggtgcaatctctgctcactgcaacctcctcctcccaggttcaaatgattcttgtgcctcagcctcctgagtagctgggattacagacatgcaccaccactcccggctaatttttttgtattttttagtagagacaaggtttcgccatgttggccagactggtctcaaaatcttggcctcaagtcatccgctcccatcggcaggctgggattagaggtgctgggattacaggcgtgagccacccgccccacaggaagaatacgtaataattgtgtagtaaaatacatatttttaaaggggcattctgggctactgttgtgtatattactctttaaaccctttaaaatagtcttgaactcaatctgacaagattactgttctcatgtaagaacaatattttccttttactacagggtcaatattcttgcacaatagtattgcattcctttacttattcagctgtacctaattagttaacaagttcactttaattattttcataaaaataattccatttttgatgatccttccatatcctcatcatcaataaaagcagcagtcacatagcactgattaaagaaattacttcaaaattaaaactacaaaaataaaggcttcaatatcatagtttctctaaatgtatcaaattcagctgttaaatatatttagagcctacgagtgttctggtattgtcccactcacatcttatgatttctttttcctttactttttaccaaacaaagctgctgtgttatcatttaggcatttataatttattcctgcttcttattttacaacaactttcagtgatatttataaactgtggcatattagtgattgatattatgtataaccttgggtagacttctggcagggcttctcttctgctctctctcctgtcactactggcagcatatacaaattgttaaattgccctgagtaaagctttattgtgccactaatatctaattttcttttgaattaaaaactacctttcatatattaagcatcaggattagtacttcaaagatacccattataaaatttctcaattaataagatactcatagaaaaatggggtcaattattggcataattatattcttttaatattttatatccattaccattctgtggtcacaaaactatctcaaggacatactgtcttttaatttggaaaaaaaaaagttgagcaatttgaaagtggttgtatgaactacttacagaaaacaaacgtgaatcctacactgttgataatgactattacactactattactccttacagtaacagctaatgcttgtgtagtagtaattaccatcaattaccatctatctgttatgtaatttaactccttttgtcttaactacaaccctatgagttaagtgacttgcccaccaatttactggcttaccctttggtcatcagataggggaactacaactcagacccaggtggtctggttctgattacataatggtaaaatggttattacagaaatttatctgaatatggactactttgtgactaatattcacttgaattttgtgtccccaatgcttccttcatattcaatcttacccgtgcctatactaatcatcaacagtttagcttgagagctgcagcagttgactagttttccaacagctaaacagaagattctggctatttatatgagcattctcttaatgctttactatattatgaactgaccctaagggctaaatattatttacaaatccaagaatacaaattcataaattctagctatttttatgccaacgtggactgccaatttgctttgaattatattaaaagttcaaaaactttaaagttctttacccccccgattccccaacttcaaaacgtattagctgttacaattcatacatggactagcattctaaagatgtgacagttccctttgaaagataatgtttggaagtctcaagacttgaattccagtgtcatctttgctctatgatgctggataagttacttaaactctctgggttttatttaattcctctggaaatttaaacataatttttatgagaatggacttttctaagatatttttacaagaatctaagatgaattagagattcacttaatgatgactgtctgaaggaacatgcatgaactggtctaatttaaagagatttctttgagtgatctgtcatttttctctcctctttgttcaaattaaagaacaacaacagataacgttaagtatttttatacttcctaaaaacaactttaactgacagagtgaaaggtataaaacttcaccctgtaataaatttgaggccatctttagacagaacaaaattaatacggccctgtagatgaaagatttacacagatcgattttctgtgcccattgacagagcaactggataatctgtggtagtcttttacacttgagcagttaaaacctcagatatatcctggactgaagattggtcagcagttcttttctggtccatgaataattaaaatcattcttattctgtattctataaatatgcagagaatgcaagatttgaaccatatacattccgctggagaagctgcttgggtccaagcgaacctcatcagcgatcacttcaaagatcaattcttcatgtccacagcatcatgtttaaatgattgtgtgtgatccagctgcttcttgtctccttgttgcttcatgcatgatctttactcatgatctcacaaactatagtgcttcagtagtaattctgcattttgtgctaaattttaacagtgattgccattttataggctaataggctgttgttgtgcatatttattataacacttttttcttttcctatcaataacagtgctttgcttagataatgagaagcaataatctctttaaaatatttacaagtctattcatcatgggaaaaaataatcttacaaagacagccttctccactggcattgcttttgattgtcactctcctccctcttcccaagacaggcatttccataattgcatcttatctttttgtatagactgagaaactggcaataactatgcctgggcaactgttttttgaggaaacacacaaatactacctgataatgtgattatatgcaatgatctaacttgctcttacttttaggactattaataatattaatgattttaaaatataatattatcatagtttcttattctgattgtagagtgagaagaaagaaatgtaaaggtagaatataataatagtaatattgtctgtacttaattccttggatggcctttcttttttggtttgttttattttttattttttaattttattttaagttctggggtacatgcacaggatgtgcaggtttgttacatatgtaaacgtgtgccatggtgatttgctgcacctatcaacctatcaactaggtattaggcccaacatgcataaactatttttcctgatggtctccctacccctgaccacccccacaggtctcagggtgtgttgttccactccctatgtccatctgctgtcattgttcagctcccacttataagtgcatgttcttagatatactctcttactaatctgtgtagggtagattcactccctgaagtcactcatggggttctaatttctatagctgagaaatgccttttagatgcccttgttctatcatacaaaaacactgttacttattagaattccagaaaagtttcctaaacaccatcaaaaattgtatggcaaagaacatgtttgtacctcatcaaattttatttatgttttgattatctaatgtgctagtcatgtttgtgactttccacacgaaatgatttcccatgttttctttctaccatgcaccatccttatcattaaggaacacaaatacatttaatatcaatgcaatcagtgtagaagtgaggcaatatgacacagtataaaacaggcagatatacagttatatatttatcaacatgtcccatagataacatatatctatattccttcaactaaaaagatttgtttaatattgccatttattatcccatatttctattttaaaatgttttgcagccataaaaacaaatgagatcatgtcttttgcaggaatatggatggagctagaggccatttttctcagcaaactaatgcaggaacagaaaaccaaatactgcatgttctcacttattagtgggagctaaatgatgagaacttacgaacacaaagaaggaaacaacagacactgagatctatttgagggtggagggtgggaggaaggagtggagaaaaaagacaactgtcgggtactgggcttaacagcttggtgattaaatgatctgtccaagaaacccccatggcttgagcttacctatgtaacaaatcttcacatgtacccccaaacctaaaataaaagtttaaaaatatatcaaatgttgggataatatggacagagtctcctagcaaactttttttcagaaaattatagtccactttttgatgacggtgatttcaaaggaaactatacttgagttcagctgccaaatctttgtttttttttagatgcataacagttcaagtaccattctctcttattttgtcacctgggaaagaggtcaaaagcacagtgggacactttacggggaacctgagagtctaagaaccattcttacatgccattagcatatcaattgatcatgaacatttaaatttggtagttttaggaacttagtttccttttcctaaaatgaagactttggattagtctctgaagcaactttctgctcgaaatgttgatgaatccgaatcaccttttcattcacttgaaatgtaatgacgtttttgatgtctacgttacagagattgaagtaacgcatctttccccttttacactattatattttgtgatgttttgctttaaaaagttttattttttattaatcttcaaatttcatatttttatccttgataacttccttctagagatgaggccagtgataagcagtatcttaattctcttctgtaagtattttttccttttgcatatgttctcccattcagtacagatatcaatttagctatttctttattccagacacaattctcctctgagattttcatcaataaataaagagacatgctaatatcacagctacttgacacctaccaaaaccctcattaactagtggactacaacataagagaatgaacatattttttaaaggccttattgcaagtcaagtcacaaagttaatacttccacatgtatttgccactcttttccttcaacagaaaaagaaattccagttggttgtaaagtcaaatctcttgtcttttcagtttaaccagctgcactctaagtctcaagacaactccctccttattctatgtttaattgactaccttccctatgccattatccatctgcatctttatgaacataatcaaacctccaacccttcagatcatctgtggggcattgctatcaccaaatagcaatttaatgctgagctttatctttcctggggattttataaagccttgaaagaataaagaatctagcagttggcacactcacttgcatgcaaacttagattgttaggaaaagaaaaaaacatttagataattaaataggatcatttaatagttcactcatttcataggatgagtgaggcaccaggggaaaagtggattgtttgagataacacagctagccatgatcccatgtaggagaataagactgctctaatatttcactctagcaccatccctattacatcacacaacttcccacacttccttcgtattttcccatgataaattataccttctgatttttccccaacctctcgaatgcccataatgtaactgaagaaatatagttccttaaaagtagctatggtttctaaaggcaactcaatgatttttaaaatacaatacaaattgttttttaagtgtttgttttgctttccagcttcaagcagaaccatcgatgtgacaaccgaagacaccaaagaagcagtcctttattattcaagatgtcattaaagtgcagggatcctaaaaccccattctagattatcccttagtatggatcaggctaaaatatttgcttcatgtgaggccctaggtcttgaatattgcatggtttcttgtactctgcaaatttcttctgaagaacccccttgggtgagtgactgttgtcagtatttatattaatgaacttttggagcacaggtatatctccaaagaggaaaggcctaattttgtccccagagctacaaaggtgtatggcatggctgacactccccagtagctgcccaaggatagcatggtggcagatgcattatcagaacaaaaagccaagagtgcccagagctgaggacctgatcaagtgaaacaatcagtcctctctgtgctactttgcaaatggttcatatacttttcaattagcacctgtcatctggatgcaccaattttcgcagaaatattttgaaaggacaattttatttcacgttagctggatgaaaataaaaccaaattccttctagtcagaaatatgtttggaaagattgaatccaaaggttcatatatccatcattggctccagatttcattataatgactgcaggtcaaggattcctgcaaagattttttaaaaaaatagtattttagaaatcatattttgaaaccaggtttgcttctgtttagttaactcccagagaaatatactgtttttggaactcccaaccccaccccaccaaaatataatttgcttttaagaatgtaaaaggattatggtttacacaagaaactaaaacaaatataagaagaaagtgcatgtatgccaaagtaatcgctctctctcttactcattctctctttcttatacacacacacacacacacacacacacacacatgcacactgacattaataagtcagtaatgagtatattagtgtctctatttaagttttctggtggaaaccaaactcttaatgctattttaatgaaggatttgtcagtgaattgtttccaagagtggtaagggagcatgcaatcacatttttataatgtttggcatcattttggggtgtaggaacaagcagattaactaactgaatgatacaaaatggtccactcctcttttcttaaaaagacacattgctccctgcaaggctgcatgaaatacaatttattctttttggacaatttcataaaacaaaagtggaaaattcatcctagaaaatcagatatatagaacactacaattttattactatttctggacaaattttcctaacatccttgcagccttctattatgattcacaatgtctgcaatgagagattagatgacagagtaacctattaaggaacagttactatgctgctggatgcagctaataattcctttatttttcatttttattactttatagtttatgaatgtacaatctactcattacctattataaatattttgattcagcaatggaaatatacaccagtaaacaaaacctacttgaagctttatgtattacatacccacccataaatgtatatcatagcatttgctgcctactagacttatttcttgagaatctagatgaactcttaatcttagctgtaataactacctgcaaacttagtatcatctctgctgctttcactgttttatctactgtctggagtcataattaattggcctcattactgtttctactatgaaatacagtcttctaagacattaatattttatcagagatactagtcttgacctaaaacagagaagaataaaaacataattgtgagttggaaatttttttaacaataacataaaataatcgatgttttggcaagaattatgacaaggctgcagatagcgacacacagctcactgagtgtaaatggagagaactaaacaggctctcattggtgtaacccttctaaaactctctagctaacattcatgccaaaacatccaatatatcaaagactttgtagcaatctggaataaaatcatttggtttcctctagactgtttctgcaagaagtaaatataacccagatacaatgaatgaaatgaaattttagtgcactgagttatggttttcaaaagtaagagcaactttagaacactaaatttaaagtcattcctaagaaccttctggaacctatgaaaattgtattaggttggcaaaaccttctctcgtcttcctatttctttttttcatttttcttgttctttttatcagtcaatactaaataagaatgtgctgcccaaaaagtgaagctataaatcgacttctgaaaagcttccctttttctccatgggtctctatttcattaggtcttcttttattttacttctgttgcccactgtttaatttctgaggccagtattttaatatcctttcaagtattgttttcaagatgtattgtgtagcagatcagtaaacaaatagttatttgcctcttactctatccaaggcaccgtactaaatgctatgcagaggtgaaaagtatgcttactgctatgcaataaattacaatctaatgaggagcataaaaaacacaataataataaaatagttcaagtgattttcaaccttggttgaacgacggaatcacacatagagttctaaaaagacttgacactaagaccttacctcaaaatccattaaactagaaactactgttgtcaatgtttaaaaactgaatgatagggacaatagtatggttaggatccagtggaagatgttctaaatgagtactcgttgtaaatagcacatcaagtgtccctcaagggcaaggatccagtggagctttaaatctacgtaacatgagggaaagtaatgcattagtactgttctaaagttattcatggaattctctcttctgatagcttattatcttctgagttcatagtagatattccatatctcaatgaactggttttattaggaaaagaaggtgtactggttatctgttgctgaataataaattaccacaaaactaaatggcttaaaacaaccatacacacgcattatcctcactgtttttaagagttagtaattcaggggtacttaactaagcagttcaagctcatggtctcatgtgattgtcaccaagtttctgaccctggctatagacagccaaaggcttgagtagggctggaacattagcttccaaggtagtgcacttacagagctagcatcacattgttcttagtccattggttttgtatttctccttttccttacctgtatttaaaagttttccttaagttctattttccccactgtgatacctaggactatcaagtctacttttattcaatacattgttactgagtatctctcctaatcaagacattatgccttctgtctttccaagcttgaatacatcacaagttaaagggggaaacacatttgttcacatgcagctactatgcctactgtactgttttaatttaccataatggacaccacaaacaaagggctacagcaaacgaaaggaggaatgattagttacacaggagtggtgtataggaagaattaaaaaagtaagctggggctgggcgcggtggctcacgcctgtaatcccgccacttttggaggcagaggcaggaggatcacaaggtcaggagatcgaggccaccctggctaacacggtgaaaccccgtctctactaaaaatacaaaaaattagccgggtgtggtgctgggcacctgtagtcccagctactcgggagactaaggcaggagaattgcttgaacatgggaggtggagcttgcagtgagctgagatcatgctactacattccagcctgggcaacagagtgagaatccatctcacaaaaacaaaacaaaacaaaaaaaaaggaggcaatggacttgagcagtaatgataaatttgagttttgagaggcaagaaaaggaactattgacttaagcctcttttctgggaccactggtactttgttatcctgcctgacacttatagcaaaattaacatatgtctaggctaaataaacatattaaggaggagatgatatatgaatataaagtatattaggggaggcagaccaaatagcttcaacatttatagtaaaacaaaatacaacatcattggtagcaagtgagagaggagggtttgaaaattcttaagatgtgaaaatgcatgaattttacttggaactgatccacatttttttttgtttagacttttaaaataactctatagcaacattcaataacttgggattgtactggaaaaagtaaacagtgaaagggacacagaccagaaaattaaaaatggctagatgtcaatgggagaagaaattgaaggtcccagagagggcagcctggaaaacggtaaaaaagatctcctgaagtctgagagggtataatgaatggcaaaactgtgaagagcctggagaatcaaggtcgtactgcaggtgaagagctagcaaacctattgccaggtcttctgataactgaattaaagtcataattcagttcttggggtcaaagattgaaaactcagtatctttttagcctgaagtcaaagaggaatagctattttcctcaagttttacaaagctaacaacagcaaggtacattggtctaactttttcttaacaacctagtgtaggaaacaaactctgaaaaaccaacagtcaaatgagctctacagtttgtgacatgggtctttacattcttgaatgtgtttctgttattgctgaaccttatttttgtacaagggtccatgtttgaagcatttgaaagatttgaaatgttggaattccatttttagctgacttttttatatactgagttttctaggcattactttggacaacaggttaatgcttgccttgctctctttggatgctgtctactccacacaggtataatcatacatacatttctatctagacatcatgaagattccacttctgattcacaagagctatcacaatgttgtacaagtccatattcttaggataaaaaggttaactctgtgtctcagctttgtgggcagaagaaaagagaagacatatgccctattatttgtgttatattacatgcattatattttcgaaatggcatttcaaagaaatagctacaaaatcaatagttcttttcttcttcatttttttcttagagctgaaaactgttcaacagctttatcgtattaaattaggctttcttaatcttaagcagtgactgggtgagttttcctggggaaaaacaattctgaattccacagtgtttaggaaataatacaatccaaatctgagagaaaaatttaacgccaatactgtgtaaatatttcacaaaatatttgttctcaaatattcaactttctatgtatacattatacagttttgactcaaagatcactaaaatgaacctaaaataaacccaccatggaatagtaacttccaataatcagtctttcgccttaagtgaataaggatcacaataacataaaatgcagaggctataaagtaaaaagcagcactcaaattgtagagctgggataatacaactaggtgaagttaaaatttgaaagaaataaatgggttggttttgagtgatggtactgcccatgattttttactttaaattttttgtcactattaacaaaaaataaagttatttgaaataaaaatataagaaataccgtgtgtgtgtgtgtgtgtgtgtgtgtgtgtgtatgtttgtatgtaagacatagaggaaaagacctaaaagatacaaaatgctaccttccaattcaactgtagctattggctctgtcagttttagccttccaagttgtttatttccatgagctcagacaaattataccactgactcatgtgctgctccctgggtgcagtgagaatattaacctttagaaggggccttaaaaatgagaagtgttatatgaattgatattttagttgtgtgttgtgtataaacttttctggatatggcttgccatttggttgggtgcttatttttggccactcaatgtgcataccaatgtgtgtgacttcatatatgggaataaatgttggcatttggattatttttggccaaagagtgggtgagaaattagacacactcaggagccaaaaataaccaaatggcaagccaattacataaatgttttctggcataccaaaaaaaatctggattagttatcataaaacaagagttttagttccagttattattactattactactactattacttctggtgttattcctactaaagccactaatctctattagacacttatgcttgttaaatttataaagtttaacatgaatcattccatttacaccaaacactaatcctatatatgaagtgaatatcagtactataaatacatggatatcagtcccacacaaagacaagaaaaattatgcttagaaaggttaagcatcttagtagagtcacacacaaataagtgacagagttgatgagaacccagacatactgaaattaagaatcagacaattcatctgcatggaaattctgctactaatatatcatgtggccttgagcactcatgaaaaactttgcattttagttttatcatctgaaaaatgaaaatgagtatatgtgctgtagaacatgagtgtaagtgctataaaagtagaaactgatggaatgtgtaaagtggatgattactgaaatattttccctttcctataaacctaatagatcatttattcttgcatctgagaaaaaaatactaatgatcaacagaagactacatgaaggcagtaactctaatattttcacggtattcttcaaagtttgaatatacattatagttcatttgaattctttcaagaatgccaagaaataggaccttcaaagtgcaacatacggaatatatgttataaaattctatgttgtataagtcacacagatgtggagaatggaagaaaactggacatcaagcagctaagcactttccacacaaaatcttgtacatgattgcttataatagcattactcatgattaccaaaaggtggaaataacccaaatatccatgaattgatgaatggataaataattgcagtatattcatacaatggaatattattcagtatttaaaataaatgaaatactgatacatgttacaacatggatgaaccttgaaaacactatacaaatgaaaaaagcctagtcacaaaagatcacgtattatattattctatttatatgacatgtccagaattagcaaaggaatatggagaaaaagtagtagttgtctagggcttgggagaaggagagagaagggatgtctttcagggggttccaaatttgattatggtgatggttgcacaactccgtgaatatactaaaaatcattaaattgtacacattgagtaaatcacattgtgtatgaattatatcctcataaaacaaatgaaaagttcaccaccacctcccaaagaaatactagaaaacttatttatttgcaaaattttcaactgcaaaaattatatgtgtgaattcattaaacacttatacagtacaataagttatacatgcatacacacaaatacacacacacacacacacacacacacacacacacaacaatttttttcctaactagacattttgaaaaccagttttaggacaggttgttgtaaacaaaagtattcacgaggtggtcagaccaatttgaaattatccaattggcattttcaccatgtctcatgcaaatgtatgtcagaagataataagatctcagaggacatttttttctttctagtcagctgcatctacccaggcttaatttcaatctattgctcctcattatatccctttggagagcctaattccattccccacttgatggccataccctctgtctaaacctgagcatcagtataccacatcctctgcagtaatcacacctcgggacagcacattaaaaattacctggaactcccaaggagctgacattatggaccctcaggttgacaatctgaaacaatgtctggaaggttttgttttgttttgttttcagctttgctctactattgaagtaatgtttgaaaacgtcatttgttaaaatgttaacaaagcaaagttatatataacatatatagtatatatttaattacatatgcaaatgtaatatatattttatttattatgaattacacaaacaatgtgtgtgtatatacacacacacacagaaatgggcagtacacacacacacacacacacacatacatatacacacacatacaaacccagtgaatccgaatctgagtactgcccattttaatatcatgtcataatattgaaattaatatactaagtgtacattaggttaaaaacagctgctcttctagcactcttcttcaagaaaaaatacatagaagaaattcataaaagtatgttagatgctaaaatctaaaattcagcagggacttaccgatggggtataaacaagattaatcaatacgatgtgctagatttcaggagaggtaagacacattcaccaaactatcttcacattttatctacctgatttaaaatacaaaatctttccatgttagaacaggtgtatgaatttactaagagtataagtagaaactgctattaaattgctgtggaaatacttttcatatttacctaccttgtcacaagatgaattttttaaaagaatacctctgtaactcacctcttgaataatcccttgtggtcacaatggaaaaaatatttttttattttgatacttactgatacatgttatgccttattatagtaacttaatatatacaattaagaaatatatatttatatatcttccccttaatcttcttaaaggaatttggtattattaatctactcttaccaataaggaaacagaaggttgcagatgttagataatttgcttatgattccgtagctactatgtgacggaacttgactttgaatcaaatattatacttcaaaggccatctatgttctttcaagcatagcagttgcctccacaaaagcattctgatcattgaagagtctaaactcaagaaacaaaatatgatcggctttagttcttctaataattgttctaatccatactattctgaatcagctatcatttgggaaagttctcttaatatcttggcccaaagtttacagctttttggccatttcaaatctcttccctgctattcagtaccacaagttagggcctttgttgtttccatgtagagtaggagggacacaagcctaggttggtatatggtttgaagacctgcttttcccctttcttctaggcccagcctcttcttagcccttgggtgaagaagaggagaaaaaggcaaaccttcccttcctggacttggtgagctgctgtgctccactagttagttgtggctggcttacagcctgcaacggttggcaggagaacccactgtctggtgtccaaatgatggtgttctgaaatgcactgctcatttccctccagtggaagactgaatttccactcaaccacttttgcaccttctcagccagtaactcacactaccagggtaccctcatccagtgggcagacctcttatgtactagcacaatgaactcatgcccagcaactttctgagatgtccaatgtatcaatgagagatacagacatcttcatctcacaaacagtgagtgtacaggttactgcaatgctgctacccttttgtcagccctttactgaccaagcaggtatcaaatgaaggaaatacagttccggtctccctcctctgaccattcttgcaaatctttgtaaatctttctcacagggtatccctttccagttttgaaaaggggatatagcttttcttccagcatatgacattcactaaaatgctatttgctccatttctcggattattttgatttagagaggaggtggtggtggagggtcttggctcctgtccatgagcctgcaggggctgtactccaccctgcttcccagaagctcttagaaaatgcaggtcctgaatatccactgtcctcagtttggggtctgagctaacattcagggacaacaagcaaaagctcatcccatttaattacacttgaaaataacacgagtcctttaagttgtagcccaaattttaaaaaatcaagctatctttcaaaacgtgctaacattcttgcgttaacacatttgatgttaaaacatttgggtcttgttcattgtctctttgaataagctttaatagatatttctcacacaaactacatataatatagagactgtatgtaatttccatttcatatttgcagcaaatgtgacattttcctttattgcacacctcttatttcttcattctcaactctttgaactctgaaagcccaagccttaagtcaaaaaagtatgagaatccatgtccacactttaaaaaggaccaagaacacaaggttgtgaactactctaaacactgaaagaacaatttaagtatttctatagccttcacccctggagtactccacttctttgataaagtgactatttttgcaaaaagtctagtgaagttcatgagtttcacttctctcaggttgagagaatgagttaacttggactctagcgttcattataaacactagagatttaatatatggccaaatgccagagagtctaattcaaggcattaacataaaataataacagttaccatttatgcaatacttgtggtgcactagcactatgctaggcccttcacaggcctagtttcaggattacagtctaactccatgacgtgggtagtattggagccttcattttacaaacgagaagactgaggttgaggaattaagtagcccaaaactgtaaaggtggaaataattggggccaaaattcaagtttatcagttcaaaatagtttttgaaaatctaccatatccatggcataggtacttaaataaaacaaacaaaattataccctttgagaatttctatttggttctgtcacaacacagtgcctacattcttacaactaaagtatgtatgtaaataagacatgtttcaataaaaacatggaaaacatttaacagatatctgatttattttcattaaacaaataatagatataacttggtgttttcaaattatttacacttgttgcaataaaaaataaaatgagaaatgtcatagatttaaatctcagttgtacttaaagcctctgcaataattcactttgtaaccactgtatatatttattaatgaagtattaaaaaataattgtgctatactatatatgtactgttctatgtattaacgataatgctgtattagtgatcttattaatgctgtttatctctcaactctctaacagtatattttccattcaaaaccaaaattataattacttgggtaaatattatcatttacaggcaaataataagaatttgaagaaaatcaaaacagaattggtccagtcaagcccaggcaatgagacccaatcacaaattcgtgcataaacttttgcctaaagaatagccttgttttgttttctccttgtatccaatcttaaaagtgttttaatgaagatttgaatattaagaattcattataaaaataacaactcatcatcgcactgtgtttggtttattcaaaaaactctaaagttattaatttcagcttcctaattagaataatccaattttaatctactggcatttttggagatgaatggattggtggtgcattattctaaaagttaaatctcattaatatttaattgcacccacattcacaggtattaattagaagtgttttatgagtcatagctattattggaaaatcaggtacaattttataattagcataaaatgaactgtaattttgaataatcactgatagtgatcatttagtagaccttgtgagattattaaacttgttgatccatataataatttatatgtagactgcatatcaccattatagtgatacttttgagacaattaaaaataacattccctttcagccaagcaggaacacatatttcattgttgttttgactatgaataaaaaccctttctgctgaatacattttaaagcagtagtagaaaatagataatgtactagttatgaaattgaataaagcacaatcaaaactataattttattgatatttatatattattatatgtttatatcaagatctttcaaataaaagatatatttagcttttaaaaaataaaattactttcacatacataagacttgcactttgctcaaacacacactatttaagtggtttaatcaagtctaaataatggatagttactagaaattcccaaacaacaaaatgacacagtgatatataagttaagttctattaaagagaaagcttttgaataatctctatccatttttctggctttcataataaaatgtggacataccaaactgacttgaaaaaaatttaaaagtggccactagattcaagggaaactttattttaggagaaaacttgttgagggaagttcctcttataccttatgtaagaaagcccaatataagaattaaccataggaactgctgaaaaacctccccttaaatgggtagatgggttcagtgaaaaacacacatgcacacatacatatacacatatacatatgttatatttatatcattttgatatcatgcttagagtatctgtatcctaaatttaatagaacattgaaaataagaatccaaaatagtacttaataatcaactatttcttcttaagatgaaaatattcatagtccctaaaagatgattaaattcctatatcaacagactattaatttgaattataaaccttgtaattttcatattaaatgataataagacaaatataatatgcctgtgatttccattataacagcaaaagaaatgtgacgattcaataatcaaatattttcatatatactggagtctataaagcatttcatataggtaaacttgaatgaaacctaatattatatactaaatactaaggaaatatcgtcataatgaaggttaaagtttagagataactaaaaacaacagtatagtatattctgtaggcaaatgtttaatgtatcaattatacatattacactcttggttataaatactaaatatctcttagtcaaccagactccatttgatgtgtaataattttgcctcatcaagaagaagacagggtaaaaaaagaacaggaaatacgtgttcttcgttcatttaatacatataattgacaatttcaggaatatgctgtaatgtactctacacaaatcttgcatttcctttggctcattcatgggagcaaatcaatatgaattcctaatacatcttaagagctacactagacagaaaatttttgcttattggcaaactaaatccactatatattcactattaaagtttcctgtccttaaaactgtcccctcaggatttaatttaaaagcatgggattcactgaatatgaagtatatttttccaaatttataattgaaaaacaaagtttgtgagtcatcttttttcagttttaaattctactaacttctttataaatgtcacagaaactctcagaagtagaaaatcaacaagataagcagtttcatggtagtgaaaaaaatatgctttgaatttgcaaaaaaaaaaaaaaaatgggtttgcctagaaaagatatcaacactttaattccacagattatttcacccattaagttagcattccctcttcacctatatggctaatattaaaggcctgtgtgtgaccctacaacttaagtcttgtaagagcatcgatttgagtctggttttttttttctctcttctatacacagcctccaggaaagtccccaaacttagaagtttttgataaataactgttaactgaataaatggcaaagtttgtcatttatatgtttatttaaatctgtagcctcaaaattggtaaaagaagttgaaggtggtttgggacattacagttcctttatctgagtgaacgaggcagaggaggagcattcttaggaaacaaataaaccaaaaatattactcaggtcagcttgaaagaaaaaccaagggaaaggaataagatgcctttgtcaatcacacacagcccctttaacctttcacagtttgcttgcattatatgaaacttcaaggttaaatgcaagacaaatgtgaactgatatttctgcaagggtcaggtaggtaccagttgcaagtcattatgattgcaaagtggttcttcatcatgagaatttccaaactgcaagaatatgcctgcaggctttagtatgggaaacactcattaaagtagtaataaaaatatcacctttgaaattgtttcccagtttctaattcccctaagatgtgttctgtctttataattgctcatagaaattaacattggtaccatggcagacaggagctggttgttgtctttgacattaggagggtgctgcacattctggagatcccaagagctttaatttgagaaacagtggtcaagtgaacgaggtgagataatatctttattcattcaacaaatataaaatgaacatttacaataagctaggcacggttttaggtgctggatatacagaagtgaaccagacagacataataagttcctcacttatacagtttgcattctaatgatactttaaatattgaatacattttatagaatgaaggaataaaagctatgtgactaaggatataagaaaagacaggaaagaaaaaattgggatgaatatattgtttgtaaaaacaatggcactatggattgtatgtgaacttcagcttgtgaatttctgctataattgattttcctatacaacataatagaatgataagactgtataatggatctggaagtttcgttagtccaggcagccctctgatgcttaatctttccacactctacacaaaggaacttgtaatactcatgacctcttgaggtagcccattccatttctaacccaccgaaatttttaggtatttctagtcaattaattatcatgcctcctcgagtcattagctagtggttcaaagaatcttgtttggactcctaaccaagaattctaatcacttttaatttctttgatgattttataatttaacttggtttcaacttttttcatcaacttcttgttcaactctgaaggtattccatttaaaaagtgtgacaagcagagcactccacaaaccccagcagagtcaccactgcagctaagaggaattcaccacatccatctttctaaatattaatgcatcctaaaattgattagttttacttggcaacttcgtaaaactattgacttacattaagtttatgctgattactaaattgtaacagtttatttagttgttgtttattttgtgctttacttaaatgtgtccctcagttttagagttgtcagtcttatgttcttggatttgatacttcattctagcttgggatactcatattagtcataactttgattttcagcttatctacatactgagtaacaatatcttcttttattttaattcaagatattggataattttcatcaggccagggcaaggataaagccctgtaggaagaactagcaatctcactctgtgatcacaattcctgaacatatccagtaattgtccctaaatgggaaagtctttagcatacgtctttctctttttcaagtagattgcataaaatatgtatcagcaaatctctaatgctaaatattttcggttccttctaatccaatcagcaactctatattccatactttcagcatttaatgagtaaattaccaaataatttgggtcatttttgtccaggtagagactgatgtcaacattagtatgactaatgtaagcaacagaaacaatattaattccagcaggcacagaaaaaaatctactgcctagttataaaacagaattttaagataattcaaatatagtctgtattctagctactttcaactcttaaatagagagcttgacttctgatttttctaaggagtttactgataatttctctctagatttcatgcagaagtcataacatatcctacattttattttttaagtgactataagataatgaaactgctttcttgtatgatttttggaaaccacatagctctgtattgcaccatgatgacttcaatgtttcaaagtacattcacatcctgtttcattcgatcttcagaataattctataaggtggataggaaagtattattatctcgactttataaactgatgcagggtaaaataaaatatgtagcatctctaggactcagctcactttaatatagctaggtccctgatttgcagccacattattacctgaattgtacatatcacagaaatgagacagatggcggcaaccctcacaaaattcattttagataatatgttatttatctaattaccttcctattcctctgagagttgaattattttatctgatacagacttcctttacgttttcttataatggcattaatgcccctttacattccacctccattctaatcctactcccattctcctgattaatgtgctcctgtctttcttgtattgcattaaaagaaaaaggttattataaggctctgaaggtaaagaatgttacatccttattacacccctggggcacattttaaaataaaggcctattataaataaatactatatgttatgtgtcagtgcgattcttaaagctcaacaaatgaatccaattcatattaacatgacctgctaccaagtataaatattacagcttcctgtgtctaacattgtctcaatcaaatattactgggtgaaaacatttaatttataaataaaaatacagtaaaaaagtaatgagattgaaatcagaaaacctaaactctgatcattgcttatccttttattagtcatgccatttatccacaggccttaattttcttattcatgaaatatgcacagtaaaaagaatttctgtaccttttgaagttgttttaaaaagattatgtgtataatgctattaactttaaaacaatatttaaaataagacatcatgatattaataataatattaaaaaatcaggacaatctaaattaaggaattattgttaaatagtcaaacttctgcagagcaggcaattatttttatccattcttcagctcaacaacatgtatctcatgctttgcccaaccatatagccttatgcaaagtgaattctccaaagaaaatttaagcaagtacataattggcatttttcagctgatttcacaactgaatgtggttaaacctcatattcagttggtgacattggttaaatatttcaaggaactaaatatgcttataagtagataaagaatggagggagtgaagcaaagaaaagatggtgtcagaaaagttatttttaaaatactttgggcctgatacagtggctcatgtctgtaatcctaacacttagggaggctgaggcaggaagaatgctggatgccaggagtttgaggctgcagtgagctatgatcccaccacggcaccccagcctgggtgacagagcagaactccatctcaaaaataaataattaaattaaattaaatacttcagtgtcaaatgagttaattatctcaaatgtttataaacatcttaatgtttataattttaagatacttgttattgttttttcaaacttaatgctctactttgaaagagcaacacagtatgagaagaagggttcaatttaagatatttgattttgaagttgaatgaggatactgtatttaaaggcattgagccatacctctgaagtatttaccaatcggattttgaaaacagaattattacttcctttgaaccacttttaattttcattacaccaaatgaagagattctacaagatctacatttttcaaataatggaagtgagcagagactgagacatgccaacagatagagttttttctttcttatttttctgttttcaagccattatttaaaaaaaaaatcagagtgctttattgagcttagaaagacacagccttagggaacaaaatgactacactaattttctgcatatgctagttgggtggaaagttcaacacaagttttaatgatcaatgatgccacgttagcacactttcaaaaagtggatttcagatttgggtgtgattccaaacatgcacctgccatcctcaaagcagagaattcaggtccagaataatcacaagttctaaattatacacagtgtgttgtgaaatatcattattatttttagaaagtgaaaaaatatctgtgatagaacctatttaatgttttgtcagcctccacagatgtggctaaaaacagcttcccagtaatactttcaagggtcaaaagcaatgaccttgtcatgtttctgtgatcgtggtaaaacacctgggtcaagacactagtgaagattaataaggtaattataaaggaatcagaaatgttattgtagcaaagcagatgtagcaaaaacagcacctcctaatactattggtattgtcctcaacttttttcccaatccttgattatgaggaccaaaataaatatgttttacataataaaatttgctattattaagaataacaaagactatttaaaaagcagtagacttattctcaatcacatctttaaaaatcacctttgaacaggatgttcaacatgcatatcagagctgtgggagaatataaagcatgaccccatataccattgttattgctgtatctgtgcccattgacagttgagaaactaagtgattagaaaagacaaagcttaaaaaaacgtaaacttattggaccttcttttatctggctggatctataattacatgctttaaaactctctaggtatgtagttttttttaaaccctataagtaggggttcaactttcaatttagatcatgtttcagaaatgcctaaagagatggacagaccgaattataacaggggacctaaagaaacagtcctaggaaagcgtgcattctgtgggtctgtggagcaagtctgtcaacagaacgcctggttgaaggtcatctttccaacccagagtcctatgcagaaagaaacttaacagcaaagctttagactcttacttgaagtctctctgcagtatgacatcacttgcatacttattaaaatatttttgccacttctcttttcatctaacttattgttattgaaaaactagataagatatttcccatttagccattcatccagaaaacatttactgatgcctagtaatggctatgttaaaaggcacataattagccagacacaccatgttgtatctcaatttagctcattatttctgatggcctcctttgttttcttctgtttggcacactcctctcccatacatacctgaactacctcctctgcaaaggtgctcctgaggcatcaaggcaaaattcactcttctttcttatatgctactattataaatttcagtgcttccattattgtctttacatcattttattaaaattatttcttcaaaagtcttaatggagagttttcactattcaagtttattgaagcatatgcaatatctcatccacatttctatcccaagaagctaacaaggttctgttcactttaaagccctcaagaagtgattcatgaatgaacgaaaaactttccaccttcagtgggaattgggtgacagttagctcccagacacgtttttgaagagatctaccagctcttagtatgaataccatcctttctgacaaatggtgatgattctctcaaaatggaagaatatctctcacattctactggagatttgaatgtgttctccttaaagttagcaccttctttttttttttttttttctttctcagaatctaaacgtctttggtaaacttcatatttagccacagtgattatagccccctccccaccacatacccacggttttggagaaaaataagtttgtttatcttggagtctaagacagaatctaaactttcagcaaggccatagcttatataacagcattactcatttacttttttaaattagagtatctttagtctttgattaggggttggaatacaagtgagcctctaagggaaataactgcctttccaggtcctgaaacttatctgagatagaaaaacttcaactttgtacccagtgacattttagttaaatataatttaagattctatggattcctgttatacatatgcaaaacaaagtaaaggtgtcctttccaaaaatattcacttttattccatattgtttaaatagttttcaagagagatattccaatagcctttatttttttttcttctctattgccaatggatttaaatgtttgcttcattgtggcattccaaacacacaaaactccagtggctatgggttttattcctttgagtgaatagttatcgtacttcaaagactgctttggattttaagttagggtgacctgttttcattatattcaaacaggctttgatccatttctcaattaggtattgcagatgacaaacaggtacgtctagctttcctgccatctaaattaccctagaattctatgaagatgataatttgttctgtgagtacactacttctatgtgttatccacacaaatttcattatttcaagtattgtctttttatgtatctcttttgtggggagactaatattccaatacaaaactgtgttctgttttggggaaaaaaaaaaaaagagctcttagacagtcagaacatgagaagtttaccaaaaataatttgtcctcaagtctagttgataaaaaggccctatgaggttagatttatacaattttattggcaatgacaaaatctagaataaaatatataattattgaggtacttacatttttagtataaactggaataacaaacacatcaactttacaaacctctcatactagtgtctcactttaaagatattcttaggtcaaatacagtggctcactcctgtagctgcaacattttgggaggccaaggcaggaggatcgcttgagcccaggagttagagaccaacctgggcaacatggtgagaccccatctctacaaaaaattcaaaaaattagttgggcatggtggcacatgcctgcagtcccagatacttgagaggctaaggcgagaagattgcttgagcctcgggagtgtcgaggcttcagtgagctataaccacactactgtactctaatgagaccttgtgactatatatacatatatatacacacacatatatatataaaatctctctctatattatatatattatatattatatatataatatatatattatatatatataatatatatattatatataatatatattatataatatattatatatatatataaagaaaatattcctaaataagtggctctcatatgagccacaatttaaggaatattttcttaaaggcagacttagagagaaatatgagtcacactaacacaaagcataatcagcctaactcctcagtcaaacaccctgaggttcacattaccaaagagagaggtttgaacatgagggaaacatattattttcactatactgtgatggaaggaaattaattctggttgtgcaaacctagagcatttctctgaattctctgaactagggtggattgttaagaccaagacagagtgtgcataataaccttgatgttgggaaaagactatgccgtgagtcttaaaacagatcctagttgatgattatgccaaccctgctgaagaaattctgaaaagatgcagaatgccttgaaatacaaatgctttttctggcccagataattgatattgcattagaacattccatgggatttgaaccagcctctttcacactttagatttcaggctagtataattccctcaccacacaaggcagaaccgaaatccctgaagttcaacaggacgtatccaatttcaacaactttacaattttcaatatctgtacaggatttttgcaaaaacccatttcaaatatcccattatcagttccacgtctttttgtgaataccaaaatatattagctagaccgtcatcttattttagctttagaatgtatatcagattttttttccagacacaagcaattaaaggattggaaaatagctcatggaaagctccaaagaattgatcctcagagagcaaatcttgtaacaccaaacaaccacaattcccctaagccactctgctgacaaaagttattgctagttatgcaaggtaactagaagatatgcacacaaatcattgcaattaaatatcctgcccaccatataactgatacttgccgagcagatggttggcagaattttcttgctaatctcgtgttatcaatgtccatattgcagagcatccttgaaggtgctcctctgtttgttttgtattggatacacctatttgtattgttgtatagttatctgtgctgtgtgtcttacccagtctcacccagttattttactttagaatctcatgggctgtgtatcgtgaagacaaacaacctgttggaaataaacaacaaagaactgaatccctcttatctgttcgctgcctaacaaatcaaaacacactgaaatctgggattattagagaagttttggggatatagaaataaaataaaaaccagcttgtcaaatggggctgcctgctgctcagtaccatgtgttaccacagcaagttgcatctgttcagctattaaacctgttagtgaatataatatagacagccacggcattaacaaatattcttaatgcctattaaactctacagctacacattttaatttttacattgtattagtaaaattcaagactatagcacctttaggacaatttaaaagtgcaatgaaaaaactataattttggttatatctcacatgcttaaattatatttagccatcattttaagaattggccatttaaaaaaaagttctttaatttttaaatgtggttctcactgctaactgtaatttagctcactatagatgcaataggactgaagtaattaatcacatgtagaatttgaaaaactcaactaggtacatcttttttccactactgaacatcttacttcctttcgatttaatattggctattagcaaatgccacagaacatatgagttactcccttgatataatccaccctctgagctcaggctcaggaacttcgtcatttaaattggctatcaacagctaggacatgtatgttttactaaacactttatagcagaatacatctgttgctactctgtttgttatattaagattaagcacaatgatgttgacagtattaatacatttaaaagcctgtcacgttccatggtgttcacgagtcctggggactgcaggattgaaataaaaagtgactagaggcaaaattaagaattatggaatgtgtagaaggtgaagaacacagaggtagactctgaaatgagtactgctacccaggaggatattaacctcttgcctgcctggcttttcccataatattgtgaagccacattttactgaaaagagccgcatgcttcatgaaatagttatccaacctccttggcctactgctgcttcatgaatgctgccagaataggggaaagtttgtgactgaagttaaaggggggttggtttcaccgctatactagtgtaattattaaaatgcgaacacactcaaattaaatacaccagaaagaaaatcattctatggagctcagtttcctaagaaataatgagaccaatttgcttttatatgaaaacactccagtttgtgatatcttcatacactgctggtgggagtgttcaacagtacaatgttcttagaggacaactcagcaatatatacattggttcggcttgtatgaatttgtacataaaaatatgcttttacacatgtgaaacgatatttttacaagattttaaaatgttatccatttgtaatacttaaaatgctgaaaaaattaaaatacccatcattagggtctgctaccctcataacatgtagcagatgcatgttatgaggtaaatatgagatcatatgctctaaaatgaaaagatgtacaaaatatattaaataaaaatactcaagttgcagaatagtatgcacatgataatatttcatctttttaaagaatgttcaggtatgttagcatatatacaaatccttgtacctatactatacacaaaaaagaaattgaatgtatatgcataagattaaagattagagttttagacaccacagtaaaaaagtgggtatattatatgctgtttttactttttactcccatcattgttgtattatttaaatttttcaatacaaatttttatgatttaaaaattaaattgatttaaaatatgggctttcctgaaaagtaaatactttcatccgtaggcaacaaataaaattcaattccttctgaacagcctgtcataaaatattattggccttcaagaccctacagtatgcctcactagtctattgaatctagtttatgtctggatgcttagaagaataccaaaaaattagtaagttaaaaaaaaagttaaataatataaatacagtctactgagaaggacaaagttaaggaaaaactagttaaatatggagttgatggttatagcatgttcctcacataacaattaacaatatctacatagcactctcaaattccagaaacatccccagccactgcatttatccaacacccttctcaataaccagttacaaataatcaaataaccatcggtcttgatttaggtatttggaggcggagctagaatttacaactttttcttcccaccttatgaaatatctttgcaatacctgttttttaaagatcaaatgaacacagttctggagcctagacgagtagctgtctaaccttactctgcgtaatagggctaaaatttcaactctatttctctgctgatgctctatgggatttggagcccccaaagcctgattttattcctaattaacagtaatgaacagatgacatacttttcctttgaacacctctgtcgggaaaatgtccaatcagcaagagctacaagcaatagacaaattccctttctctgacctcatttacatgcttaagtacacagagactccccctgcctttagtttggggtgcggggggaaagaagtaggtcaagacattgaggctttatgcattacctttagaatgtggtgaaggctgaaagtcatggctccaaccagagtttccagagcaatgtgggttactttcatattcatcacacataaggccaataccctcctagcagtattagtttagttctacatttaggcacaactcacaaagcagcaaagatacctataattgtacccattaagagacttataatagaaaatactatgtgctatgtcatcacactttgttgttatttagtgcattcaccttgagggtcacagaatctctggaattccatgtttaaggaatatcataaaataatacactacaaagactcactggtttcacatcagtagttgggattttataatcatttgcaaaataagctgggccagcctgaaattttcctttgtacaaagaaaaatgaagctttgaagtcatatacaactggttcaaagacaggcagttatttactatctgtatgattttggtcaatttatttataatgcagtctgctcattggtaaaactgagataaaattcatacctcaatgaattattgtgaatatttaataaaatctaattttatgcaaaatgtttagatcagtgtgtgttccacagtaagcaatcagtacactctaaagagtattgtttagttaccgttcttctgactaagccaaataatagggtaagcatgatttcagagggggaatttaaccctacttcagatgattcactgatagtacttccaaacatttaatatatattaattaaaataatttttacaactcaacaaatggagaaccaattttacctccctcagctaagccaagtgttagaggttggcacagcagaagattaaagagagagagagagggagaaagagagagagagagagagagagagagagagagagagagagaatggttaaattgccagggtagtggagattgatcatctctacattcctaatcaattagggaggattactacaggacagttttttgtttgttttcattctcctagtggattcttctcttctcatcaagtcaggatgcagggaaatatatcacataagtttttgtgtagatattagaaataaaaatgatacagagaacagacaagaagcatacctagactcagagaaatgatcacctgtgtgtagtatttgaatctgaaggtggagctagccattaacaaaagaaaagtcttcctttcataagaaaataacacaggaaaaatgaatccatttcatgacaggcctcagtcctcaggcctctgacttttgtttgcctcaggaggttgtaaatgggaagtcccaggagaacatcacgtgctttcacgattatcctttggtactgtacctcatactatgctccaaggagagcacttctggagtgagcgcctgcatgacaatggaaaactaccagcaggagggcaagagaggccacagtcaaaagtaaagcagcaagagttcacttatttctccattcactcaggtatgcattgcttcctctgtaaaccattactatgcatctactaagcaccatgctagagtatgaaaatacggacatgtaaagatacatagtattatacattgtcagtgaccctgaagagtttacaatttaatgggctacaaggacatataaagacatagttataactacagtaagtaacacaataggattaagaacaaagtattatgattgtaccaagaagggcataattagtcttgccctaggggacaaaggaaggtttcacaaatacataaaatatataatccaggcctcaaagatgaataaaaaagcaccagactaggaaaaagagaaggacaggtaggaataagaggaagtaggagtactttaaagaaaggaacagatatgaacagcggcactctggaggtctctttttgctgactctcattattggtacatttttttaaactgtgtttctcggtctttaaaattatttatgccccaaacttacaaatcaaactagttgcaaatgctagctagctaaccacaaaatctttggggtaactggccagtcagataacttcctatgtatttatttaactagagaaaatgctttatgtagcagatatctgaaatgctccataatttatgtgatatgtggtatactaaagggtagggttgtttgacttcataaaacttcattacacagaccaaaaggcagagttatctcgttcagcctgatgagggattgtctcctgaactctcacctgcatcacagaaggcacagtggttaagcacatggatttaggagtcagactgactgagttcaacactggttttgcagctcactagttgtgtgactttcatttcttcattaactacctgagtatatattttttccttttgaagttttaatgcatattagatggacttacatatgtaaacttagaacagttatgagactgttgattgcttttataaaagccacacttgtagactgcttcatagtttaaaaacttttaagtgtgcttttacagtgtgaggatttgaaatatcagcctattttctgtggctaatgtgccagtagaataatgattatgtagtaaattataaggtacttgaggtcagaagccatgccacatctgactgtatttctagtgctttggaaagtgcttagcacttagaagaaaaggaggtagaagagaaagaagaagaaggaggagaggagaagcacaaggaggagggggagaaaattttgttaagaacatgtattaaagagtgaatgtgtgtgaggtagaatgtggagtagctgaagatgaggctggaaaataagtctagattgtgcatacatcagaggtccagctaaggaagttggcctttgaagtatttgcagtagaccactggttctctatcagaactagaatcttgcttcaagataccaatctataaataggtaacacataaactggaaacatgctgatagttagctcagatttgtatctctaacccccccaaaacacatttaatataaactggcttctgatattgcctttaacctgagcagcaccgacctattgccattgaacattttcagaacacacatagtttaagttggtagaacttccagaatgcaaagattatttcaacaaatactgattgctcacttgctaaattctaggctcatgctgggctctaggaatactaaagtgcacgaaatagataaaattccctgctttcatgacacttgctgctcggcatcatgctgttcagtatggatgaagatttgccatcagagtttaaatactttaacctaattccaaattttgtctgcttcataaaattgccaacaaaaaatgcaagagtacacaaagacgggaaaaaaaaaaaaaaggaagtttgttgttgttattttgccaattttttccagacgtttgactttgctttgtcctggagaagtaaattactaagtgtccgtgtctataattttaataaataaaaattagtttctcttcatatgctattaaatacacattgggaaaaatacttaaagaatactatgagggggcttcaaattgacaactgaacagggagcccatgcccatctctgaccagccttgctaccaggtgagaggtggaaacacacccttgcagagcagtgggagaaaatgggtgaaaggactgatagagtaccaggatttgtgctttttttccactgatgagcagctcataagtgagcaaaattactgctgaaagtgggtgaacattatcagccaggtatgtcttgaactaaaagaggttgagacccactgtaactgaacatttgaagccagaggttgaaacaccacaattttattttataacaatcattctggtagcagtgcagaggatggattagaaagggaagatgctggaggcagagagattagttagaaggctattgcaacagttcaagaagaggtcattaaactaaggcaataatagtggaataaaaagcaagcagataccttctaaaaattgctgttcagtaggcaagccagtagccatatgttgagcatttgagatatggctaatgtgaccaaggagctgaattttaaaatgtatttaattttaattaagtttgttgtaagtttaaaagatactcaaacttttaagtatgtttagaataacttgagtatgtgaatctacttttacaactgtagatataacaaaatataaaatgcttctgatggaaaatttagattctgaaatgagaggtgttgttaagtgtacaagaagttccttgttttgacagcttggcataagaaacagggtttgctaaatgttaagtgtaaaacacacattggatttgaaaagcttattatgaaaagataatagaaaacattaataatttatatcatttatatattaaaatgataatattctgggcatattgagttaaaatatattctcaaagttaattgtatttagtaaaactaattccatctttttttccttttatatgagtagtagaaaattaaaacttacaaacatggctcatatatttctcttggatggtataggttgagagacatggtagcaattcggtgacaaactgattagattgtaaaggcaagcacggagtaaaagatgtcaaagatgtagcctgtgatcgtgtagatgagtgggtgattgggagatgatgagttcagttgttaatgtggtaagtttcagtcgcctgtgagacacccaggtagagatgctgagtaagcagttggaaatattagtatggtagtgacagaagtctgggatggagatgtgtctttgggagtgagcagccggcacttatttgatagctaaaattcagagtaaaattttaagtatatgaagataccctttttcataggccaaaagccttactaatcaattaaatttgatctttcaccaaacttttttgtctgtcaatcacgaatttccattctttattgggcaggaaggatttaagggctaaaattccaggaagagcccaccattaaagcatttacttagaagcctagttgcagtgtgatcttccagggcagttgagcgtcccccattcagggctgtgctctgttggcaaaaaggttagacagttttccagtttgttttgaggaggagagaggcctcctctgtgttgtcgatataagaatccctagttctggtctagcacaccatctcctaaagtaactcctagagacatcacaaattgttttcatcagaagaattttctcagaccccataaaaattatgtctagtcctccgattctaatttataatttggattatttatgtctactattaacttgagtaccccctatctatgcacctagattatttccttccattgtttaaataaacttgcccatgtctagagtgggccagcatcagcattaataggattctaatgctgtagaatcaccatcatcatcttgttttctggtctttggctgacatatttacaatgctgtttctattttgtaaccgctactgccatgcattttgcttatggctttcagcgcatttttttttgtgtgtgtgtgtgtaataaaagtaattttcctgatcattgtgcaaatgacccatattcagtatgtattccccaaactggttcttaaccctcaagcaatgtctttgtttctttttttcttccatcaatctatattgtgtttagagttctgcaaagcctccttaataacgtgcttgcatatagtttaaattattgctcatcatttcttcccgagacacacagactctgtctggatcataagggtaaacatattggatatgttctaaatacaggagttcttaaccattacttcttctaaaaattccagaataactaagatgctcctggattcctaagtcagtgtaagattataaatgtttgctcttttaagcttctaaattatggaaaaattggttacacaggaactaatcacacacattataaattgcattataggtgatcaaaaataatgtgtttattttgcctaaaatgtttcttaaaggtacgcttttgaaaaatagttagtagctatagaagaaattgtggtatagtcagtagtcagaaagaattcaacaagaagttccttgttttgacagcttggcataagaaacagggtttcctaaagccactcatcactggctaacttaagaatagatttgaagccattctataaaatagcttggggcccaccacaaagcagtgggtcaaaaggagtagtgatcacaggatggagcagaatcaatggacatgattttctccagctaggtaatgtcctaggaattgtttctgcaactcttccaaagagattccggagacctaacttctttctgctagcttaggaggtgaaaagatccaggaccaaccctgaaaacactcactatttgaaaaaactgttcaatgactgagtcaaatctatatagtgagagagaatgggaagaaatcttttgaacaggaattagaaatagagagatgacaagaagctcattttttaaaaaaagttaatatgtttcactggagttgaaagataagtagaaaaatgggaaaaatggacacgaaaagggaaagagatcaaaatgctgaagacattaaattttaggtacagaatttgcctttacccatatataattgcagcggcatcaatgtgttttaacaaaggaataatatgatcaaagaaccagattagcaaattaacctgccataagtatataaaatggatagaaaagtactcagaatggagacagaaggatagctgagaaagtgaggcagcagtacaagcctctaagtggtaagtatgtgaaccgagaagaagctagaaatagctgttttgttctcatttcttaaatttcacagcaatagaatttcagatgaggaaataactctagaattctagaaaccaaaaacatagagattaaatgacacactaaagatgatgaccagtaatttagaagttgagaaattgaattaacttccaagggaaaaggatgaaggtaggaatctgtattgattcatttacctctcctacctcccacataataaactatttagcacttaagccaatagaaatgtgaccatcatttctcacattttccccaaaaatgacttttacacctcagaagtttggacagtaattttacaatacatggtgaaaaggcattatttaacccatcttttgaaattgtagtaaaataggccacatgttctctaattcatataagaattaggaaagctacctcgtgatacggcaatagaaaaaataaataaatgaatgtaaaagaactaggaaagcaaaaccaagcaatatatatacaacatatgatttacaggactgaatctgaatactatatggcaaagttaaacctctataaaatcagtgcatctgttgattagaaagagtatttcaaatggaacataatttctattcaaggaaaaccctgaggggaaataactgggtttatcttgttgatataggtgtgcatctatgtataattactgactttaaaaaggtatttctgaatcaaatcttaatagaccagcaagataaataatgtataatggagagaagcagagaaagatgagaaagacttgacacgtcaccaatattggtgttattttgggacatgtaatatttactataaatacactgtttctagtctacactaaaaccaatgatcaaaaggcatatttctaaatcaaaatcaattaagagcttggtttcaaaataaggcttccggcccagcaaagtacaaagaagcaacacttaaggcaaaaatgtgcaacaattcactcatcaaatttgcaatgctcttttatgctcccaagatgaaaggatttcaaaacacactcttcactcatcccctcctccaccctcagtgacatttcctctggtcagaaccaatgcacatgttaatatttgtggtagtgaatgcatccagatttatagtgactttcttctgtcagagaggcattaagtaatttccaaatgacatcactaaactgctatatgagcgcttttctctagaagtgacaacattggtaaaatttctagatatatcttatataatataaaaacttgagctaaatttttcttattgcttctaagaaattatttaagtcattatcagttaaataatcctcaacacatcgtaacttaaacatgtcttgtgtaacacttcacagtttgcaagttatttctttatattctttatcttaaaaatctattatttgttaactgtccacacaaatactatacaagtaagaaagttaaaactgtaaggaagagagatgaagaaatatcaagacagaaaaataccaagaaataccagtcatttggggacaaaatgtttgctataaatcatataagttaactggatctcagctagcttgttcattcattcatccaacaaatatttattgaggtggttactaaacaaccagctcatttatttttgtatccacagagcctaacataggcctgggtcatattaggtgctaaataaatatttctggagaggcttctaggatgtactgaagtaaatgatgaaaagtcacattactgtattatttttctttcttttcttttcttttttttttttttttttgagacggagtgtcactctgttgccaggctggagtacagtggcacgatctcggctcactgcaacctccaccttctgggttcaaacgattctcctgccccagactcccaagtagctgggactacaggcatgtgtcaccacacccagctaatttttgtatttttagtagagatggggtttcaccttgttggctagcatagtctccatctcttgaccttgtgatctgccagccttggcctcccaaagtgctaggattacaggcgtgagccactgagcccggctatttttcttattaatcatcaccattattataaatcatgttctctgccatcagaaagtttatttctatttgtaaataatggacagatataaaataactagagaataattcatgataaaagtgaattacaataaataaggcaattattaacaaaaaataaacattcatccaactaaaatttcaccatagactttctttaaaccaccaatcaccataaccaattcttagttgaagatttctgaaaactacctttaagatttgaagcttctcaataatatggctgcttatatcaagttctatacttttctgtattgtaatcaggaacctggaggactttctcagagttatatagaaattaaaatgtctgtcactttacttgactgttaaataattgaagatctacactcatcctaagccacagtattttcaatgtataatttattaaatctattaaattctttcagaaaatatttattgagcactcatattctaggtactatactaattaattgctcttcacttcatgtcttaccttctcctcaccccttcataaaaccttaacaatttcaatagtaatattatatgactttgaggttaacagtggtagcatcaatattaatatgacaaaaaaatccatctatcaaaactgggccacctgactcaaaaaccattttattccaagttgttatgtttttaagagtacagttaatcaaaatttttaaaaatccaacatttttattctgaaaaattggatgacaaaccatgtcaaatattcaaatcttcattaaaattatatgccaatcagattttttaaattatctaatttaaatagcagtatatatttcagcaatgatggagcatctcttaatgcaatcaactttctaatttattggcttactctatcaaataaggatgaaaatattaaatctgatcagtacatagtatacttcactgactttgaaagcttacacaaattttccttgaagtttaatggataatgaataagtctaacttttacagataaaaatgtatcattgatagcatagcaccaattaggttaatttttaagtcagttatattcacaaacctaaatcataagcaataatctagaatttataaatcttatttttccttttaaatttcaataatgaaagaagtagaacaatttattgggcaaaccaaaatggactcaaagatacctaaataatttgataaaacagcctttcaatattctcaaatctaaatattaagaacagttctgcttctatcacccccaggcattatcttgtgttgctttgcactttctttgttcctttcttccctccctttctttctttcttctttccttccttcctttcttcttggcttcctgtctggttttcattttttcttttaatttctaattcctctttcttttattattccatgcacccaacattttgggaaagtgctggaggtaaacttaggtagtaaaaagaaaaccactggccttgtgttaatttttattatatgcttaaaacatggaaaaaggccgggcacggtggctcatgcctgtaatcccagtactttgggaggcagaagcagttggatcacctgaggtcagaagttcaagaccagcctggtcaacgtagtgaaaacccgtctctaccgcatatacaaaaattagctgggcgtggtggtgggcacctgtaatcctagatatttgggaggctgaggcaggagaatagcttgaacccaggaggcaaaggttgcagtgaactgagattgcatcattgcactccagcctgggcaacaagagcgaaactttgtctcaacaacgacaacaacaacaacaacatggaaagaaatgacttatctccacatcaaagacttgttgagtctgtaatgtctaatcacctcttctaggcaatgggagaaagaaaatttaatttgaccagatttgaactcagactgagtcccattagttgataaggagtgggtagggctgacaataaacagtatttgagaagcccaggaggacacggtttacgagcaagggagattttgaagatatcaagtccaagagaaagggtgtgtagagacatgcactgaatccaaagagaacgaccaggcaagaccaagatcggagattcagaaagaagaaggccttcacagtgcagctatcagaaatccatggctcgtaaaggagatatggagggtattacgctagaatggacgccgagaaagtcaattctttacttatgacaggaccctaagaccacatttgaccagaattggaaagaaatacctattcttgcagtctaaaactctttgaccataaaataaacaacagtggtttgagtaattcaataacacagccccttgtgatttgagagtgatcattgtagaaccttttctcagagtaaaagtgtaattggttatggatcaataagtaatttattttagaaggaaaaggcccttgttttcatttttatttatttattttttgaagtagcaaagctcttaaatcagaacggagcaaatacattttgaaagttgagcttactctaaacagcaagattccttactgtactagtaaaatttatcttaactgatcatttatttatgatgccataaaaatccagatgttcttaattttgattgttagaaatttgctaaaaggcacctgaaattacttttccagagttcccctcttgagaactacattttaaattgaaattttactatggttcaataatggctgtgctgaggggttttgttgtgtttttcaagcttatcaatgaattcagcccttgtggtcagtgtaaactcctacacagcttattggaaattccagaattctaaggcaaaattaagattaagaaaatagtttaataaaaacagagaattaaaaacttgtaaaagtttgtgctaatgtactttggtgtttcatgtttttcttaattattttagaactggtacccgatgaccactttctaacaggaaagaacatgatgacctaatcaaatgtcctttggagagtgagcactgatagaaggagaacttatagggaaagacaaaacaaaatagaacaaacttccatggtcgcttaatgcatgggaaataaacagaacctcaaggataaaaaagaggatggggagacttacctgtttcttctgaaatcttccaaaagatagactttagaccaagaactatgataataagaaccctttagaaaagtttttgaatatgtgacacactacgattttttggatatatcaataaaatattcatatctcttaataaaagacactgtgcttctttacaaataatgcaagaaaatgaagatttaaagagttgcaaacatactcattaataatttttaaaatgcagagaaataagtgcccctgaaccctaaagttaattatggcaactttcaaaggaaaatgaagtttttcattcatgactattctttgctatctattatatgctgagtaaattactgtgggaggcttacaactttagagaaaagagaatgggcccaggatgtaagtggtaattatgaattaaaatgtattttcctgacacgtatcaaaatgagtacaaaatggcacagaaacaatctttttgccatcttgtttcacatccccaagtatccttaaagtatactttcgttccttttatttcatgtagcttcagataagtactttctctagtgagcaaagaaataaagacagaatccagatctttggatgtcaccagtattacaacctcctgcttccagccagatggtgtggtatctactaggcaataacttattttattcatttggcaagtctgcctaaagacactaaaatcactccaaaatttttttaaaaattattttgaacacagaattaagaggaattcacactccaaaaaaaaaaaaaaaaagtttgcattgtaaagaacgcgattaactacagcaataggtatatggtcttatttcctctagattgtattcatatttcctataacaaagtactggtttctgggggaaggaagcatccaagaagcaaaattataaattctttacaaaaagttaacagtaaaaagtaaaagctgaatcttatgcaaaaagtacttactatatgcagttctaggtagtcacccaagcctgaagaactgtccactcgcaccaatacggcttctttctgaacagtgctaaaacctatggccagtctgtctgctcgtgtactgggtcggtcattaggaggccacttatacgtgatttgtccaccacctttgctaaagatatatgtcgtcccagctggaaaacaaaaaccaaaaccaattagtccaaatacatcaagtctgcacattagcaaggcatgttatattgatatatcagtaaagtatcaactctacacacaaaactatggcaaagtaaatcatagatttcaatcaaatgtgctcaagaaagtggaccaagttgttttaaaagaaatggagaggtagctcagtttttaatacactgattcaatttaccagtaggtgtttcagaacaaatagtaggttattgtgttttccattgagttggacaagaacggaatgtaatgaggcattatctcttcctgccagtttttaagaaatagtttagtagaaaacattgactggatgcttccaaaaagcaacagcagcacacatcaacttggtattgaaataggagctgcatgcagatgtgacagggtcatacagcacagtggagaaagtcgcaacaaatgtgctaggaatgtaacttttatggaaaaaggatctacttacatgtgacagataactaatggatgaatagccacaagccccagtagccatgtcaagaaaatacagataatagatgtcatccctagaagtcaggttttgtttaacaagcaacatctagtagctgtcaaactattcagaatcataaaaagacccacatcctctgccaccccaaggtgaatacaagccttatagcactgagaataatgtcacggactcattctgtgagtgttcaaattttaccttatggttgtctggtcagtaaattatccagcttaaatgaaaagagtctttttcaaacaaatttattcagcatttgatatggtttggctctgtgtccccactcaaatctcatctgaaatggtaaaccccataaaccccatatgttgagggcagggcctggtggaaggtgatgggatcatggagtggctttgcccatgctgttctcatgatagtgagttctaacaagatctgatggttttataagtgtttgacatttcctcctacacacacttctgtctctcctgctgccttgtgaagaaggtgcctgcttccccttctaccatgactgtaagtttcctgaggcctcctcagccacacagaactgtgagtcaattaaacctcttttctttatcaattacccagtctcagggaagttctttatagcagtgtgaaaatggactaatagagcatttggtgcactagtcttacctcaatgcatcattcattggccacccattttggttctattattttgaggtcctgaatagaaccaaaaaagaaagaaaaaagattggattttccctctgtcttcttctgactgcttaaaatgggacattgttgttttcctgcctttgcagcttcttgttctcatgccttcaaacctggactaaaatctacatcgttgtttctccagttgtcagtcccataatcgatacccctagcttttctggttctctaacttgcagacagcagatcatatatgatttgatcatatatacatgattatacataataagagaaaatatgaaaacttaggccacaaaacttcttgtatttatagaaaaatagcttgtaccaagagtaacatttatgtgtaaaagttgtgtgtacagcagtatgttttgaagaaaactatacattgaattgccatgattaccaagtttaccagttaaatggagttgacctactatcacatttgtgtacatttaattaaacagctgacaatattgattttgtggccatttttggaagcaactcttctttgttttctgttacagacatttccacaggcctttgagaaattccaaagacctctgcaatatgcctattgtacctgatgcttaaataggacttggtatatagacctcttccaagaaacatgttaggagaaaattgaatgcaaaagtgataaacatgaatactgttaaaatgcaaagctatagaggctgtacccttctctattaattttgcagataccaatgcatgaaaacagtttatctctttcaagagagaaaaggcaagccatatttcaaaagcaccagtcagtgcacaaagaaaattcagaatatacagagtgtagatcagaaatcccagggctttcctgagccacttatgttctacatcctcagaagcttgttcatcataatctttataggcaaacactatttgagaaatatttttctgcctggtaatttttgcaaatgattaagtattaacttttctagtgaagcccattgttgataaaaataggacaagaacataaaaaagtggagatggctttaaaaggaggatgtagtggttatctctgagtgctgatacttaataattaatttttttccttttttaaattggctttgttctctaatgactatatacattatgtgaaataagaaaaatattcaaaactagagatgctatttaatgatataaaacaacacatatctaagaattcagatggtttaagaattatataagtgtgaggtaagcattataaaacaacattgcatattaatttttaactttaaacatcactttcacaattaaaaaaaatcttatctacttattatggaacatagggcagacattacttccatgctatatctgaggaaatttagtcataaagattaacgtgctatctaaagttgcaaacttggttaattggcagagttggtataaaacccatatcctgatacctattccagtatatatatatatatatatatatatatatatatatatatatatatatatatatttatgacagaaatatttctgttatcataaccaggcagtcaagaaaaagttaattggatgtcagtctgaatttatcaaggccaactgttatcatattctaatgtcttatatccataaagtgacatttgctcttcattatcatatactttcttctcacctcacaatacttttaaaaagagaaaaataacatctaaatgtaaaatgacagaacatttaatatatgtagattaacatttagttggggtacacttcccaaacctatggaactatgaaagtttctagcacaattatagaacttgtgggtaataatttgaagttttacactttcagtaagataagtgtcacaatacaaataccattactcaagatttgatttcttctcagattttaacctttttcaatgaatctaaaacttgatgactagaatgagattagctaatctgtcttgtttagaatgactttacagttttttaggtttcaccaaaacaaagcaaaaaaatcgcaactactgtttgtcaaacattgccattatttctagtttccttttttcccaccagatatatcctgagagcagtctttcttagtttttcttctgtatgcacagtagtgcattgtattgtactcatcagcacaattttataataagcgagacaattagatatccagtccttcctcagctctcttctacatacttctataagcactctggattttttttaaaaaattaactttgcatcaaactttacaaaatctcctatattcttaaagccctcttttcactgagctagaaaattactctcataatcaaatatagtgggttagatggcttaaagtttcaaaatctacctcctttaacacacatctttctgaaccaaggacatgatgtacttactgaagcagaatagcttagagattaagaatgtaaactctagactcagagagatctgggttcaaattccaactgtgtcatttactagctatgtgaccttggtagccatttattctgtattgggattcctatttgaaaaaagatggggatagcaacactatcttatagagctctatcagaattacatgagatattacaaagtaacatttagtccatttcctagtatgtgataaatgcctaataaattttagagagaataggtgtcatgtgtgagggcagttgtgtgtgctgtaaaaatataaaataatgaacactgtaacattgttttattttaatatgaaagccttcagaaaagttggacatatttcaaagttatgtccaaatcaagtgactttcaaaaatgacattcctacctcgtaatttttattaatattttcaatattttgtagcacagattaggacttttatgtaaactcattatatcattatttatgttcagtaatagttgacaatggaaggaatattaaattgtatcacatgggagctttcatgagaaaaagaatattagctcatcaccataaaacatctagcatagtaagatttatagcataatgcaaaaaaaaaaatcacttgaccattaaataaagaccaaacttaccaaaaaaccctgccagctagctttttaaaaattttatctttacagaaacatgttttattttactatataagtgagttaaatatgcagtggcagtacatcttaatcacagttccaatatagagaggaacatagaggaatgtgtcacctttattatttatgcatgtttctatatggcaagcactaccacatcagtaccatgactactaatggatttactgcaaattaaccttgacatccatcagatcgctgaatgtatgaatgactgaaatttaaagtggttttcagcaatctccacatttaagctgtgcagcaagcctctattactcactctaaattcattaacaaagctggctctatcagacacaaatttagcaatgtcaacatactttacactccaataaatgtttgtaaaaaatatacatgggctcccgtatctcttgtttaaactgcctgtgatgttataatcagggaatatttttagatcttattgaacatgctatttacatatagggctctctcccttcttgttctttcttgccaactgtcccttgcctaagtgtgcccacttcagcctcacgtcaattctgcaaaggctaacatattcccttacatagattgaaactttctgaaaaagaaaaccaatcagcatgtacaggtctgctcaattattggttgctctggatccttgctacatgaacaataatataattaacttcggagtagattagcttctaactcataacataagtatatgaataaaaggttactttttgaaagcctataattcttcaaatgtcatcttgtagccaacacgaaacattcaggcaattatgtttctattaataaatgtaacaggaatataacacttccttcagtgaaagtttacagtgaaagccaggtacccagatgaatattaaaagtaaagcatttgtaagtaaggggaacctttattctttctacaaccttttccagatgctgttgttaatttgaaattttctggagaatttctacctatatggaggaattctttggcttaaggttcataaaaagcaaaagcacagagaagaccacattgtatgcaaaaagagttttagatcagggcaacatttctaaactgatgaaacagaatcttaacaatcactaaaacaataacaagtaaatacactttattttccttctgaattattgtaagttctttgtagaatcataaggaattatttcatgaagctgagcactataggttcctaattactaaaatttcatataggcatattaaaaattcagaaaaagtgaacatcttaggagaagttaatggaatcaagtaatgagtttctacctataatatgtaaccacttctagatttaaaaattaattacaataattactaatattgagaagtaaggcacagccctcaatgttacatatgcatgtaagggtgcaaagacaaagatgccaggaaaagaaaaagaaaatatggactatatatcataaattaagacttctggtgggaggggcagacaacagaattggcaaatgtgttataactagctaaagagattggagaattagacagatttttaatcacatctttgagaaagagaatgcatatgctctttataaatgaaagaaggcaagaaacatgacatgtcacagaaatggtttaggcacaggtcccatattctcaatcaggtcgaaacaaaaaatgtccagaagaatttagataattcccaaataatgaaagctttatggaaatagttaaggatgatattcaagacagcaacataggtcaacagatacaaagttacggttagataggaagaatgagttctggtgttctgttgcacagtagggtgactatggttaatattattatattgtaaatttcaaaatagctaggagagaggatctgaatgatctaacaacaaagaaatgataaatatatgagatgatgaatatgctaaacataccgatttgatttttacacaacatatatatgtattaaaacatcactataagtgtgtacaattataacatgtcaataaaaacaaaacacaataaataaatttgaaaaaagagaacaatgggaagtttgtcatatatagcaaattgtatgttctgtcaaaactctaggctaaagcattttttaattattaattttttattaaataaaattaagttattaaattttaaaaaatacgttgttgactacttattaagtcaaatgcaaactgagcaagacagggagactcaaacttgtgagcacactattttcttgcattggaatttcatgaaagtgatactgtctaggatcactgtccacacactattccaccaaacaccaatcataaatttggttcaagttaatccaaaagattcttgaactcttgcaaatcagacactgtcatacctccagtatccaggaggactcattaggtgttaacaattaaggttttccaaatttttaaggggatcagaggagggtgaaccagctagactccacggtagacattggaagtctgaaagcagaagagtattcctcttcaataagccagcccatctgagattaggctctagcccagccaagataccatttaaaaaaaaattgtgtgtgtttactcaacaagaaattttaatcaaaataaaacaattgagaaaatgaaataactaaaagttactgtgattccaatgaggtcaagaatcatttctctcaaatataatttcaatagtaattatgcgcttcaataaaaaatgaatttacctctacctattggcccaaaacttttctctaataaaaatgtttttctaataaatgttctacattttctatattctctaataaaattgctatatcttagaaagaattatatattcataaatacattttatcacattttgatgtttataaaaagagtatggtacatgaaaataaagtattcattcttctaaaaacaagtgtataccactctaataagtgaaataattatttaaaatgtaaatagatccatggctgacctatcttgtcaatatcctagacattcattcagaaacaccaccaatagcagcaaagactgcacactggacaatcaaatatgcaccattcatatagaatgagatgttaatgatgttcattggtgtcgtataaaactatgactctacataatcaatgatcaatgattgatagagattgtgctgatttgaataagttattctcttttttttctgacattataagggcattaactaacatagaaaacatttctaagccttcctatctcttgatttgctgataagtgccaactgtgtgaaaggagctaagaatataaattcagaaacagccttttctcttcagcagataggatctgttcattaaaggtaaatattagggcaaaatagtttgtgtgagatgtcagaaaaatggtggtgttctgttgcacagtagggttactatggttaatattattgtattgtaaatttcaaaatggctagaagagaggatttgaattttctaaccataaagaaatgacaaatgtatgaatatttgtcaaatatttgacaaatatatgttattcaaccatgttatcatctattttggatttttaaactgctttttaagaaggtgataatattaaaagcactgattaatgaaaacctaagattatcagaaaaaaatgataagaaaaatctatgtgtgtatatgtattttcttttaggtcaaagtcatgtaaatagttgagtagtttgaaataatgttcaacccaatgaacactacttttaaaaatgtatgcaataagtggtccacttagtggtatctttgcaatatattttcttttacaatctacttattattttcctggcaaatgtgtcatttagaagtatcccctccaggaacagttgagttcaatagtttgagctgcccagagagacaaacttgttttgagatcaaattcaaagtcctgggaactgcttaaaaggctcttggtccaggttacctggctgagtagaaaaacaggtaagtagtagaacttttgccaatcagatcagaaaaaattccataaagacagcaaagtgatctagaattaaaaataaaacaaagcaaagtaatcccacaaccaataatcctaagaacatcaaatgcttatgtcttcccttctgaaactaggctccctccagcagtaggtgaactttattaaaaagtctctggcaagtaactcagtaatcaatttgtattaaagctataggcagcagggataggaagaaaaagaatcacatcatcaggaactttaagaaaaatctattttgaagagcataacctaagtgtgcatgttcccagtaaactcttaaaattattagctggtcggtagaagttgtagttgcctagcaatgtcctttaacttacttatttcaaaggttaattgtgaaaatggctttcattaggattcaagagtcaagaattttctttactataattatggtctaaaaaatgtccagtttaaaaaaaaaaatgacataaacatagaacttactgccgaaatactcttggagaaaagtgagtaaattttccaatttacaaataacaaaactgaggcacagagaaaccaagtgtcttctcaatgtcaaacagatgggtgcaggcttgtacttaactctattcttagtgattttttttttctatacaacaaaaagctaagctcaaatgactaattcttatttagaaaaataaattataattcacaaatcaaggtctcatttcaatcattttagagtttttctaatgatgcttccctagtctgatttggggaaagtttctataatgacacttaacagaaatgattcactcacattctgacatttttagagtctatcctgaatctttaaaaggtgtgaggtatctgcaatgctttattgtaaacatcctctctaagcagccatccaagcctttggcttattctgaagcttctaaattgtggaccaaagctacagaagacaaattttccttatttttaccacagtcacttttactctataccagaaaggctttatgactttttggcagtgacacttctttttgtccttagcaatggaattaaatccttaatacaaaagaataggtatttattttgaattatttgcatcgcatagttaaatagaagggaccatgcaaacaataaaatttgtagtaattttaggctaaaaccagaaccttaacttttgtttatttcctaatgttagttctactcatttatcttcttcctgcctatctgctatacttaagtcattctttacctgactaggccctcgtcaaaaccatttactaattattttggactggaacagaagggaatattagtttttgactcagaaattatctcagactaagctctaactggatttacctaggcattcacaaatgcaatacacattctcctctcaaagtcacttttacttctgctggtttaggcttctctgctgcaccttgatttcttttgtcatgctttccacattcattccagccaaggttaattctcgcctttcaacatccactaacttatttttaatttttgaactattataatatatgagaattgtcttttattgaaatatccattttaaaaagtatgcatcctgaagaaagggatcttgctttaattctaggtatccttataaaaaattatgtgcttttattcacttactaattattaataatgactaatacactcctcaagctaagtcaggaccactgattcaatgatgaataccataagactcctgattctgaaacaagcataggaaagatttatttatgtgatccatcccatgcctacatccatcagcatgatggagtatctgcagctatataagaaattggaatgatttcacctaatacaacaatctcagataaggacacagattgcctaaattattctgataagaaaaaacatggtcgacttagttatacctgggtaagaaataagtattatgaagagacatgggactcctcaacctggtaatggtgatcacatgaaaaggagcaccagatctcacagttcacttgaatagcatagccaaaaattctgcatattttacagggaaaagctggatataccttgctagtcctcaggctttaatgatttattaatactcagagaaatctgacagatagcaccttaaccaggtgatcaaagctagcatcaccagtaatgagacatatcaaattcaggttctccaaatatggtacactgaggacactgcaacattctgtgctatttttggcaaaaattcacagtctcagttttagttttccaaaaatgcatagtctcaatctaatcataagaaaacatctaacaaacccaaattgaaggacattctagaaaataactggcagcactcatcaagagtcgagggcaggaaacagagaaagactaaggaactgtcctagattagagaaaactaagaagatatgacaacttgatgaaatgcaagatcctggctttgatagtggaccacagaagagggcattagtgggacaactggcaaggtttgattaaggtctgactcttacttaataatactacattaatgttaatttcctggttttaatcattgtactctggatatatgagatgttaacatttgtgggagctaagtgaagacacaagaaggctcttttaattttttataacttttttgtaaatctaaaatttcaaaataatttttaaagataaatatattagtcatgaagagcaatttagaatctctctcttttttattgagacagagtctcattctgtcacataggctggagttcagtggctcaaacatagctgatttgcagcctcaaacacctgggctcaagcaatcctcccatctcagcctcctgagtagctggggcttcaggcacatggccaccatacttggcgaattttttaatattttcttagagataaggtctcactatgtttcccaggttggtttcaaacttctggcctcaatagatctttctgccttggcctctgaagtgctgggattctgggtgtgagctatagtgtacaatttagaatcctgaataagattcttggccatgggaatttatgcaagagaggtagcttgagaaacacctacctcttgaaatgaagtagagtttgagattttgtttggctataaaaacaggagagcatttagaggtgggcagaagacatttaacttttgttctacctaataaatttgcttaacgcagagctctttgtaaataaatcattattaagtctttaaaatgaacatattctaaaaatgcaagttaaaatagaaattgcctaagtagagtagtcaactctgggatcagttcacccaaaaagacagacaacttattcattcatttaattcttttatcataatgtcattgtaaatatcattgaaattcttatgaaatgttttccagtcttaaaaccatgtagatacatagttttaagtcagaatacatttttcctgtcttgtaattagaacttcttcacattagtgtgagctaattccttccctaagtttggaatctaagagggaaactagtgtaaacaaatacttgtatgtgtagaaattggcatacgttttgggctgggtatggtgactcacacctgtaatcccagcactttgggaggccaaggcagaaggattccttgaggccaggagtttgagactagcctgggcaacatagcaagatcctgtctttacaaacttttttttttttttttttaattagctgggtgtggtggcacacatctgtagtcctagctacttgggaggctgaagttggaggatcacttgagcccaggagtttaaggctgcagtgagttgtgatcacatcactgcattccaccctggacaacaaagtgagaccctttcttaaaaaaaaaaaaagaatgaaatattgtggttatgatgaaaaagatgattcaaaaggcaggggatggtgataattatagaggaaggactcatatctcttctaataaaacaagacaaaaaaatcctatgagagatcacttttagatttcttgaaagtttaaaaaccagatggcttagagaggtggcagggaaaaactctaactcaaattaatgagtggggcattttgacacaaacaaacaaatcaacaaaaaacaatgcggagacaacagcagaaatatattgctggagacagaatacaaaggcaataaaatagtataatttaagaataaaaacatctgtatactcaataaatactaattaagcatttactatgtataaagcaccatgctagatcctgatgatgataaaaaggtgtgacatagctctgaaatccagctttttctcaactatcatgacccatccaaacacatgtcatttctttcctttctttttttttttttgagatggcgtcgcactctgttgtcaaggctggagtgcaatggtgtgatctcagctcactgcaaactctgcctcccgggttcaagctattctcctgcctcagcctcccaagtagctgggatcatagatacgcgccactatggctgtcaaatttttatatttttagtagagatggggtttcaccatgttggccaggcttgtctcaaactcctgacctcaggtgatccgcccgtcttggccacccaaagtgttgggattacaggcgtgagccaccgtgcctggcccagatttcatttttgaatttctctttcatatttccattcttaataccatccgcatcaagttaaaaataaataaataacttttctaataaatactttactgactgacttgctttactgacctgctaccttcttacctcttaatttaaatctcttttataaattaacatcagtttattttttgaaatagtattgctaattgcttctctattcaaagaccttcaatgattaagtgactgtctcccaaattaagaatttatggtaacttggactaccttatgtacaaaccaaccctgtacttcaagcaaactggagaatttgcttgtctcccaaatactcccaaattattttcatagaagataaaatttaatatggctctgaaaagataagagcaaattttattggcaggattttgatgaggaaaggcaaaaaggcacaaaatttggttttcaggagtaggttgtagatccacttatataaatggaaagtcactttttaatattttttttttttagcggaagctgatgcatttttaaataccactatgtcttatctctttgtctcttgaattaaatctccagataaatacagagcacaaatcacatagtagaaattaggactattcaaggtcagtgttaaaaagagattagataagttctagtatcttagtttattaaaaattctatgaaatgcaaatttcctttaacaaggagtcacataaattcacaaaagtagaaaaatgtaatattaatgtcataagaaagactgcacttagtaagtgtcttggtgatattttgctatttatcataaattgtgtcattctatctttatgagaaataaaatcatttctcattttttcaaaatttaaatttaagtaccgggatacatgtgcagtacgtgcaggtttattacataggtacatgtgtgccatttacctatgtaatagatattgtattacatatgtaattgtatatttattacacattgcatatgtaataaatttattacatatggcatatgtaataaatttattacacattgcatatgtaataaatttattacacattgcatatgtgtaatattacatattgtatatgtaataaatttattacatgttgtatatgtattacatatgtaattgtatattgtattacatatgtaatacaatatgtaatagatgcatctattagcccatcacctaggtattgagccccacatgtgttagcattcatcctgatgctctctctccccctggctccctgacaggcaccactgtggtgagctccccttcctgtgtccatgtgttctcattgttcagctcccacttataactgagaacgtgcactgtttggttttctgttcctgcattagtttgctgaggataatggcttccagctccatccatgtctctgcagaagacacgatctcagtcctttttatggctacatagtattccatagtgtaatgtatcacattttctttatccggtctatcattgatgggcatttggagtggttccatgtctttgctgttgtgaatagtgctgcaattaacgttaagtgtacgtgtatctttataatagaatgatttattgttctttgggtatatacccagtagtaggattgctgggtcaaatggtatttctggttctaggtctttgaggaattggcacactgtcttccacactggttgaactaatttacattcccaccaacagtgtaaaagcattcctctttctccagagcctggccagcatctgctgtttcttgactctttaataatcaccattctgactgctgtgcgatagtatacgattgtggttttggttcacatttctctaatgatcagtgatgttgaacgttttttcatatgattgttggcagcataaatgttttcttttgacaaatgtctgttaatgccctttgcccagtttttaatgtttttttgtttgtttgtttttgtaaatttgcccaggttccttgtagattctggatattagacctttgtcagatggatagattgcaaaagttttctcctattctgcaggttgtctgttcactctgatgatagtttcttttgctgtgcagaagctctttagtttaattagatcccatttgtcaatgtttgctattgttgccatttctttttatgtttttgtcatgaaatctttacctatgcctatgtcctgaatggtattgcttagattttcttctagggtttttacagttttgggttttacatttaagtcttttttttttttaacttttttaaaattttatattttaaatacattttgtccttttttttttttcttttttcttttctttttttttttttttttttgagacagagtatccctctatcacccaggctggaatgcagtgcgtgatcttggctcactgcaacctctgtctcttgggttcaagtgattctcctgcctcagcctcccaagaaactgggaatacaggcatgtgccaccacactcagctaatttttgtacttttagtagagacagggttttgccatgttagccaggctggtctcaaactcctgacctcaggtgatccacccacctctgcctcccaaagtgctgagattacaggtgtgagccactgcgtccagcacatttatatctttaatccatcttgagttaatttttgtataaggtgtaagtacggggtccagtttccattttctgtatatggctagccagttttcccaacaccatttattaattagggaatcctttccccattgcatctttttgtcaggtttgtcgaagatcaggtggttgtagatgtgcagtcttatttctgagatctctaaactgttccattagtctatgtgtctgtgtgtgccatgctgtttggttactgtagccttgtagtatagtttaaagtcaggtaacgtgatgcctccaggtttattctcttcatttaggattgtcttagctatacagattcttttttggttccatatgaattttaaaatggttttttctaattctgtaaagaatgtcaatggtagtttaatgggaatagtatttaaactataaattgctttgggcagtatggccattttcatgatattgattcttcctatccatgagcatggaatgctttttcatttgtttgtgtcctttcttgttttcttgagcaatggtttgtagttccccttgaagaggtccttcacttccctctttagctgtattcctaggtattttattgtttttgtagtaattgtgaatgggagttcattcacgatttgactctctccttgtctattggtggtgtataggaatgtttctgatttctgcacattgattttgtatcttgagactttgctgaagttgtttatcagcttaagaagattttgggctgagacatgggggttttctaaatataggatcatgtcgtctgcaaacagagacagtttaacttcctttcttcctatttgaataccccttatttctttctcttgctcgtttgcactgaccagaaattccaatacaatgttgattggaagttgtgagagagggcatctttgtcttgtgtcagttttcaagaagaattcttccagctttttcccattctgtataagatttgctgtgcatttatcataaatggctcttatgattttgagatatgttacattaacacctagtttattgagagtttttaacgtaaagggatgctgaattttatcaaaagctttttctgcgtctattgagataatcacatagtttttgtctttagttctttttatgtgatgaattacatttattgatttgtgtatgttgatttcaccttgcatcccagggataaagccgacttgatcctggtggataagctttttgatgtgctgctgcctttggtttgccagtattttattgaggatttttgcatcagtgttcatccaggatattgacctgaagttttctttttttttgttgtatctctggtaggttttgatgtcaggataatgctggccccataaaatgagttagggagaagtccctccttttcaattgtttggaatcatttcagaagaaatggtaccagctcccctctgtatctctaggagaattcagctgtaattccatctggtcctgggcttcttttggttggtaggctatttattactgccttactttcagaacctgtttttggtctatttgggaattcaacttcttcctggtttagtcttgggagggtgtatgtgtccaggaatttatccatattctctagattttctagtttgtttgcatagaggtgtttatagtatactctgatggttggttgtatttctgtggggtcagtgatgatatcccctttatcattttttattgtgtcaatttgattattttctctttttttttattagtctagctatcagtctatctgtcttattattttttttcaaaagaccagctcctggattcattgattttttgaagagtttttttgtgtctttagctccttcagttctgctttgatcttggttatttcttgtcttctgctaccttttgggtttgttggctcttggttctttagttcttctagttgtgatgttagggtgtcaatttgagctcttcctagcatttttatatgagtatttagtgctctaaatttccctcttaacaatgctttagctgcatcccaaagattctggtacattgtctctttgttcatttctcaattttttaagtggtggttttatgcttagtagaaacagtaacagcaaaagaaataaaaaaatataactttggtttgtttgtttactcattccttatctcaagcctactccaacagcctatgaagatggcagtaagagtaaagttcagccatttctgtgatttatctatccacatttattttttttgtagacactgtcatgctctgctgctctgtcacccatgcttgaaagcagtggtgttatcgtggttcactgcaggctcgacctcctgaactcaagagatcctcccacctcagcctcccagatagctgggtctacaggcgcacactaccacacttggctaatttttgtatttttttgttgagatgtggttttgccatgttacctaggctagtcttgaattcctgggctcaagcgatccacccaccttggcctacgaaagtgctggtattacaggtataagtcaccattcctggcttatccacatatgtttataataacggttataaaaaacaaacaaacaaaaaaaactggaaagttaggtcacttacattgacaagaaattgtgggtatctgtaagatttataactcaacgatataagattttttaacccatgaagttctttggccaattaaatttaacaaaggaaatggattttcaagtgaaaaagaaaagaaagaggttctctatggagaattttacattttaccacccatgtgaagattataactatgtatgagagtcatttttgaagttgaaataattgaaacacaagagcacggattaaagtaccaaatcagacatggggcaggtaagtgtcaaatcttttttcttttgtatttggttcaaaaaattctatctttctagactaaaattacaaggtggttccaatttgcacatcagatccttgaacactcaggtccccaatctcaaaataacctcacatttgaaacatacgtccttaagctctgaagtgaaaatggtggagaaaaacctataaaacagaaaggatagaacactcagaggtgaagcaggcttccaacttaaaaattcccagttctagggtcattttaaaaattttaattcattttaaatgggttattgtattcaaataaagtttgcatgccatctgttttcaaagtcatttaaattaagttttatgactcatgaggaagagaggccatttttaacacattatagtctgcttattactatcattaactaattaaaattaattattaagagtgattccttttgctctcaaatcttctagatcatttatcaaagaatgacatgactttctcttccttccttggaatactgaagtcacagtcatatgacttttgggtagatgctattgaaatgatgattttagtcagatgtttaacagtaacgctgtctaaaagctacatttaaccaagagagcagtatttttgaaacagcaggcagtataaaactgctttgtgaatattaacatattctagcaaattagtttgcactcattatcataagcaattgcttactgtttagatgcagcttgtattaaattggcaagcaatttgcaagaattaaaacataacatggagagctttctgaaaactcagcaatatcctgggagaaatgatgctactaggttcacagaccatgtaccaaacgtttttacccattaaacatatttagcattagaacaatagttggttggctacataggtttttaatgtaagatcattttctaaccgctgtttggacaccatcaacagaattttatatatcagacatttaaagactttgttttaaaaagcctgaggagaaagtaggaaggctttgttttctaaaaatgaactagctatcaatttgactaaattttgatacttcaataacctattgcattgtcttgagttactttatgctacccaatttgtccctttcacaaagtttctgttgtcttgatcattctttccatttattcctgagttggattctgctgatgtttacccctatccactttactttctttaataacagaacttttgagtgtcagctgagcagatagataactgcgtagagcctacatttcccattctcttttacagcttgaagggtctattgactaacttctggccaatgagagatgagcaaaaatgatgtgtgtttattctagttcagatcctgaaatgtgtctgcattctcctgcccatttccctctttcttgcctagtgatgacaaaattgaatcagctgcttcagacttcgagatggaagccaaaggttgagaactgtacaatcctatcctaggacgactgaaatgtgactattatgtgagaaaaaagaatcttatactgtgttgagagatgagtatttctgggtctcatattgacagcaaagggtgtttatccaggctttgaaaaaaatgacctaacatttccatgtatttttttaaccttatgaggcaagtaaatttgatagagaagctattattatctccattttatggatttaaaagagattaatattcaaagagctaaaattatttgtccatggtcacaaagtaatgtaaaactttttctgtcaaaaccttccacaggaggctaccgataatctattacctttttaatagtaaactgaggttacctaccctgaataattctatgggaggtcacatgtatttatggatttccccattctgcaattctttgctccttaagaaaacaaaatttgcaaaacacagtaaaggatattgcttgtaatatgaaacaaagttaaaataactgacccacacaagcccctcagcttgaatagacagcatttactttagaaaacttttaaatactttctccaccttttgagatttaaatcttctcccagctttttgccagatttacggcttgaaaatgtctttctcaagggcctaggagtcatctatttgaaatgtaatcatcaaggaagacagtgctctgtctaccagtatctgaaagggtaagagcctaacctctggaagtgccaacgagtaattttttctgtactatacatataataaaggactaattaatgggaagttggataataaagaaaagtgtaatgtattaaaatctgtacatcagcaaagaaagataatttaaagagtatcgttaaagtgctacggagtactgagaaaagagactatccaaaaacaaatctagtagctagttttatggtttttcaaatgataaaattaaaatataaaacaaaaaatttaaattttttattgataaagtatctgcacaattttttttttggtttcccagtgcatataaaggttgtttatactataatgtagtctatttaagtatgcaacagcattatgtctgaaacaaacaatgtatataacttaattaaaaaatactttattgctaaatcatctgagcctttagcaagctgtaatatttttgatggtggaggatcttgcttcattgttgatgggtgcttactgattagggtggtggctgctgaaggttgaggtggctgtggcaatttcttaaaacaagacaacagtgcagtttgctgcatcaaatgactctacacaaaagttttctccatagcatacaatgctgtttgatagcattttaaccacaatagacttctttcaaaatttgagtcaatcctctcaaaccctgctgctgctttttcaactaagtttatgtaatattctacatccattgttgtcatttcaacaatgttcacagcatcttcatcaggagtacatttcatctcatgaaaccacatttttcattcatccataagaagcaacttctcatttgttcaagttttatcatgagattgcagcaattcagtcacatgtccaggcttcactcctagttttagttctcttgctatttctaccacatctgtagttacctcctccactgaagtcttgagcctgtcaaagtcatctatgaaggttgaaatcaatttcttccaaattcctattagcactgatatttttaccgtcttccctgagtcacagatgttcttaatggcatctagaatggtaaatcctttccagaaggttttcaatgtactttgtctagatacatcataggaatcactatctatggcagttataactttataaaatgtatttcttaaataaggcttgaaagttgaaattactccttccttgggttataaaatagaagtgttatcaaggataaaattatattaatccccatgtatatctccatcattgggtgacaggtgcattgtcaatgagcagtaataatttgaaaagaatctctatttctaagcagtaggtctcaatattgggctcaaagtgttcagtaaatcatgctgtaaacagcatgtcattcactctttgctgtttcatttatagagcacaggcaaagcacatttagcataattattaaggaccctaggatttttagaatggttaataagcattggcttcaacttaaattcaccagctgcattagcccctaaaagagagtcagcctgtcttttgcacctctgaaaacaggcattgacttttctccttttcagctgtgaaagaagaagatacctacatggcatcttcttcaaaaactatataaagctgttttgtctacactgaaaatctattgagtatagtcaactttatcaaattttagctaaatttttttttataacttgctgcagcttctacatcaggactgttgcttcaactgacctggaaggggagtagaagatgtgccattcactcagataggaaacatcagagaagaaacatgatgcttaagtaatataaggggtttgttatgttagaatttagctaccttcctccaggtaagcataccacatcatctctacattcctacttagcatactgaagtgtacatggaagacttttttttagtatcctgctaattaatcaagtaaataattaagaagacatcttcaaatgaaaactctgccctcttttgtagatttttgccaaactcaaagttataaacacaattaactcctcatctcttttaaaatattctccaaatgtaatatttagctttcaataatacctttccatgaaacacacatgaattggctttatctgaatatttgcagtgttccccttttttccaaaaatgttaagaaatcattttatgaaacaggtttcactatactatattgtcccaggatgtcatttgcatgtttactatttggttttctaaatacatttatcggtacaagttattgtacttagttgatctgcttcctctactcatcaaggtggtttatcatttgtggtgcataggtgagcaataggatctagtgtaacgcgggcttaggttcaaacccctgcatgtacagatgaaattgggttatctgcacttcttgtacctttcaatagtgggaggagagaaggaaatccatcactactggaaaatatgctctgtactctatcaactctgttgaccctcagcataaaatattttaaagcatttccctaacaaacaactctagttagacaatctgtatcataaccactacttttatctatgagacccctctgtctcttagaacatagtggtcatgggtactggtagcccatatgatgcctttaggaaaatagaaaaaaagcaaatctccaaaaccctctacttctgcctattgaaaattttcatgatttttgtcagaacaagacatttgcttgatatttcctagaaaattgtcatattaaatatgcaactccattgtgaaaacagtataaatggtgccaccttaacaagtgtacaacttgcacaaacatccatggcatccttttagtaagatgtaggaaatgattaggttttgggttaagacggagactcaacacatttggaccctgttgttctattggaatacaaccacactcctcagagggagaaaatgcaagagacacacaaaagaaccataattcctattcaatcactttttttaatgcaaagcaaacaccgatgacaaaagaagttcaagctttttttttttccgttttttttttttttttttttgaaagaagccgtcttacagagttgaaataagattagtcacagacctaacctgtagaaatgaaatttctgaaaaggaagacagtatcagagcagtgttaatccaagatgtatgaagaactaaaccatagcagcttaagccatatatttgaagcacagatttcagcaagacaaaactgtgacttgaaaaacgagacactcaaaatcctcaggagatcagtctcttctcctgttcctctacggctcctccaaagtacagattcaattttgagtcaggttaaattgggggctgaagtgggaatatatggttaatgaattttgtacagtcttccttcttttcaattgaaaaagaacagagaaaaaaaatccctcaaaaagacttcatgggttttactaagtctttccaacatttccccccagattgatttcagatcatgtagagacaaccagactgctaattaaactattaactctttcttctaaattgcaaatctttgagcatttacactgtagaagccacctcactaactctgaagccccgaggaatatagactttccatagattgggagggaagtaacatacacattaccctaggccaaatttgaccctgaaaatgaagtcatatgcactaactctcaaaatatttaattatttttcccagactttgcttaacaagtgtatataacaaggaaagcctctaaggtacgctcagagagattcattttctcctggagttaaattgaaaggtgacacaatgaaagctctgttatgattcttttgaaagcagcaagattatgttctcagccaatgtaatgtatagctgacacagaataaagtgttggccaaaacagaggaaatgtgctgaagtccaaagcctccatagacttaagtcacaagacataaatatacttatggaactctaatgccctaggttattgtataaaagtgatatgtgtgttaaatttttaaataaaccaaccaaaacagtgtagcaaattcagctccaaaatagattcctttaattttgaaagatatgttaacaatatagaaatatgtaaaaatactatttcttttatataaagtgaattctttacctcttccatcagagcagtgtctacactctaaattcattaataaattctccttgtcctatgtgaaaatgagtaaaaaataagattgcaaatgtggaagttctcaaccttgaatcaggaaactatagatctagtcctaattccttgctttgtgactttgccaaagttattgaaactatacaataatcctcattttcttcttctgaaaataaaggagtttttccaggtaatttatatgggcatctccagctctattctgagtttaaaatgtcactccaccaaagccggcgttaaccttgaacttgattccagagtacactgagcatgaagtagaaagttaaatttatcagtgaggcaattcagcagacaacatgcaatgacttctttggtttatatttatttcattcttatttgactttcaacaaaattgcacagaatgttttctgtattttatggctgtgaaacaacacagtagaggacattttattttgcctagcaattctttctatgattaaaattaagacataaatacagaagaattgaatagtgtatgggataagcactgctagcagttaactttttaattttctaaaatcatataccctacatggctgttctagcaactccacccaaaatcaatataatacaaaatccatagaaatagtagtctaaaaccagttccaggtttattagaacctagttatgtaattactgaggtcttctctttttaaatctataattactactgttatactaaaaaggttgggttaaatgttattaggcaaaaccaccctggctgatttgttttgtgaatacatgttaagataattcctacttagaagaacagaatcattccaagctgaaattcttatgagccttagtaggttctattgtcataaatatgactcagatccagaaagggattcattaccctattctagcagtcaattttagttgtgaaaatataaggaaaagtcaaagcatattctctacagatgtagctgcagtggtgtcattttcctccatgcttctggttgagaaaaaccaggcatcgcctcaatggtccacagattattaattcccattgtaagataatcctgccaatgttcaccaaaattatagccatttcttcttttgcatgtgttcttatgtgttggagtttttggcaaagaatttaaagtccttcatagatacccagttaaataatcctattactcattccctggtagattaataccttttgaaatgcccttagacctttcacatcatggaatagaaactcatgttttcttctgagttacatgacagtactccacacactggctgaattttgtctatcatctcactttttctttaaagcactaattggagactacatggcaaggtgatgatcatttttaccaagaggaaaacacacatacacacacacacacacacacacacacacacacacacatacacaaacagcaaatgacctgttcagtgtcataaagttggtgagcaggaggaacacataggtgttccttctgttatttattcctcagatttgaaagttctgcccttcatataactgtcccatactgaagcagtagaaccaatgtacttatggtaaggtggcactgtgtgtactctcaacaaatgttaattaaatggacttagggcaatctcccctctcacctatttgagaggtccaaatgacacaaattattatttttatataggtagctattaggtcttcaaacacatatgaacaattctgattgggatcattcatatgttatatataacaaataggcttaattacagttggtcattaaataatatatctactgcagaaactgtggaaagtacaaaattaaaaacatagggacttaaaacaggtgagaaaatttttaagtgatttgaccactgaaggtgaaggaaaataaataaagagaagaataaaaacaataagaacaataacattggttcaagaaatcagagtatgcatccttttagaggtctccaagctgtctgtgccttccatcttaacacctagttcaataacacgcctgtttagagggtggcagctacattcaaaggagtcaacataactttgtatcactctattgattggctatttggcttgggaccagcatagaccagaattggtctagaggttgctctcttgctttggagatcatttagcaagtgacatcgtgtgaaatcaatggcctgttactgctttcatcattctcaagttcagtatcataagggtccttaagatttaatgaacctagtctgttgagtgaagctttcaacctgctatatttcttctaacataccaaaatggcttgtatgggaaatgattactatcttatgcagtaggactgtgcaatctaagacttatcaattaaggataatacggcagtaagataaacatttaaattagtttttcaataagatgtgtatttatatattttccttaaagaaaaacagtgaaacagctctctactggctaaaaaaaaagaaacaaagaaaatcagtcacaattgaacgcacacatacgcacatagaaacagaatagataacattgtagaacagtcgctaggtctctggagattcattaacatttcatatccaaggagactagccattcattccttctaaaacagaaagcattttcaaagcaatatccatgtacaggtaaacgacaaagcaatcattttgaaagaaggtaaattacggtcagatgggtagagaaacaaggaggaaatgtcagacattctcatcagcagaaagaggcaacaaacagcaaaatatatatcatatatatgttaaatatatgtattatatatctatgtataataaatcaatgcaagaggtgaatgagaagtaggctgtcatgttctccagcacaaggatgatctccctaagtggtacaatgaaatgaagaaactcccccagaatattataacacagttatatgtcaattttcttaacagatttttgagtgttctgtacacacggcaggaagaacattgtggaaacatttcagtaaagagttataatctaggcctctgtctcttggagacaagaagtgggaacaagaccatgagtctcatatcaagaccacacatctattttctttggaataatgtcatcactaggaccagcagaagcttgactaatcacatgtgaaattaagtcaggggtcctagattttttcaagaaaacaacaataacaaaataggagtttaaaataattgatgggtatagcgcccaaagcattaattacatgtagaaaggttttttaaagaaaacctttaaaatttccagatgccagaaaattctttttttccaaaaacatttgatatgggagtttaatagtatcatatgaagaagtatagaaacttctccatttctgggggacttttcatagagataggccaactcaccaattctaggtttcctcatggtgggaatatatttgcttactggtaaaaaagtcttgggcaaggacaacaaacaccgaaaaaaaatgtgtactctgatctgatcttgaattcccagaaacaagcaacttcctgttaattaatcctagcaaggccagagactcaggaaagggcagctcttttctacgtgagattaaaactctctctacatatattataggtgcaccatcagaagagactggtctaagggcttatcataaagaggggagagtaactgcactgctaatctctccaacaaaagtgctactgtgattacatcatgacactataaagacctggataagtgttactgtattaccacatgagttactagttcctggacagaatgcccaagactgtttctgattcatttttgtgaaactacttccaatagcaacgaacaaagaagaaaaatacagaaaccaaaagcaagacatagcacaattcttcaggtaccaatttactttatcaagttttcaccttataaaaacagaggtgatatttggacacaagaccagaaaaagtcatcttccgagcatatgtcctcctcaccacactcattcacacttaagcaaatacatttcacccagggttcttggaagccagcattccacatttagaaataatttctttggcttaaagattggctattcttacatcttcaaatgcaagagaggagcaagttaaagctagaaaaacggtcacacaaagatagaggtttgaggaccaattttttattttatttatttctttgttattattattattattattattattattattatttattttttttttttttgagatagagtctcactctgttgcccaggctggagtgcagtggcacgatcttggctcactgcaacttctgcctcctgggttcaaccgactcccctgcctcagcctcccgagtagctgggattacaggcatgcaccacaacgcccaggtaatttttgtagttttagtagagacagggtttcaccatgttggccgggttggtcttgaacgcctgacctaaggtgatccacctgccttggcctcccaaaatgctgggattacaggtgtgagccaccactcctggctgaggatcaattttgagatcacttgactccagtttttccaagaaccaccctgaaatggacagtgtgaattcaacataactaaatatatattatatactataaatgtatatataatgtttataaatttttatatatgcattatattttattataattatatattatgatataactctataatatatataatttttatatatttagttacatataaaatatatttatatatgtatataaatacacacacacacacacacacacacacacacacacacatattttctttctagaagaactaaggtaaagttgcgtttgaaaatggtaataagagtgtgtggccagaaagaaggaagcagcaagttagttgtcaataacactggccaaggcaaactctgaccctgtctactttccagcttttgtctttcctcgatactgctttgcctaacagactcttccctggcattaatgactccgctgtgaagaaggatggtttctagtttagtgacacaaaaagatacgtttggtatttaagaaagcataaagggagcataactccattcacctatgtcaaaattacttggataaacaagtatagaaaacattagttattcttctttattatagaaaatggataaaactaaaactcaacttcatctctgtgtacagatagcatagctacctagggaattaattatttaatttgtgcacaccttatgatcatgcctcagaaaagaactgccagagcaatcccttgtataggctactgtgattctgtttttctgaggctaatgtgctctgtgaggttgtcagaaaagaaataataatcagttatttctttgtttaactggagaggcagatgaataaagcatataagaaaggtacaaggaaaagcagcttaaatataaatacaagctagtcccatttctgactttgtgtctacctttgaccaatggtgaatgaatttccttgtcactgtttctgcattttgaagaaagtaagctgtattcatattttttctcagaaatactatgttaaatgtattagtgtatgtccttgataaacaaaatgtaaaactcagaagaagaataatgtttatggtacatatatttcttcaaagtaagaaagaactattcatttcaataatgccacaattgaaaattgagccataaacatcctgaagggccccaaagttgaaaacaaaaatgaataagactaccaactttttaactttttcagaaggatgaagctgcttgcattctttggggagcaaatgttaggcttttttcctatttaaattaccacaacattgtcacgatctgacattcgatttataacaactaatcaagaaatatttacctaatgcccatagcatatgaggtattatagggaacgaaaatcttacacactggatatttaagacccctattgagggtaagccaaattagaagtaaccgttgtataaataatgctcacattttaaaagcactttatgattttcaaaatatgtttcacattggtcacttcatttaacagacattatcttatttgaagtccaagaagagagagatccagaggtggaagtgattaaaaaaaaaaatctgtgaatttaaggccaggcacagcggctcacacctgtaatcctagcaatttgggaggcagaggcaggtggattgcctgagctcaggagtttgcgaccagcctgggtaacatggcgaaacctcgtctctaccaaaatacaaaaaatcagctgggtgtggtaacgtgcacttgtaaacccagctacttgggaggctgaggcacaagatttgcttgaacccggaaggcagaggttgcagtgagcagagattgtgccacttcacttcagcatgggtgacagtgagactctgactcaaaataataaaataaaaataaaataaaattctgtgaatttaaacctgagctggcatttgaaagaagagttgggcttgaataagaaagagaagaagccaattatgactgaaaattgctttgttctttaattttcataaacacataatttactagttccttaagtacacaaatatatgctttcttattatcctacttaggcttagtactacacccaacagtgacctggggagcacatactgaattaaccaatagggaggatttgtccttctgtatctattttgatcattaacaggacactttacaaagtagctggggagttcagagtatagctcatggctatggaatataattgagctcacagactcagggagtcaatcccttcacttaaggttcattagcctgggttccaaggatcccagggggcgattccttccttttctgaatccccatagcacacatcacccagacaatgtctgtaggacaactttagcacttcaaatgaaatattgtctgtgagatctttgcttttcaattgattcgtgttatctttgtcttacctcccaattaatctccagagctccttgtagataggaactatgtcatccagattctttatctaggccacatagcttctagccaattacttgacaaagcataggtgcataaccaatgtcttctttgtgcctctgagttgcaaacgcagttgtatatctacgttaatgaaacgatgcttcatgcctgtattttaaaaactgatgcctagacaggtgagtaatgccaagcagactatgcaagctcttgtggtttctgattatcagataagagtcgcttaatttggtaattgtgacattgtagatatggaaagtatagtaaaagccaactagtgcagaaccctcattttttacatggggaaacagacttagacagggaaagtgccttgcctaagatcacaactaatattgtgcaagaatctgttgtgggctcagcatatggtaggcaattatttcaatgaataaagaagtaccagatgtgggtcacatggtcccctggcactccagccgagaaggcaacttggtgttatttctatgagtccttgcaggtgtggaatactgtatactcttccctttgctgtattgtttctgccaaaataattgtattttgtagctgtattttcacttaaatataaaagcagctaaaagatagtatgcactgtatttcccaactttgtatttaagtccatgattacgtctacgtatttacacagattccttttcaaaatacttacaaggcatgcaccaaaataataacagattatatctggccaatggaattcttggtgactttaatctgactttttaaacatgtcaacatatctccaatattgtcatgaatatataaacaaacattaattttatagctagaagttaagtccagtaaaaatatgtttttaaaaagaaagacactacttctacacctgccaaaagcctgccgttttgcaaactagtcgagttttctcatgatatataaattagcgcaattttgaaaatgtaaatatcaattattgtgttacaaaaaaacaacttttaggatgtgggaagcagaggttctgctaacatagagtttaacattgagccttaaagaggcggaaaggtctaatttgggaaaagactcgttccttaaattttactctagtttttctttctatttccctccataaggaatttataaactcagactttaaattccattatttggacttacaaaaagcacattctgttaaaacaaaattaaattaaattaaattaaattattagattaaattaaaaagccctatctgcatgataactatcccctccgtttctgaccaaagtctcacagaacttcccccattatgtgttgaaggaaatttgtatttcaaggtacaaatgagaatgactcaaaaccatgtgggagaatcccagatgcattatatagattaagtgggtgtggtgataaaaaagattaggggttaaataaaatggttgctggtcaccatgagcctcttattttgtattactaaaattcaacctaccatcatttgtaacatgagcgtggggaaagtaaattgtgaattgcagactattttgtatacatatgaaactttaataattatagatccactagctagactgagaaacactaagtacttctagaaaatattgagcgttgtgagaatttgcttaccttaagtagtattactatttgtatttggagtcctctaaactatgcaaaaggatttaaaattggagatctttactaattaaattgtttattcatcctttctccagaaaaataaaaggtatgtctcagctcaatatatttcagaactatcagaattttgaattctaaaacagatttttcccattatacacacagtttatcgacaccgtgaaagtataacgtacaagcaaattatatatttatatgtaaaatgcatatagatatagtttttttttttttttgaaacagagtctcatttgttgcccaggctggagtgcagtggtgcgatctcagctcactgcaacctccacctcccgggttcaagcaattctcctgcctcagcttaccaagtagctgcggctacaccacacctggctaattgttgtatttttagtagagacgggttttcaccacgttggccaggctggtggcgaactcctaacctcaaatgattcacctgctttggcctcccaaagtgctgggattacaggcatgagccactatgcccggccatatacagatataggtttttgaataattgtctttcaaatactcatgccatttatgggtatgtatgcaattatatgcacaactgcatagttacaatgatataacataaatgaaaacaattcagaatactaaaaagtgttactcataagtaatatagtaaagtagtgtgaacactactggacaatattgatacaaaacacaaaaatgcagtatttcacattagcttttaggctacctgattgaaatgaccttttaaaactcttgtggagtctgataattgaacttagctaccaataatggaaagtatcatgatttaaagaggacagaatgttgtattttgtctacaagaaaaaatatattttctgtctacagaggagtataattaagatttagtagaggaaaaaccagtgataattgtcatattcctctctttcactctcagcatccaaatgatcactcaaaatggtcattttttaaattggtgcagtgcaactaagagctattttaggaatggttatttccataaaattctattctattttcttcagtcttactgaaaatggtgctttctgtctaaaccatcaaggtgttaaaacatattaggacaggttgaaacccaatgagagcaagtgacacattttaacaagattttataggtcactgtcttgcaaaaatgtaactcaaagtacatttatgggcacacaggaaaattttaacaactgagaaacctattcataaatcttgtacttattttaaattaatttattagattatatacatgactggcattgctaaaaaatgtaaacttgcctattttggtgaataacagtacaataatggtactttccttttccttcataaacaaaattttttaaaaagacaagagaaaaaaaatcaaataaaactaaagaacagccaatctatgaagaagtatttcctatggactgcactgaaacttggacctaggtaaaggacgaagcactaggtcaaaagccacccgagaggtaatggactatgcagtctgagttcctccaagggggggtcacacaatcccaaggatagacttaatatttatttacagaactcaaagtgcttggaattggggaaatgggtgtgaggacaaattgcaggagggtccctgaccttggggagcaggtctgactcagagaacacacaggctggctgttttgcatgaaatagatgatgatttagcaatgtggcggagaaaacgtagaaaacaagaagttctgtaactctccattttggtcaaccaaagagaagtacattctatcaccacaggtcagacctatgacaccagttcactatagacctaccatctgcaagtggagacagccacaggaaaaggtgttttggtaagggtggagaaagagacagtaggagaaacgtagctgactgcttctttagtttaccactactatattagcattcaataaaacttgatactgaaaacaacagctcccattgaacaactggaggtagaaaaaagtggcaaacagaaaataaataccaaaaatttttccaagatttagccagaaaatattgagaatctagtttcaatgaagtcaaaagaaaacacagattctctgaaacaagagtctgaagaagagatgaagaaagtaaaagtagactaaaagcaggaaaaaatggaagagtaaataaaactatggcataaataaaatccactccaacagttaattcttcctctttcaatagaggctcaatagatacagcataaagtgataatctccccaaaagggaacttaaatatacaaattacaagaaataaaaggaaggatcataaattttccagatttagaataaaactgcaaaaacacacagattgccacataaacacattctaaaaatgcatgctacttattaaaagagaaatttaaaaagaaacccttaatgaaaaaaaatgaatttgtaatacataaagaatttttacaaccaataagataaaacccaaaaattcaattaaaaactgggcaagtctgcataggaagttcatgaatttaagaaattgaagaaacatcttaaaaaacacataaaaattttaaaagaagtggctctaaacatacaaaaacatgtccaaccacctagtaaagaaagatcaatgaaaacgacattgaggtaccattggcaaatattgaaaagattgacagagagcgttgggcaactctcaacactgttcaaaggaagggaagtttggattcaaatacattggaggaaaatttggcaatctaccaaaatgaaaactgcacaacattttccccccaataattacatttttaggactttatcatacaaatgaactgaaacctgtttatataaatagccagtttaattaggccaagcctgcattaaagttagttctcaaatgagttaaacagtttccattttccactttcttttatttgtctatgtcttaacccaaaactcatgcaaaattttccagcatgatctctccccaaaatgtgagtagatgaaagatctggatggtttgtgttttcgagtgctattggtaaatcagaaattttttaactttaatgtgcaaatctcatttttacagtcccttattaaatttaaatttggtataaattgaaggagctcactatatttaaaataacaatagaattgaaaacctgacataggaagggcctgatacatcttaagaaaaatttagtcaagtataaccttaatatttatatacacaacccaaagtccatgttaattccacttggtattactatataaaagagattattatttatgcagccaaaaaacatatgaaaaaaagctcatcatcactgcttattagagaaatgcaaatcaaaaccacaatgacataccatctcatgtcagttagaatggcgatcattaaaaagtcaggaaacaacagatgctggagaggatgtgtagaaatgggaaggcttttatactgttggtgggagtgtaaattagttcagccattgtggaagacagtgtggctattcctcaaggatctagatctagaaataccatttgacccagcaatcccattactgggtatatacccaaaggattataaatcattctactatgaggacacatgcacatgtatgtttattgcgacactatttacaatagcaaagacttggcaccaaccgaaatgtccatcaatgacagactggataaagaagatgtggcacatatacaccatggaatactatgcagccataaaaaaagatgagttcatgcccttcacagggacatggatgaagctggaaaccatcattctcagctaactaacatcattctcagctaactaacacaggaacaggaaaccaaacactgcatgttctcactcttaagtgggattgaacaatgagaacacatggacacagggaggggaacatcatccaccagggcctgctgggggttggggggctacgggagggatagcattaggagaagtacctaatgcatgccgggcttaaaacctagatgatgggttgatgcgtgcagcaaatcaccatggcacgtgtatacctatgtaacaaatctgcacattctgcacatgtatcccagaacttagagtataatttaaaaaaagagactattgcggagactgaaaaagagatagaaggaagaaaaataaactaaaatctgtaaaaatagacatcacttttcaatataaaatgtatctcaaactttctgaagatattgcctccattttttaatctctaaaatgagcataggctggctgccaaagtccacaatgtaaatgttaacaaattatagtcaaaaatgcctttcaactacttaaaaaaaaacccataaaaatgtagttagtagtcgatgttgcctaaatagagtctcgaagcctacaatctgtaggctgtagaagtgaaccaagtcaaaatttaaaaacaggcttctgtacaacagattttctctgtatacttaactcacattagaagtgtggcatgtgttacaaaattgatgtcagatagcttagaagacttcatatgttttgaatgacaaggtattgaccatggtttctgcaaaagaaactaagcatcataaaaacagatactttaaacaccaagaatatcatcactccatttgttctgctcctttagaggtcctgtgtaattggaagtgaggctactggactacaatgttatcttttacaatgaactaccaaatttagatgtcagagtgacagttgaagaaaattgcttgaatgggaaataaatgaacagtcacagaataaaccaagtctacttgcccaggccttgtgttattaactagagggatgattactgcagcaagaagtgatagcttataaaaattctatgaaaatcaatatagatttgcagattgtaacttcaacaaagatttgatttgtcaaatattagtctaacttgctttattcagcacatgcatttctaaaattattaaagacaaatattcatgattgaaatctaaatgcaatattttttagaactcttgtttttaaatatttaaagtttcagacagaaaaaaaaaaatctattcatgggtagttgtcttcacttactatagtcccagaacataattgttgccccttgacttttattcgaagatttggcttccccacacaaaatttgtctttgtctaacacagtaacactttatgatgtcaattaataattattgattcattgagtcccttctaattcacttacattaccaatcagtagttcattttggtagaattcattccttatgtttaggtaaatgtggaaactttcttccaaatacagctccttcaaatttaaaagaaaagtgcctaatctttgtctcctggatttttggcacgtagttatcaatagaacatagtaaacatagcagtgaattgctgtataactatagtgtcaaaagccatgtttgtttaatgtgcctgcattctgccaaataaattaaattgttcaatcactgtttttgatgataataattatcatattattacccattcctaccttgcaaaaaaaaaaaaaaagcccagtctgcaattttgctggttaatttaaaccagaaactaaactgcaaaatggaaatatttaaaggaaagtagcctttgtattcaagcagggcttactcaaccatagaaacgtgagaaactcaagaacaaccacaacaaaaaaaggcttcttgatgcttcttttgattctaagggggaggtttctttagcttaattttttatattattgcagggaatccttcaccttatcaaaaccacacagctgttaaaaaataataaaaaataagaataaaaagcctaacactcattgtgcttgctgtctctttggaccaataaaaagcggaaagtatgagatgaacatgatacaagtatgtttatataacgggaagaacattaaaaggtagagtttctgcaaaaatgaaaatacctcaaacaattaagtttgttgctttaaagcaagattatagtgtagggcttgagataggaattcattagatatttaaaatgcagcaattattaagtctgtgctaggatcaagttttgcaatgggaatacttacccttggatctcagaggagaaagaaatacatccttctccattagagacctcagctacatgatagtaacttttatttaaaattttaaaaagaagagtgaccaaggtgttatacttattgtcaaaggcactttgcttccctagcgaaaacttgacaacattgtaatctttctctaacagacatgttgcaaagctgcttgccatcttgtagtcctatatgatttccttgcatttccagttctttaggaaatcccctgttttaatgatctttaagaggggaaaagacccttcaatagagaacttgctatttatgccaaatttgaaaaagtagccaaataaaaatgggctataaatgaggtctctttggccatttcaatccaatatagtcttacttctagcccccctgctttgactagggctctcatttcatgtaagcatcatggatttgatatttacctgtatgacaaacagttctacagaaggatagccttaccttttaattaacacagttagctacactatgaaagtagaaatattcgttcagaatgtaagaatgtttttaaaatattataactctctctgtataaataaatggagtttaaaacaacaacaacaaaaaaagcctaacatttgtatttagaagatacaaataactcaggagccacaaaacaacagtcgcctgttaagaatcctattaagaattctgactttttctttactttaaataagtaaataaataaatgttaaaaaatggagtataacactctactctgctgcttgctggctttcctaacaatgtgagcagttgacattgcttggccaagaggaactcaaaaaggtccgtccttccttccttccttcctccctccttcccttccttccttcctccctcccttcctccttccctctctccctcccttccttccttcccttctttttccttcctttcttcccttctttttccttccttccttcctttttccttccttcctttctcttcttctctctccctctttctctttctttctttcttagccaggagattttaaggagtcagtgtctagaccatctttgttttgatcaccaagctcagtagtcaatccatagatgaactattttagaaaaatattttcatgtcagtttgtagctggactgctttggtagcacacccattaaagcacaaactcctttaaattcacagtgctttgtgtctgtttatacaattcccaaagcataaaaatttcaggattggagctgaagggtgcacccatctttatttttctgcttttgatgcacccttcaaattgcttcacacccttctatacaatctaccttgatcagaaatatgtatttatcatactattaggggaaaaaagaaacatatgttctgagtggcaattaagttaccagcactgttaaggtcctggttattttatgtaatctaccatataactcaaaacatccaacaatattggccaaagacattgaccatagatagtgctttcttatcttttcctttctctctctctttttttttttttttttttgagatgaagtctcactctgttacccaggctggagggcagtggcaggatcttggctcaccacctgccaggtttaagtgatcttcccaagtcagcatcccaagtagctgggatcacagacaccacccaccaccacacctggcttttatatatatataatatatatatatattatatatattatatatgtattatatatataatacatatataatatatattttatatatatattatatatatatatatttagtagagatggggtttcaccatgttagccaggctggtgaacacctgacctcaagtgctccgccccccttggcctcccaaagtgctgggattacagatgtgagacactgtgcctggccattgatcatagatagtacctttaaaaacgtatctcaatctaccacttctaatctgagtgaaaccgtttgaattgggtccaaaggttaatcaagggcccctgtattttgttaatatgaactctctaaagggctttatatttacgatttgttttaagctgcttactaaagcatggtggaacatattttacctgctaaaaaatattctacaaaagcatcaaaactgaaagatgaaaattaggccttactgagaaaagaacccctttatgtccaaaacggtccaggataggctggaattcaattatagtatggcaaaatattgtgaacaggctgagataagcaacagctcgaagacttcttgggttgattctagtaaaaaattatttaaactacaaaataacttaatgatgtgtcactggcctgacaaaccattaaaataatctagaagtagagatttaattacaaataaagcacctcttaaaatattaattcctaaaataaaaatgacatgcttatccaattatatcacaatccactcatttcctcttcccaccaggctgaagtttctctttttatattttaaggcttaaaataacatgggtttaaacattttgatatctgtggcatcatttgtcagggactatcctattttgtgggaaccactcttcaaatcattggcctgtacaaaatacaaataatggtgttagtgttactacttgtaccttttccaccaaatgacccaccagttgcttatcagctgatacagttatctataaaacagccctaaggtactggtcatcatcaaatttataataatatcactgtcaacattttctgttaaagaggaaaatagatcaatctaaataataacagcttaaaagttacaaaatgcatcactataatgtgtatcttaataatgattagaatttcacataacatgctagcaaaatacttttgacatgaggaaaaaatgtttaaaactgaataagaatgtcctaaaatactgtatgcatttggcctcctttttcaccaaaatttaacttttttggttgtctgccccaggatcataatgaccatgatgattatcctagtttaggtaatttattaataaggtaatgactcattaattacaatgtttacataaataacatatcaaacaactctgatgaagctttataagtaaatcaaactgaaaatgtgctctgtgattttactaaagacagccacaaagctttaaatagtgcttgtttatagaccactttgaaagaaaaaaaattcacttcgtatctcttgttgacaaaatgccaagaatcattttcaaattagtagcgataaaatattaagtgattcataaatcataatggaaaacagaaaagttgaagtaaatataggcttgaaaatattatctcagaggggtacaaaataatttcaaatggcagtaacactaagccacttacttgaattttaaatgtgaatttgtcttgaaattgtagttcaggtttccctccaattaagaaaaagtattctattaaaaagctaagcagggcttgcataacagatatattaacgcctgtaatcccagcaatttgggaggtcgaggcgggtggatcacgaggtcaagaaatcgagaccaccctggctaacacggtgagccctcgtctctactaaaaatacaaaaaagtagcagggcgtggtggcgggcgcctgtagtcccagctacttgggaatctgaggcaggagaatggcgtgaacacgggaggcggagcttgcagtgagccgagatcacaccactgcactccagcctgggtcacagagcaagaatcagtctcaaaaaaaaaaaaaaaaacagatatattagaagtcaactattcactttaaaaatgcattattaatttatgaaatgattattaataagattgttttaaataaatgggatttcaagttgaaaatctcctgagattttctgaggttaccccatatcagaagcacacccccatatagccatgtggcatggatcctgatgaacctcagtctttggagtttaacaggctggggttggaatcccagctctgtcacttgttggccaaatattgtatttcatctattggaagctcagcctcctcatctgtaaagcgggagtaacaaaggcctaccttaaaaacgctttgaggatagcctgagacaactatggcacatcataggtagttaagtggtgattacattggttaacattaaatcagagaaaatactatgattcaggctctgacggcgctctaattgatagcttgggatctccctcccaatattctcccaagtccaaagtggacataggatgctcctattgagcctttcctgagggaagaatatgattaatgaaagggaggttttcctgtttttgtttggtttggttgttgttgttttgtttgtttgtttctgttttaaagtactggagatttgtaatttattttgaacaatgtttcaaaagggtgaaaaaatatacatttcagggaccatgttaaatggaggccaaggaaaactgtatttttattattttttattaaaaaatccataataggccgggcgcggtggctcatgcctgtaatcccagcactttgggaggccgaggcgggcagatcacgaggtcagaagatcgagaccatcctggctaacacggtgaaaccccgtctctactaaaaatacaaaaaaaaaaaaaaaaaaaattagctgggcatggtggcggcgcctgtggtcccagctactcgggaggctgaggcaggagaatggcatgaacccgggaggcggagcttgcagtgagccgagatcgcgccgctgcactccagcctcggtgacagagcaagactccgtctcaaaaacaataataataataataatccataatagtagaacaatggcaacatcacaactttgttctgtcctttttgtttgaaacatgaatgtgctatggagagccttagtgagtgaacaaaaccctctgcttggattcaaattctacctttccataactataataaagtcgcttaactttttttttgtgggattgttgaggctcaaatgagaaaacacattagaaaatatctggtgacttgacaaacatataaatatgagatactgttattattaatgataaagatgtgttcctggtccctgcactaaggaaggaagtgaggaggtccccttccacaaaccaagagctcaaagatgataaactgttcccaattaattcacaaattcagataagtaaggatcgcaaaaatgagacccagtcatctcagatttatttgttggtgcaaaatcttttagaatctgaatctgtactatgatcttgaagtttcagtgctcaagaacaaaagcaaaagtggtttctattagcagtagaaaacttgaactccttcccaaacatctttaaagactcatcatccttaaaataaacatatcaataagacagagttttaaactctatatatttggtcttgagaaaaaattttattaatattgagaaattaattccattgttaccataaaattagtcatttcccaaaagcaaagccctacttcatgcctgcagtatgaggcattgatacatttaatcaaaatgtcttacagttattgctttttagttttatggtctttgctgtgtgtgttatataacaacagttttggagcactacgtcagaagtaggaagcagaagatgtggctggaaagataggtagagcctgtatcataaagagctttatatgccatgctaaggattttgaaatttaccacttaagtgatgaggatctaccaaacagttttaagccaaggagagatgtagttctatttaattttaggcaggtcactcagtcagcaatgtagagtatttttaagacattaatcacagcctcaaactaagatattacagttgacccttgagcaatacaagttggaattgtgcaggtccacttaaatacaaatctttttcaaccaaattctgttggaaaatacaatattcacaggatataaaatctgagtgtatggagggaacacttctcgtatacctgggttccacgggaccaacagtgaaacttgaatatgcactgatttgggtatgatgatgaagaaagaggtcctagaactaatccccccaaaattctgagggactattataattaagtttgacataaatggtatagtttgggtcatactgttgacttcaagtatttctatttttatattatacttcctttcataatgggaaatcagatgaattctttgaaaatatgactcaattccaaagaaaatccaagttaaaatttttttccacaatttgttgactaattggagcagcaaaataattttgagtagtcgaggcaaacagatatccatgtgctttgagtgttggcaatatgtatcaattaacaatattatcaactctaatctcactttgaagtcaaagagtaatcaaattaaaatctttggcacaagttaagaacatagatctcttttaccatggatacttgcttaaactctttgagtcatgaataatttatctgtataatgggaacaataagatatttcacctatctccttttatttttgagacttgtaagctctgtgaaggaacactgtatgccttcttcattgttgattgtcaagctcccatgcctcctggcacacagtaggaatgaatcaagtgaatataaaaaagtattaccaaatgaaataagaatgtgaaattgttctgtaaaccttagaagtatcatacaagcattagtgctattgtttttgtttcacctattctgttattagcctccaactttttaagatgtactaaaaagacaataatctttcttcaacaaaatttaaaactaccatctctgaagatgcatttatgtgttaaaagtatttttatgcaaatgcttaagaaataatgaggagttctttaaaaattgaatctgctgcctttctaaatatctttcttgtttaaaacacaaaatacatatgccaaaatgaatcaataacttccttgtctggtacagaatgttaaggcttgaatttgaacaaagaagctgaacttagctttggatatctattataaaagatatccaaatgaagaacgcattgacacaatcgttaattagtattcattatactactcctcaaatagaacgatatcaggtctcctatatatcagtgattatttctcttagcttatccaagtttttccttttctactgcacataactgttacacatttgaatctgtaaccaggttttatgatttaatatatgctctgactgtaacacctatattttctgactaaatgcctcctgtatttcaatggacatctcctgtagcccctattaaaagtccctctccctatatccattcttctcagaaacaggctcatttcttctcaaggctagatttggagaactctaggtaaatgccaaaacaaaacaaaacaaaacgtaaaacatctttctctctctccttccctcattctctttccatgctatacttttcctaaccagagtaaagttccttgggagaagtgcttattttcttcaccttgccacatcagcaaaagcaaagtgatgcatcacaaatggtattacagattcctatgattctgagtcttcaatgcacattcatgattgagacactgctttctcttggaaattatggtgattctctgacataacactggtacagtgacctttgaggattctctgtcaacagtcattgatgaaagataacaataacatttcagttccttaaaagtggtatttctcttcatgtcttaatccaaggccgatactgtaccatctacttggaatctcttactcatcccttctcctccctttgcctaatgaacactgttcactcagcaaatgacagtccaaatgatgttcccctatggaggcctttgctggcctccctcactaggtcagggtttcccattatgtgacatcacagcatcctaattcttcttctatgacacttaggatggttttaaaattacaacaccttggggattcttttaataatggctgcctcccacaacgacatataatcttcatatggaaaaaggctatattttgctttccatcatccacgtaggggagtgtctaccacagaatatattgtagtcagtaaatgctttctcttctgtttatccttactcaccaaaccaattctagcctcctcccactcttatctacttaatgtagaaaaatcagtggggctaggcaagagattgttcttgatattttctgtttcttttcaaatttatttatttaaaaaattgtcatacaaaatttatatatttatcacatacaccacaatgttatgaagcatattcagtaacaccttgcttaacctcatggataaattactggaaactgcaactttcagcaaaaagatttataacaaaaccattttaccacaggctaattgattaaaaaaagagttaagttcctggtcacaaaaacatcaccaaacttctgtataaagactcaaaacacttctaatattaaacattgaattaaatgtgaaatatatatacatttaagaaagattaataaaaagataattatttatccaatttttggtgaatcaatgagtgatggcagttgtagttgtagtgggttaaatcaaggaataaatgtttgcaatgcaaaaattctaacgagcaccttctaaaacaaacaagaacaaacatggtgtgcccactgagtgctttcaaactgcattccttattgttgtgcatttgaaagattattgcaagctttatgaattttttattttacaataatttgtatttatttattcattcattcattttccaatccactcattctagttcagagtttgggatggttcaagcctatcccagcagctcagggtgcaaggtagaaaccaagcctggacaggaggccattccatagcagggcgcagtcacacacaaccccccacacacactcactcagactgggacagtttagacacaacaatgaacctaatgtgcacttgtttggaatgtgggaggagattggaatacccagagcaaacccctgcaaatatggggaaaacatgcaagctccacacagtggtcctgaccaagaatcattttttttccctcactaatgttataactaaaagactgagagaaacattattcaaggacctgttgtatagattgtaaaatggtcagatgagaagtatatattttttagatttttacttaaataaaaagacagcaggtagtaatttaaatgtttcagtatgcctacaatctttcagaaataacttcatgaaattcaactttacgaaatgatcttcaaaatacccatacagcacacctttcaataaacggagtttcatttgacagtgtataaaagagtttttttgaaaaacaaaaaaaaaacttgaaaaaatagcaatgcatgatggaataaggtattctcaactttcaactgttatagagaataatagaaaattttaacaaacagctacctaagaaaagatatatctctcaggtagatttttaaatatttttaaaattaacagataaaattgtatgtgtttaacacatacaacatattcttttgaagtatatatacattgcagaatgactaaatctagccaatttacatgttacctcacatagttatcatttttgtgatgaaaacacttcacatccactgtcttagcatttttcaagaacacaatgtattgttaactgcagtcaccatgtacaatagatctcttgaacttacttctcctatctaactgaaatttggtagtctttgaccaatatctcccaaactccaccaacaccacctcactcctaccccctagtaatcacaattctactctctacttctgagatcaacttttttcgaatcaacatatgagtgagatcatgtagtattcttctttttgtgcatagctatttcaattcacataatgtcccccagtttttccacattgttgcaattgacagaatttccatctttattatggctggatagtagtctgttgtgtatatatacctttttaaaaaatattcattcatccattgacaggtagaaaatttatgtaaagcagttaactagcaaaagcagttaacaataacatcttaatgtgccacagatattatgtgaagaggtagaatgataaaccaaaacaaacagccaattcatcaaatcaacaaaactagaaaaatctctgacatcctattattgatgtgagtacattaaaaaattgtgaggcaaagtgactgctacaaagttgaaaaaatacttcacataactcataaatatatagaaattcatattatcgcagaataagcattaagataaaattagaatttgcaattaagtgttcttttgataaatgggaaattatttttagctcctaagatacagcctggctttttgtaataataccattgctgctgcttcttcctcttcttcctgttatcattattttacaatatagacatgttgattttggcatttaagtgtaaattattgatgaatagaacttatattttgttgaaggtgctttgtaatttttaatattgtaaacatcatgatcatcaataagtacaggcttgcaaattacttccctacatgacttaactgagcttaatattttttcaacaagtatataaaaaataataatccagggaactatgtgctaaagctacttacgttcagtgctttacatgttttgtgtacctaggtctcacatttaatatcatttcctataatttcctggattgaaaattaatcagacagtgtcttctctttctacattcttcttctcaaaataataggacaaaaatgtttaatccttctttatggattttaacatgccattagtgctggaaagcatgaaaaatattacaggggaaggtaaccacaaatggataggagactaaaaattgacattgttgtcttccaaatgttcatataatttccattttaatgcttttgttttttagatatatttaaaggtatgttctcttctttacactgcccagagatcacattgtctgaatattagcaagtcttatttccctaagatggaaagtgcaacagagggaagatgactaaaaatagcacgtctctcaagatgtttgctttctatcacctgactctaggatgcagtcttcattagggtacaaatgtattataatggaatggtctgatttctgtttccatattttatgattctcatagtctaccacttgttaaatttaaaagtacattttaaacagatgaaaataagtgttagttgcttgctgataagaagatttaatttcccatatgttgcagcacgcttaattcatttaagaggtgatattcaaaaatattacttagtatgtattaaatttttatctttaataacctaggaagtttgctagcctattatttcctgatacatgaatttataaataatctggttatttgaatttggaatacaaagcaccctactgttgaggaaaggacctcgagggcatgtatagacacaacaaagagggaggtgaccaaaataaaagtatgtattattgatgcacaacctaaatacatctttgaggctttatccagtggaaaaaaaactcaaataaatttttctcttggatgttcaaacagcatgtaattatgttgtatcatatgaataactttccatcaaacatttactgaacaccaattttctaggagttttatttaacaatgaagctaaagcagtggttgtcaattggagaagattttacttccagggacatttgacgatgttgagagatagttttgattgccatgactaagaaagaagtgccactagcatctagtaggtaaaggccagggatgctgctaaccatcctacaatgcacaagacagcctacacagcaaagaattacccaccccaaaatgtcagtaatgccacagttgagaaactctcagataaagacataaggatgacttaaagggagataaaaatgaagaaagaataccttttgtattagtctattctcatgctgctaataaagacatacccaagatggggtaatttataaaggaaagaggtttaattgaatcacagttccacatggctggtgaggcctcacaatcatggcagaaggtgaatgaggagcaaaatcacatcttacatggtagcaggcaagagagaacatgcagggaactcccatttataaaaccatattatctcatgagacttattcactatcactaaaaatcacgggaaggacatgtccccatgattcaatcacctcccaccagtccttctcaggacacgtgggaattatgggatgtacacttcaagatgagatttgggtggggacaaagccaaaccatatctccttttaaagaggtgactgtactaaccctaactagaagagatagctccatgaattaaataatggttgaaatgagacgaaaagtcagatgcagagattgtagggaaagagcatagacaggatacaacaattgagcggctataagagaagctcgtaagaaaggtgaggaatctagggcaattcccgggtttctgcttttgatgacctagtagcaactcacagtatattgagatagggaacgtataaggagaaatagaactggatgggaagttagcttggtttgggaaatgacttagaggagaatgaataacatgtaaatggagccagttgcaaagaatataattatatatgggaatgtgtaaatctgtagagccccaaggttaatattaaaaagacaagaactagccatcaaataagttgaaattttacaccatagatattactattgactaaaagaggtagctgttaggtgcccttctcacaatgcaaatgaggagtgtggatctgggtagctgtgattacccccataatggtgaagttcccctctaagtcacttatgcaaattttagtagtaatgcttcccccatctaatattattctccacagaaatatccacttattcactgccttttcatatgaatgtgtggtataaagctggactgacagaaaaggtaccttaatagaaaccagaaactgatatatttgctaaagctctgtattatttggcttctttcctgctacatgaagtaaaggccatttcactgtattcctaaaggcaatttactattagctatgaattttcaggtaggcttaattaatcaaggtcttaaattaaattgaagtatttattacaagtatatgcatcacaaacatatttatataatttataaatagatttgtgtataatttacttgtctgcaaaacacacagtaccttactgctattgatttcaagtagaatcaagacacttggattcagtgcacaggaaggaaatatgatatctgtccattccataatcagctaacctttagcaaattcattaattttttaaaaggaaaaatataatatttagaattccaaacctcaagtggtaatcacatttcctgagacaacccagttattgttagcacttatatgctaagaaacaattagaaattaattttttagtgaaattagaatccaattaagcaagacagtaagttataatagtgagaaaatggctttcagatttgttcagaataaacgataccagacattttatctacttcagacacatgatgaaagtacaaactctgaaagttcacatttaaaaccaagaaaggagaaatcaacaggtgaagctcatttgcgcaaaataattaacgacaaatgagtagtatttctttcccataaaagaaaagattcatgtggcacttaattatttcatttacccaatacttcgcctgaaattgaagaagctctttttcaccagctgctaaacaaaagcaatttattcaattgggtttgctttgcatgagttgttctgtatataataagggaggaagaaaataaaaatgtgtaagtgccacacttccttccaaacatttttgaaagttatttgtggttccttgatacaagtcataggcataacaccaggcctgcactttattgtaatcattaaatttgtgtgatttgagtattctttcttattaataaactgagaaaataatgtctggaggaagagaaataagacagtgctagtttcctacgttctctagccagctaggcaacaagctctccatgaaggaggccaagccactggaaccacactcccactgtacagcagagaggactggagggggctgttctgtgggttcccaatcacctgttgctttggagttagaatgctggtttaggccaacatagaaatggaatttggttttaaagaaataaacaacagtggtaaaatgtccagatctcttctggacaaaacatggggccaagaaaggaatgtagctgttctagaaggcactctgctgcatgtggctgacagtctgactgaataatgagagctttcgtcaaatgcgactggcaaaggaaccctttccaaactgcattttttctcagggcctatttgcctgcagttgaggtgcaattacccgtcaaatgtggatgtaatgtagccacgtgacaccagcatatttctatttctagaaagatagcagagaaaaatcccctagtgtaatcatgttagtgtatgcttactgtcggaaggaaagggattttttattttgctcctggagttgaaccacagaagttgaaaaaaaaaaaaggctctgaattaaggggaaaaatctgatgttaggaaacattggctcacgtgcttcccactttcaggaactgaacagtttcaacaaataacctggtttatttttttcccagatgcatgcatctattaaagcatttctcttcctccaagtacataaatgaaatacgcataactattttaaaacgagttaagagtttaagcttaagattttatccttaactgcttaattgggcacccactctacactagatatcaaagggcatttgggccagatttgtaagaatatgttcaacaggcgatactttgccaggctgagaaatcaaggtggccagatgttcagcagtgcatttgcaacccatgaacccagctctagagaagcattcatccctggaactgagactccctgaaaaagccatcctcccatggatcacaagggaatttccccaataccagctagaaacaatttaacgaagcccgaagcctgccgaattttcaggagatgagtgtcctgctctctcagacatactgttctgctatttttccctaaggacaaagtccctaaataaatccaaactgacttttatttgaaaagagcaagtgtagattggtatgtccaggaacttaagtcacaggagcaataaattctagcaccctgtttcctctaaacaaaggggcctgcaaaggactattggtatttacgaggactgcagaggcttgagtaagcattttcacagcagccctgtaaggttctaatgcacagcagtactactctatagccagcttattaaaccttaatggcactcttttagtgttgtacaccaggacggtagataactcacccacagcgtggcttctggaagctgccacagcactgcaaccattctgcaggttaccacccttcaacttgaaattcctagatactggtttcttcattaaaatcaggagtcagcaaaccaaggtgcttggccaaatctgacccactgcctctttttgcattgctattagtaaaggaggttttttacattttaaaacagttgacaagaaatcaaaaaagaataatattttgtgacatatgacaactatataaaattgacatttcactgtccataattaagttatattggcaagccaccacacccattcatttaaatattgtctagggctgtttttgtagtataacaggtagttgaggggttatgacagagacttatcaccccaaatcctacttcctggctctttggagaaaaagtttgatccctgatttgaaagtactatcagtcattttcatcctttaacaggttctgaaatgcattactatcaacttaaaggaagactccatgtcagcctctttaaccactggtcaaaatgaatcatttcccaacagtcagatccattgtccccacttaagaaaagcatgcaagagctctgggtgggctaagcaaggatcaagactaaaatagtacctttagaaagctctggagttgctccagcaacatatagctgaaaagtagtatcactgatatttttttcaaactaacataatagaacttgttctcttcaaaggagtaactttgaaatttgttgcaaagaatctgccaatgttcaaaacatatttggagtgcacctttgatgctgcctttagaggctctttttaaattatcttttaaacaatctcaataatgccaaatcttgattcattatacttgagcttgattcatatttttaatcttaagtcattcagaactacaatcagtgaataaaagggagaagtacattgcctggaatagatggcgacctcaataaatattagtgaaacgaattgagctggttcgatataaagtgacactaatgcaacttaaaggaataaaaacctactgaagacatacatatccatccattatctgtgcccctaagcgtacataccccaagtctttctgattctacatttagttttcaaatattgctggctttctgggaatctgcatgattttatctgattctccactgccttcttccattcccaagcctgcctcattgtcctgcatagaactcgtctcagcccctgcttgacatctgactgctcgctctggacttcagttgtcacatctcttttccatctctcagaccacttctgatcaacatgcccatatagttatatacaccagtgatagttctcggcccaaagtgcctttcatattcacatacttctctgagggaagtagtcataggtttccacatgcatgatatggcaagccttacatcatgctaccctgtccatgatagactacacggatgcatatcgaaggtagccctgcatagggaagaagcgggggagacagggatctatgaagctatgtagcaaatgcctaaaagaacaaaattcaatactgcttcgtagatccctgtctcccctgttttcccacagcagggctacctttacatggaactcaagtagaacttttcttaggaagacatgatacactggtataagtaaaggagaaaggaaggagacataggaaatgagcggtctgtagaaatacacactgctattagaaagagcagtgcaccctcagaaatcagtcaagacagaaaggtgagccacagaatgatgccttcctggaggcagggggagatagtaaacttgcgagttcaatgaatttgctataatatcccaagtagtgtaaccatgttctagttctttaggatgcctggctgtgtgactgcaaggaaggtttcctgtgttttctcacattcctatttttcacagtaacctaaatgggtctcttcattgtaacctgaataaatctgtattcacagaaatgaaagtggttttctgttcacttactaacttggctatgacttcaggagcagagaattctaaaactgctttgagtaacatcagtgtctgtgcactaagtgtatataatcccagatgacttactaaaagaaccaaattccaatgaaacctttggtaaacttttccaaatagagcttcatgactttaaagctgcttctactggatgtgtcaatttatggagtaaaataaagtaagagcaaaaaattaatttacaatactttagggaatgataagacagcctaaattgccaggtagttatctgtatagcagtgtacattgtgtctaagtcttattttttaggaattgctcaatgtttctgctatgcttaaacaaaaataacaaattatttatttacagtatctgaaaacagtaacaacagagacatttatagatttatgatactttgtattctgttataaaaataaaataaatcagaaatagcaaatagtaatttattcatttatgtgtttattaaaaaagcatttactatatgctaagaactgaagacaggttgtataaaatgacttctctgttctggtgaagttcattgtgaaggagaatgacacctaaatcagcgatacaacaaagcatcaaggagggacacctgatccagcctggggtggagaggaggtagagtttaggaaagattttctggagaaggaatggtatttgatccaaccctgaaggatgaggtacatcctgccttgttgggacaggctgatccatgttgtttgatgagtaaaatatcagaacttgctggccaaaggtgcatcatcactcatcactgaagacacaggaataatggatctgttttatttccagagttactttattaaaatactaaactctcctgggaaagtttaaattacaagtctgtccaggtaaaaccttatccctatcagtcgatggaggaacagacgagacagaataaagagggaagaggaatggtttcttaggaattactgtttggtccagccctggctatggacatgtaagaatttgatttgggcaaactatattaactattggaaacactctgtttgcatgttaaatgcctagaaaggatgaatcatacatatttcctatgttccattttctgactctgttctttttcctgtttctgctttctatgccctggccttcctccctaccctccattgagggtacaatagcatgtggtatcaattaatgttaagttttgaaacttaagtttcagtaaactttgggtcagcactacaaagaacatctttatatctacatcttttaaattcaacctttgattataaggaaccaagagagtttggataggtcaatgaaaatctatcccaagtcctacaaatgtgacacaaggtaaattttttatgaaagatcattagacaatattgttcatgttttctatttttcttctactcaatattaaatgggaatatcacaaaatattgaggaagagtaaataattgtttaatattaccatctttagcaaaaaaaatcatttactactgtaatctctgaatagaaggaatatgagcaataaaataaatctgaatttacactccaatattgttgaattcaatcttgttcaatcttgttctataaaacatctttcacaaatgtgggctctgaattttattttatcctgtcattgcttaatttaccagattctgaaccagtcttttgggacatttgcagactgatttctaaggcaatctgacaaaaataacttgaaatttcaatgaggatgaagaattgctctttaaagaatgaggaagtcagtaggcataagggaatttctcacaaaaccgcaatgcagaccacttcacaaataactgggaaaattctaaatttttactgcactgaaagacaattgggagagaggacaaaccactacttacctgtaaaagcttcaccagtttattacagtaatttccctagaattcaccctaaagttttttgaatagagcagcacctttaaatctgtcttaattatcagcatatgcaaaatatagaatgattgctttacaaaagccattactccagatgtgcagactaggtgaatttcctctgtgggcacggcatttctaggcagacaatgttaatattcactatgactatataaagatgaatggaatgcttaggtttcacgcctacttgataagtaatcattttagataaattatagattgattacatttaattacagaactacaatgctcatacagtattctaagcctttgtcacttatccatctgactctctacacaaaggaatccctgaaaggataagtgagagaagcaaatgcttcaaaagctacagatttcatgcaattgccacaagagttgtgaacaacatcttttttgttctttcttttttaaaatacagatcatggggatacgagtgcagatttgttaaatggatatattgtataatggttgggcttctagcgtgcccatcacctgaatagttcccagtgtctgtcacttccctctgcatatccatgtgtacccattgcttagcttctattattattattattatcattattattattacttgaactcctgggttcacacaattttcccacctcagcttcttgagtagttggaacaacaggcatgcactactggctggctatttttaaaatacatttgtagagacagaatctcactatgttgcccaggctggtcttgaactcctggcttcaaatgattctcccacctcagactctgaaagtgctgggattacaggtattagccacgctgctcagccagctgccacttataagtgagaacatgcagtatgaattttctgtttctgagttacttagaatattggcctccacctccatctatgttgctgtaaaagacacagtttctttctttctttttttttttttttttttgagatggagtctcgctctttcatccaggctggagtgcagtggcacaaccctggctcactgcaacctccgtctcccgggttcaagcaattctactgcctcaggctcccaagtagctgggactacagatgagtgccaccacacccagctaattattttgtatttttattttttagtagagatgggtttcaccataatggtcaggctggtctcaaactcccgaccttgtgatgcacccgcctcagcctcccaaagtgctgggattacaggcgtgagccaccgcacccggctggtttgattctttttaatggctgtatagtattctgtggtgtacatgtaccatatatttttattcagtcacctattgatggacacttaggttgattatgtggttaacatcttcgatgatgaagaaccatggagttggcaatttggctatgaatacaaataagaagtagtgctcatcaggtaactatagcttgcttttttaattcacagaactacctttaaatatattttattgcctgtaccttacaagcatcagaactaaagctcataaagattataggtaacttgtacaaagctaacaggttgagaatccaagttcaaaaaaagctttactactttgtcataggaaattactatggacttcaccctaaagttaattcagctctgccctatttcaacgtttgcattctcttttcactctgccataatatttcacaacagaagtctcaagtgtaaagactcaagagaaacaccgggtggtaatttaatcaagacaaagttcctgggataactgtttatattaaaataattaaaactctaaaactctaaagtgtaatgaccatacaggtgatataaaatgtgcagctgagtagagaagagagatgtaacttttttcttagtgttgaggaagtctttccaaagagataattttaaaatgggttttaaaggatgcataggagttcaaccatgtataagggcaacatgggtgacctgagcaaaggattagataaaacaaaatccgggcacttgacatgctcagggatcaaatagtccaatgtggctcagggtttgtatcctccttaccttcctctttttgtgatcagcacatctcaatattttagctttccctaatcggcttaattttaatattaaaatattcaatattaatattaagattaataaaaagacaaaattttgaaatgacagcaaattcaatgatgaaattgccgtaagtgctaaagcaccaaagaactaaactaaaaacagttgcacctcttcttggctccctttcttcagggtcccaatatctttaccactgaaaattatttttttaaggcacagatttttcaggaaggaaaggaataaaattaacacaaattgaatagaaatatgaatagttcaaaattagacttttactctcttttagactttctaattccaagcaacactatccgacaggttatgatgcctcagtttgatgacagcttttttcttgaacacttgccaggatgaggaaacccagggaaattttcatgaaagacctcctaaaaattatgtgaaaattcaggcaagtatttgaggcccctgctagacttttttagtacatctgtaaatttacagattttttttttttatagaacaagcaaaatcaccaacttaaaacatccatgaacctgaacaagatattttatccaccacttctttccttcccaagagggagattctctctaatctcaggaaacaaatattttcctattgtgtggttcctcagacctggcttttgaaatttctgctaagtacacagttgtaatcatttattacataatctatttctaatgtcttattctacacataatgtttgtgaaatgcatgtagcttagttgtctgtggatatattccttgcctcttgcaagattcttaaaacagatttttatgattaataggtgtctctgttgctaacctcaagtcactcaaactctccttttgaaatgaacatttatttcagatagtacatgctctctgcggatagcctgtccacttttcaaatgtaatgtcctgtcttccatagatacgaaattttcaaaagatattggcataatgcaggagaaaatgccatccttttattatgttcaaaattgatctgacccctgaggtagcactttggggaattgggctacataatcatgtagaccctttcaggaaatggcttatttatggatttattttttatatacagaagatttcacacttctggctttatacaattgcatcctctcttcctttccaatatgtttccaaagtaggaaagctatatatggcaggagaactgaatttctatatcagctagaaatctgtcatctgctatatattggctctaatgataatgctttaagaatacatttatcccatatatgcatccagtcctctccagcagaacttttgcagttctcatttactgaataaagtaatgctaaagatagtgctatatcctggtcattgtccaatttttttttttttttaaaactgacttctaaatttattttttaaatgtctttttccccctgaagaattgatgtattttacactcttagataataaaagtttagtaagtctgcatgtgttttttctcactgcttagtttacatttagtaggtcatctttattgtattaaaatttaaggaaataaatcatattaagtacatattaaaaacatagtataaatatcaagcccttgttttgtctgaactttttattattcaaattgttctttatttttaaaagttaaaggaagaaatgtagttaatctgtatatccacataaagcaacacaagtagtccaactaaacccgctgatcttggttccagtcctttcgaaatggctatgttttaaataaaacctatttccttaggctaacaaacagtctataatccattaagtctttatgaacaaatccaaggcttttgaaattagtgcttggggaagaaagagtcaagtaatgaatttcaaagaattatgaaggtgattaaagaggaacaaaggatcaaactcccatcaccatgatttctagaacagagcctatcaaatgggcatttgggaattttatttatcatctaatcctgaatatgaaatagaaggtagagggaagaaggcaagaaacagtgttaatttagaaaggaggtgggatagagaaatagaaaaaagaatatgagagcaatttttctttaatggacatttgtaagctaaagagcaaccaggaaaaggtaataatactgacaaaaagagccgttgtttctgaagtttcaaaatgtcattttaactttttaagctggactgagtaaattgggtaagaccaccctgatcctagtgatgccagagatatcttagttacaaacaatggtttgagttatacttgttgtcacagaactgaaaattgcaaaactaattttctcttatgtactcaagtgtactatggaaaaacagagatactacaaagccaccaactccagtgggaaagtcatctctgtgctggctccaggagggtttatctgtggcagagacttaaaattgtcccattaataagctttctcattggcttccctgtctaggcagaattctgagctggccacaaggccatacaatataaagaaggaatttttcagtctcccttgcagctaagtgtgaccatgtgactaactctggccaataggatgtgagcagacgtgatgaggtccacttctaagccatgctcttaaaggggaatgtggtctttccctatgagaatggccatcttgtttttgtttttgttttgagacagagtcttgctctgtcacccaggctggagtgcaatggcactatcttggctcactgcaatctccgcctcccaggttctagcgattatcctgcctcagcctcctgagtagccgggattacaggcgcctggcaccacgcctggctaatttttgtctttgtattagagagggggtttcaccatgttggccaggctggtctcgaactcctgacctcaggtgatccacccttcttggcttcccaaagtgttgggattacaagcatgagccaccacgatcagctgagtagccatctttgaccaagcagataaggatgcctcatagggttagtgaacaaaaatacaaaaagagctggaactcctaaaaattctccagaaaagagccatctcacttgttcagatctggttattcagactctacatgagaagttagatgtaaacttctattttgcttaaatcatttaaatttcagcctcttttcctgcatcagaacttttacaataatagcaaacacactatagcccttaccatgtgccaggcagtgtcctgagtgcttttactatattaactcattacataagactataatttaaaacataacattattatttgtgtctacagacacagaattcaagcactgagaggttatatggttgatccagggtctgaatccagaaaatctgactccagagtccatatacttggtcataccatttagcacaacatcatacatttaacatatattaagggaacatttgtttaataagttaacaggtaatctgtctgtttaaaattgcataactgtgtttagaagtctcaacatcaacagattttttatgtgatctctgattttcttcttcaacaagggaaaagtcatcaatttagatggtaagcaatgtcctgtagggtactctgtaccctgcaaccttttatgtagccagtttctagcatctctgagaataccctggcatgtcagctactgctgagcaaagatgtgctctgacaatacaggaacacaagagaattgaaaaggagcacagatgaacagcatgaagaatcaagatgaggcccattgcctatttgttttccattctattagcatggtgcctactaagtgccagggaccaaatgtttggtgacagtggaagaggtatacaaatgaatgagacattctttccctcaaagaattaaaatccagcctcctttgagtacaaagtctttccaaagatctcttttgtgttcttcccttaactaataggcctctcgaggataagtcccagcaaatcatttttcagtggaatggaaaaaggggaatactgacaaacatgaagaaatatttttttaaaaaatttcttttaagaaccagaagttgttggggcaatgaagatatgtaggaaaaaaaatgagaaaaaaatataatgaagttagttttgaaactaagttttgtggcaattttatgacaaagattagggccatctctttgagatttttttcttctttccccaagtatcaaggaatgaatccttgaagtttcttttttgcagagatttaagttttcaacttttcaataatgaatagccactttgctttagataactttaattaaagtttcataaatgcaccaagagccatagggctttttgtattcttgaaataatgaataatttaatcaattaatacataatgggagcaaatgactaattgcagattcaagatacattttgtcaatcatctttattgacagttatagattacaaagtccaccataccaaaagtcaagaatgccttgattgacaattaattgctaagaccaattccattatcatgacttctgccctctattttccaatttggaaagcgtgttgcagtttcgatttatacactgggaagttgtattagtatcaactttagctcttatataaatgtggcattttaaaataaacattctcccaaattaatactttgtttctgcaaacatgagcaccaagcacatggctgaaaacatctttcattacgctagtttcaagaaaaaacactccttttcactgaaatttaatttgtaagacatttagggtatccctacactatatttttaattgaattttaaaggaaggatggagaaataacagttccgaatttgttggatatttattattttgaaaaataaatctgcattcatttatttgccatagtctaccaggccatccatccatccatccatccatccacccatccatctattcatttgttcatccatcaacgcatacatagatactttatcttttaagagtcaaaaaaaagtttttgaactaaagtccaaaaggaccttccgaactcagtctgcctagaacaccacgcttgagtcaaaaattctggaaatgtgttgctgtaaactcatcttctcatctggatctcattggagtaacataatccacattttcttcttttaagcatatacaaccccagaacacatccaatttgttcacagctatctgcataattaatcagtagtctttaggttcactccacacttaaattttcacatatctatgcatgcattggatacatacctcacaggatataatttctggacaaaagaatgttacttagaatgatgagcgtctgataaaactatggctatgctctcaatatcaagacagtttggctggtatggaacagacaaattaattgaaactcatgtaagttttattaatcacatttcagagtggccacatttctcttctttggctttatagtctttacagccaacttaagtcattatcatgcattactcatgacttgtgtatcatgtctatatacttccacacttggttatccctctgattgagagcactttgaaatcagtccctaaacactctgtgttataaatattctctgtaaacctttcatgtgtatttgcatgtaaataatgaaatatttgataagcagaatacaccacaaaaaattacatcaagacaaaatttattgaaaagcatcctgatttttgtcgttaaaactcataaaactagagcttaatcacctctagattctttttacaaaagttaggtaaaaacaatttccatttacattttttctacttactatcctatgacctacatagttcagcataattaataactggaaatttttgacctcctctgtgtatttgcaaaatgtaatattcccaagtataccttagcagagtcttctgtggcaaaaaaatattcactaagaattataatctagaaagcctttgtctatctatatagcttcagacaaaatagcattttatagatcataatggtaatgtaaacattcataacttaccccaattagctgaaagtcttgacatataagattacagccatagatcgatgaagatgcagcagaaaaggtatggcatatttagaaggctagttacactcatcataacaacagaaactaaaatatgtattcttttggttatctattctgggcacaccgaaataaattgtgaaccaaaccctataaagacaaacccaaaatgtacccagaactgtgcacattaggtaaatttttattagaatacaataggaattgaggacaatgcggtcttattaaataaactattaataaaaaggctgaaagggttgaagattttctgggctctctggagatttgaactatctttgattaaatgtgagctaaaaatactccagatatcaaaaacaaaaacttgtagtggtagcaacgaactataggtatatgtagtacttattcattccataccacaataattcaaaaattcctaggagccagctaatcccttttcagcatttgtgctcagggacttcttcactttttatagctgggtaatatataaacacaaatgtccctcctttttacttgaaccccagaggaaagcagttttacagagctatggaagcagatcttattaattaaagtctattttttgttcctctaaatttatcttttactatcagtgtgttgtgtgctaaggaatggattctaagacttatgaaatgggaagcatctatcacagtgttcaatgcatgctaaataaatgttcatcctccattaatataaaggtactcactgagaccgagtgtggtggctcacgctataatcccagcactttgagaggccaaggtgggcggatcagaaggtcaggagttcgagaccagcctggccaacatgttgaaaccccgtgtctactaaaaatacaaaaatcagccgggtgtggtggcgggtgcctgtaatcccagctactcgggaggctcaggcaggggaattgcttgaacgtgggaggcagagggtgtagtgagccaagattgctccactgcactccagcctgggtgacagagccagactgtcttgtagggggtgggatggggcggaaaaggtactcactagtttattaacttggtaaaattaaattgtatccacattaccagcaggcaaaacaagtgaagacttttaaaaaatgattttacagactcaagggctgattccttttcagaaacagaaacgagttacagagctttcaacttttatttatataatattatccccgtaaggtttaaccaagaagataaagtagatgtgattggcaaatcttttaaaacttgatgtacaaatgtttgttaaatatccagggtcctaaaaatcaaatagccatttaattttgtaaacatgtttttaatatagtcttgtaattccaatgatgatccaataactagatttaaaatttaaaaattcagtaaacacataccagaaacaagaaaaattttatttgttaaatttaagatttaagtcacaatttcaggccaatggattcaaaatactttaaatcttaacttgagtcattaacaattaatactaaatatccaatgccccaaatctcctttggtcctagattagctgatgacaaatgacaagttgattgctaataagcatagatcacaattttatgagaaagtctatttgtggcttgatattctcattaatattatcaaagtccacacttccaaaaattcaaattgcttttctgtaagaaacacaagacagagtctgctctaaattggtattcccaatgttcctgcccttgggagttataaagaaggtaaaaagctatcccttcttttccctgccaattctccgtccttccatgtgagaacagactttcagaaaataacattttccttctttcatgatcaatttagccctaccttattttttcttggctgaattggcccccacctgttgcctcctggttttgttaattaaaatgagacaagtgaaaagcactgacaacctagaccttgtgtgattattaaagaatgacaggtgctttggaaatcaaacctaacaccaaacataaagaagcctttagacctctatcttacaagataattacattaatcagtgaaaaactagattaatctattggggagttaagtaactgaaaatgggacaccctaaaaaattacttggtacaaaataagaaacaaatgtcagtgaattcattgagtagtctgggacttctttttaagtcactatggtattggtcttttactaataaaatagatgacttattaaagcaatatttacactgattaattcacaacggcagtacctgagacccctaagaaaacaactattcctttaaaatccagcctgaaagtagtgctcaggtgtacacactgagccttttgtctttaacttagcaaacactcagttcaaaaataattttgtcattcagaggagaagctattttatagataaaagattatgaatttcacagctgacttgagctctactcaggtcaacaacattggtttctactttgcaagtaggatttgttctgtcaatgcagatttctcagtaagtactttcccctttcaaagaaacatttacatttttttatataaatcaagtcactgattatattagctcagattcacatttgatgcacccttgtgcccctcctcctacacttcagctaaaatggaaacagactttgtttctaacttttaatactgacatttttgagtgtaatcaaaattccagagtgttggcttagatggagttctaaactgaagaaaggagtaagggctaaggtggctttttgtttttgttgtatgtattttcctattttataaatagttcttcagtttcctgtatgatactaacaatatgcatgtcatatattaaacaatatatgcattaaaaatgaggaactgtctgccctaatatgagcatttttttgtgagttttgttttgtttttttctgagatggagtcttgctctgttgcccaggctggagtgcagtggcgtgatcttggcttactgcaacctctgcctcccgggttcaagcaattctcctgcctcagcctcctgagcatctgggactacaggtgtgcaccaccacgcccagctaatttttgtatttttagtagagacggagttttacattttggccaggctggtctcgaactcctgacctcgtgattcacccacctcagcctcccaaagtgctgggatcacaggtgtgagccactgcacccggcctcttccttttatttagtttatgatttatccttattatatattttgaaagcttagagacatgtcaaattaggaaggatcaagaaggagcttaactttttgtagggggaggctctgattctgaatatctctaaagcctgaaaagcaatttaattagtcactaagtgggaaggctccatttgatgacaggctgtaaatggcattactcttggtcatctgagtagaatgcagaaaggttgcaaatgaaatggtaatggatttaattgcttattctgatattcataaaaatctgagatgtttctcaagccctgtttagactctaaacaattttatttttccttatattaataattagtgatcaggtcgaatacactgaagccttgtctatgtaaaaacaccatcaagtgactattttcatgactcctgacttactctcaactgcctccataatgactttatttaaaccatgatccattgaaatgactcatgaatttcagaggttccctttatcttttccgtggatttatacccaaagctctggaatagttgtatgaacactagaaaaaaagaaacagaaatgacaggttccaggtaatcaatgataaaactactttgaaaaccaagaagaaataatttcatttatggagttttatgagcactgtatttaagctgacattcaacttttaaaaattgtacgtatttaatgtgtacaacatgatgttttgacatatgtaatgaaatatttactgcagtcaagcaaattaacataaccatctagtcacagtcacagttaccagttacggttacctttttttgttgttgttgttggtagggagagaacttgtctcctgactactgtcttagcagttttcagtgtacaatataatatcattaactttaataatcaagctgtacattagatcactagacttatcctgaaaaacgtcaattgtgtatacttttactaatatctctccatctccccccacctccctgaccctgctaactacctttctactgtttctatatattcaattttttaaattattttttattttttacgtttttagagtcagagtgttactcttttgcccaggctggagtgcagtggtgctccttgcttactgctgccttgaatttctgggctcaggcagtcttcctgcctcagcctcccaagcaactaggactacaggcacatgccgcaacttccacgtaagtttttatttttttttaattttttatttttttccagttttttgagatgggagtcttgctatgttgcccaggcagctgtctaacgcctggcatcaagggatccttccacctcagcctcccaagtcttcaggagtacaggcttgagctactactacaatcagtgtattaaacatttttagattccacatgtaagtgagaccatgcaatatttttctttctgcgtccggcttatttcacttagtgttacgctttccagacattcattttcattgacaggcatcatacatgatgctaaagagcatggtagacagggagtcagacagatttgggttaatgatctgagcccaccactcatccaacgatgtgacctttaaatgggttaatttatcctagtcttgtgttcctcagctaaaaaatggggataggttgataatcgttaaggttttgtaagggttaaacgagacatgtttgtaaagcacttaatgaggtcagacacgcaggagctgcccagtaaatattagctacaaatttaggacctaacataaagggatctctcaagaaaatcactgaatgcaaagacaagtattttcttaatactttacagctgagtatttgatccaaggttctttcccatttatagatttgttatttgatgcatttcattttactttttatgcagatgggttggttagcccggcctcagttatcatttgaaactcaaaagggcagaatgtaaaacaagatattcttatgattccaaattgaaaaatacacaaacatcaatgtcttcaaaactatagagtttttactaggacacagtttttcctctaacttgatgaaaaatcaggagttctggcttccattggtatctctgacactaattaattgtgaaggccttggtctcctttatttgggatatgagagttttgacaaaatgacctcttaggtcccttcagtatgtctgaaaactaattcagaatgtaaccctaatgccgtttgtgaggaaaataaaagagacttttcccctgtatgtcataaatcccaacctgtgacaagttcttcacatgtgtaaaattctgtcctggttttctatggcagtccccatgatggaaactcttttagttatgcataaaatcaggccagtttatcacccagaaaaggaagagaggcgacatgcttccagcctatatcgtctagactaattttcttgttctctctgatgccactatgggacccttgccagctgcctcctaggaaataattattaattgcacttactcaaattagcctcctcctaagtccccttcaagatcacactacagagatgtcctgagagcctagcggaagcagagaaactaaaaaaaatgttcacaatctttcttcttccaaagaggttcctgcaaatagactcatgattaaaatggacctcataacatgtcagcttcttggaatggaccctccttccaaggctagaggcctgaggattgcttctaaataaaagaaagcttgctatgttttcagttccagatggtatatgtgcactaatagacagcaaattctaaaacgacatgcctctggcttcatcctggagtctcagaagcagagaagaaatgcattagaaaaggaaagagagagtatcttgctcttgtttgtgttgggatataccaaggcaacatttcaggcagcttacactgctcatagattattttgatcaaaattgttattgctcacttctttcatttcttggataagttaactgaccacttggaaccattccccttaaaatgggtaacaggaaatcctaggtcctctaactctcagcacatattcatagaaaaccaaagttgcaatactgtaaaaggagcagaaataactaactacaattcaatatatttcattcagaacgaggctttgaaaaaagcaatgatcctttgtgcccagggctgctcaatttgattactgcatcccctactttgtgaagtgatattttgtttctattttgattccaaactgctcaaatagagtcctcctcaggcaagtgtataagaatatagcatattttggcctcaaatgactcttattaaagaataataaatcaatttaaacattattattacttcaaaaatcaaatctgtaacaaatattaatcaatctgatacttctactgttattggagaacatttagtctataaactacattatggatgtcatggtcccatttcttaaaatatgtctaggtatatgcttatactgatgcataattagatatgtttatatcatatatatactgattcaacagaggagaaaatattcgtgaagacgagattaacacagcagacagaaagcatcacatcttaccttataagactgcatttataattaccatgtggtagaataatggatgatctttttcattattatgtttcttaataattttcaaattaaaatatttgaagaaaacaaatgcaatatcctataatttgtataacataaattccattttttccctagataatggcaaaggccgcatgactattaaaactttagataagtatgtacatatacacacaaagtagccttttttattttaatgtgggagaaataagctaagaagagtaatgctatctattcttctattagatagggttttatataatacatgcttacaaaaggatcatgttgtcaagggtacctcgtcttctctttaaaacaaaactaatttcaaaggttgcttaatcaaatcacaatgaagtttcatacttttcaatttaacaaaatatcacagaaaagcatgcatcatagaaaatcatatcttcctagataatgaatttccaacaggtaattttggagagtctctatttataagctaagaatgatgatttgaatatttaaagatatgcactgctgacaaataggagtgtatttatggagtacaagttttagttatctaaggtttctaaatccccaggagctcaagaatgaagaaaccatgcactgataatccgaacctggatagatgaattctagacagcaacttgtgtactcccctcacagccacagaggtaggtggaatgtataatacattgtcttgtggaaatcataagctcaaaaggaccctagaattatcttcattgctatctcatgatgaccttttcataatatgcagccactgatcttcacgtctcaaattataatagtcaataaagaatcactttatataaaaagtatttgacttatttcacttatttgaattccagggtagggagactgtttgcagggatatttagcttagctttcaaactatctgtggttcctaactgtcacaacattcaggagtatcctaaatatataatgaaatgtctgtaaacctaaataaatgttagtataaataataaatacctacacaattggaggaatagtgtcatattgaggaattaagtcaaaatggtttaatcatgaaaagctatggtagacactggggaatgaatggcaaaaataacagaatatagttagtgtccctcctggctttgagtaatatatgctgatgtaaaaatttttgattgttagtgttaaccactgtatttattcactaatctgtaaatttgacacaatggatttattaatgtaatttaatttacttggcatttcttctcctgagaaagactcctaatagatttaccctttaccagtccaaccaaattatgagatttctcccctatttctacctcacaggaggaacctggatatgcatagattcaggatcttagttttttacttttaatgaagaattatgctattggaagttgaacaaagatatgcagagttggaggacagtcatagtatgcaggggttaaaaaaagaaaacaattttgcaggcacttgatgtgggcatgacggtggtgtgtctatgagatggctgttctttgtgggtttttttttttcttttaatcttgggaaactttgcagtttttacacatgttcatagaaccatgatctaaatttcaatatagctagttttgacagtgcttttacattttcaacgcatttttattttcccctctgacaattcagcttattctattaagtgtacttccaacctctctctctccaggctctcatcctacacacatgttaaacctgaggtatgttttggaagtaggggatctcagacagtccatctgattttttgtcacatcctctcatctagtcactagaaaatgcttctatcagatttgtgtcataggtaagccaaatacatatgttgcaatttcagctacttcatttatcaccagctaaaaataaacaaaaacaaacaatggtaaaattaaaccaccctccatttcctgatcatataattttaagttttgatagaggcaggcagtgcttgagcactacataagcaacttgttagggcatgccacagaattctgatggagttcttggggctttcttgggagtcacttccttagaaagagagaatggaacatagatggctgtagacactaataatatatatcaagaaataagttaaagtatataacaacattatatatgggtaaatgctacaaaaaataaatcaagaagagagtgatatttctatgggaagatttaggtcaggaatttttttctgatgaagtcgactttgaatagagctccaaaactatagtacatattctaatatgtctagaattatctcatcagtatctattaatcaaggatggtgaataactacagtctcattctttttgccttatattctgctcactcttacttccctagttcccaccctaagctctcacgattatactattatgatttgattcttcactgacactaatattgctcctctgagtgcctaggatgagtgtttatttagtttatttatgcatttatgatgctcttgagtattttgacaatcaggaaccacagaaatgtgaggaaagccaagccaaatgcacttcaagcagtctccctgccatgaaagctgtgagccctgaagtcatttacctgataatctgttctatgggtgctagcaagcattagaccccgtagacatgtggtgctggggaggctgtaagccaaggaatctgggcaggtataacaggaaccgaagacttaagcagaaagctgacaagaacaccataccgctacttctctgaggtcaccaacagcatctcagtccaagagtagccagacccattaaacaaaagcataaatgatgggaatcagatccttttttggaagacatcaggattgctaggatatttagtgtctttagggaagaaaaagtatgaagaaaggcagctaaggacactggagacaaatgtctcgtgttttcatgattttacttgttaactttccactcggcagacagaatctgggcacagggactttgcctgcagctgtcatggggagctctgctgtaaatatattagcatataagcacagtatacaaggaatttgttagtctgacagcacataatgtagtttaatcaatataattattgaaaaaaataatttacacacaattgctcattcactcgagtatctgggaacctcaaagagaaaaagaaatggtttttctatgctgaagatgagagcttcagaataggtagattctggttgtaaggcagtcttaatcttaataatggaagatcttaatctttgatggtagacgctagtcctcctctcacataaatactgaggaatgctaagaaatgctagtttctgcagacatctttcctgcttcaaaaagacaagcttcactttgatctgtttcccatgtggactctgtatgatttctttcagagggggaaaaatgaagagagtcctgccactttaaaaaacaaaaacaacatgaaacaaacaaaacacctctctctaaaatctctagaaaacactccatccggcctttccctttcctcctcagctcaaatcagaagcaactcaccacaattaaaacaaagagtttccttctcatctttcatcactcaaaaggccagaagagctctaatccctcagagaaaaaaaaatcattccatataattatgggtgcattgacatcaatgattttctgagtttattttttaaatgccattgtttggtaaatgccatttctaaaatgtcattatttttttaatgccactaaaccacattaagagtggtttagtagcattgaagtgcaaatgaaaaaaaagaatatattttttgtaaatttaagagagtaagaataaaaggttcttaggactgtatactctccataagaatcatgaagagtaatgccgaagatcagagaaaactaaccagtatttataatgatgttcacttctattgtggcctgagccttggggtgtttggagcaatttttcaacccttctgagccttatttttctcacttttaaaatgagggtgttaaaggcaggtgatctcaacatcttttcccaacttacccagctttggatttttttttctggttataaaattattctgattattttttcttagaaaaaatatagataggaaaatgtatatttctgttaattctaccactcacagataaccagttcggtgtatattcttctaggtaatgcttgggttctttttttaaaagccataacgaccacaataaacacagtagaatctcttttctgctttatctctctgaagaatatgtgagcttttttttccccctgttttagtatttaagtgcttaacaattgaggttctggcaactaaaactgcacaggcagcagctccgtttttctcagaatcaagcgaaactgaacaggcaattaaaagttactgaactgcaaggtaaaattacttccctgctatgcttctgggtgactaaagaagggagacaatggaaaccatatttagaattaagatagaaggatggaacatagcagtctgctctactaaaatggaatctataagcattacacataatcagcagcacttcaatcatgctctttgctcacagttacatggaagattacacaaaacaaatgtgcaatattcaaatctgtggcattgctggttaacagaaggcacttctctcccagcccacacggtgatccaaattgtctcctgtacagtcagtgcccatctcacaaatgggctatgctccaagcatctacttgtaagctcattgttccattctctgtattaagtttctcatagaattaatgttataaattgtcctcagattcctaggctagcctatatgggccagcttattaaaaggcacattatcaaaaaataacatcaagaagactatgcaaattaaccaccatagtaatgcttcttttgaagttgtattcagaggtcaattgtggaagcacaagaatagctctcctcttctgaaaattactggtgacagtttccatccttagagacaaatggtaagacagaagaataaagtttaaagaatttcgggaattcaatcaggaggattcagggccagagatcaaggaaaaggattcacattgaactgggaaagcagtaaacggcatgagatgaaggagttggtagtatgcctgataatgcttaagaaaggagaaaatgattacagtatggagaaacagagccttcttctagggtatcttcccatgactttgagctcttatcttagttagaagcttggaggctataatatctggatgtcatctgttttccacactcagtagaaatgttgggggaagaggatttggtgaactggggtaaagataaaaatgagcagtggaagtctggggaagtattaagacatttccattccaactgaaaccttatgtctatcacctctccctccactgaggactctacctggtgacttgtattgggaatagttaagatgcctggaaaatgcagtggatcttgaaatgataatttcaaacatttaatagggtagctcaaacatcaaacaacaatgaaaataaataggaatgtggaagtcaagcaacggaagatcttgccacatgcaaccagtatagccatttgcacaataagaatcacattaaattggattaagcaatctgtgagaatctccttaggataatatttttacataacaagggaatcaacaaagcagattttataactgatgtcatgtaataaaatatgaaacccactcttaaaggttatgattctattggtacagttaagtataaatctgctggagatagtaaggtagtaagattaataagtaacaaacacatgttctgctataaaggtcacttttgatttaatgagaaatacaaatttgccgaaaatatgtcttccttctttaggaggggatggtggtactaaaatttaataaaatagggtaaaaaaatgtcaaaatatcaatcagaaaacctaaggtgaactgaaagcagttactgtggagtacagtatctactatgagatttcttttaggtaacttttttatgtcgtccaacctcaattatcaattttcctcaaaattacaattcgaaaataccaaaagaaaaaataataactgtttttgggatccacgaggacattattaaagagtattttggagttatatttgctgccaatatcatgtactgaatgttcagagaaatattttctgctctgcgtttaaaaatgacaaataactatgaaagacatgttactagacatggaggagataatcaaaagaccaaaatacatgtaatcactgttccagaaggagaggggaaagagaatggacaaaagactcacaattctacataattgattaattagacaaatcctaatatcaggaagcccagtgaatccaaagcaagaataataaaaagaaacccttaccaagacagacagacacatgagcaagaaataattgaaaatgcaaggaaagagatctttaaaacagtcaggaagaatgaaacagtagttagaaataaatgataactagatttacaactaacttttcaacacttacaatggaagctagagggcaatgggataatatctccaaaatataagagacaacagctgttctattacaattgctatacccagtggaaaaaaaaattcaaaatgaggttaaaataaagctatttcaaacaattaaaaaatgaaagaatgtactaacaaaagaccttcacgaatgaaacatctaaataatgtatataaaacaaaggaaaataatcacagaaaaaaacgtctaagatgaaagaagaaaagtaaaaccatggcaaacatctcagtaaatctaaagaaagccttactttgtaaaaatattaacagtgtttaatttatagagttcatacaacaaaagtcaaagccaccaacaacatgtcattccaaaaagatcatgaaaggaattgaaacattcaaaggtccttttattgtctgagaggaaaatattagttaacattagatgttgtaacctcagctattcatgttttatatttaatgatttcaaggtagaggtagaaaagtatatcttaaacaggatattaaaatacaaactataaagggaaatactgataatttaactatatcaaattttagaactccattcaccaaaatataccataaaaagactgaaaattccagtcacatactagaagaataaacataacaaaatataatgaattctaagcatcaataaagaaatgataaataatctaataggaaaaaaatggactaaaaatgtgaacagatatttcacagaaggggaaacacaaataacccagaaacatatgaagacatgtacaacatcattagtaatcaggagaattcaaattaaatcacaatgaaataccattgtacaatcaccgcactggcaaaaaatttaaaagtttagatgagaacacagagcaataggaagtcatcatcccccagtggacagcaggtgaatggtaagtaattttactaggaacgttacatgtgcatcctgtatgcattatatgtactgcaacaatactgctcctgagtctatgccctagagaaattcttgtgcatgatccagagtcacatgaaacagggttcaaggagcactgtttgtaagagcaaacactcaaaaccacccaaatatccatgagcatagagtgggttacaatattgtgattttttttcactcagtagaatgatacacagtggtaagaatgattaaattaaatgctataataaaccccaaacaagtttgacagacaaaaatgaaggaataaaactactattattccatttatataaaattcaaaaacaggcaaaagtaaacagtatatcatttactgatacatgcatatatgataaaactattttaaaaagtaagaagattataaacacaaaattcagaaggtagctagctatctcaggataaataagaggggcatacacagtgcttcagataggtactgctgtatttatgtcatgtgctggccacaaagtttttcaatttttaattacattttagtagacacacatgaattatataagttttaaaggtaaattattatcacaataaagaaatatttaatattgttaattgcagtttaataaacataataagtttaaattaagaagaaaagcttttcttttaaactaaatgtttaaaatttgggatttttattaaaaaatcacatttaaagaaacatggcaaaactggagtttaaatgggggttcttttctgagtcatatatttgcatagtgtcagtggaataataatgactctagttattctgactgaaagttgaaaatgtttgtttgtttaattattttagtttgtacttcatttttatagcattccctcacattaattatatattgtagttgcattatgcaaaatgaaaacaaataaagttagaaatactatgcttcataaaacgtagcataaagttacactggctgatactcacagtcatttgtatagccattgccttgaaatatactgatcacaagctcctttatctccaaaatgtctgaatgctgttaacatgagaaaaagacacctgactaacttgactgacctgcagcaaaattatttgttttcatcgaaaaggaaggtgccctcctctctgttactcacttttttcctttctgaactaatttctgagaaaattactcaattaatagcactaatttataaaattaattgtgtaatttgcctagattccaggcattcattagctctcatggaagcacctgtgtggagaaaactatcaggactctttggaaagaagacagtggcagacagtggcagacagtggcagacagtggcaccgtagcacctcaaataatgcaacaaagacccctacgcgagcttgcatcctgtcaaagaagctgttttctgctctattgaaatctttggcttcaagcactaacctcctctcatattcctttgtcccttaagctccaacttcactatgcaatcgtcctctctattcttgcctcctccagttctaactcaagtttcagtcttattagaaataggacatgctcactttggcaagacatggctccttttttacccagagggtaaagcactatagcaacaagaggtacacaggtaaaggacagtgttatcgaaacctaacatttccctaactatgcccaccctcactcctcatcagtgagcttctcctgtaacctggaccattccaaacactaacaatgactgagaagcaaaaagtttccacagccttctaacatcatcaattcaagtgcctaacaattctaatgagaagggtcttgaatgataatatttaaagctattttttcttattttatcagataaataatcaattttttaaaaaggtattcatttattcttatacctcaatcatatatatatatatatatatatatatatatatatatatatatatagtatatgattagcatcaggttagtctgggagtaggaatgggtttgtttgattaagaaataaaaaataagcatagtatcttactataaaaatgttatacttagaagagaatgtatacatttaaagagaattaaaatgaaaatgttttcatttctatatgttaatataatacagtgccaaacgatttggcaatggcattaagtgacacagaagttcaaagcacagacaaataccaatgtgagcaggagtcataaaggcttccaagaggaactagaaagagagctaggatttagggaattgatgaatggacaggagctaaaaacacagaggggaaggaggagggtatttctggcattggaaatcgaatatgaaattcagctcaagcatgtgaagataagtaggggctatgaccgtgaggtatggagggggctgatgccagtagctgctctgatgagaatatgaagagaagtaccacaaacactttgaagtctggctgtttcattcattgaactattggaatgtgcattgaatgccatctgattcaacagcaatggtttgtactcttctatcctctgataatttgctggcagcacacaccttctgtcatgccaaattactgcagcctgaaagttgtgtaggaaaatctgtggtggcaaattaagtccttgccatcctgaaagaatccaggcattcaggattgattattaacaactggaaagctgaggaagcaaagagaaaatcatcaccgtctacagccaaagtcccaaagccagtaaccatatagatattaacattaggtagcctcactggaacaaaagcattctttggtctctaaccacatataattcagagagatagcacagtatgcagaaaaaccagactaagtatcctggaatgcatgactctacaccaaagcgatatataaagtatccagagatacctagtatgacactgtcactggtccaacacattgtctgtattcctaaatctaagaaatcatagaactaacagggattatgttgttgaatgcagtatgtcccattagaacaaggagtgaagtgatattcactcactgggagaaataaactgcagttcgtgtctaagatatagaaagattcaccttttccatcctatggaccagtaacataatgtatacctttgaactttaaagagtttaaacagtgcatagctttataaatttgtagtgagaatcagggagacataaagttacaaaatgaacatttttttttcctaagtagcagtacttttcgagaaacggaaggtattgaatattcactaccttttaaaagatagcaaatgagagaggcaaggtgctttttgtttggttttgttttaaattggggaaaatgacaaaaattagcagttattaacttcacttttcattagatttaatactatcttccattctacaatattgtataatatcccattctacattgcactccattctaataataataaaataataaaacaattaaccagaagtagctaactagtatctatgaaaatacttacatgccagatatgacattaaatgatctagaaacattatctcatttaatttttatatttactgtaatatgtattatctgcccattttgtagatgagaattagctgagttatcattgatgcttagattagcaaagtggtctacctgtgatcacagacgtaaaaaattacaacatcaaaaaaaaaaaaaaaaaacagtctgtcatgtgcacttcaagcctgaaatggattaaatctagggactaaacacctactacctggtcagatgttacaatcaaagaaggttcctggagacaagggctaactagaaggttaacacaaggaccacgaaggccaattcctttttatcaccttagctatgtaaccgtaggagttgcctcaaaacaatcatttataaaggtgagaacaaacaacaacaacaaaaacccagaaacctccaaatacttcgtgattggaagagtgctgttgtggggtatgagcaagctggttgcatttaataatctgaccatcaagaaccattctgttcacttctgtattaattacagtaaaatgtgtgtaatatatctgatccctagaagatacctttttaaaagtatgcaaacacattttaaacaaggaattgacaacaatgatttcttagacaaggaatttttcaggtgataactgttttagaatgatgctactctgtaagtatgaaagttctctaatctatcactagattggctaactaatgaggatgagtagagacagaatatgaatttaaatacgcattcattccttgccttcaccaagatttatttgtaaatcaatgttattttattttcccattagttatatttgaagtaattcattccaaatatagaaaataattaattcttgaaaaattaaattcaaaagctacaatttaaaaattaagtttcatggagttaagtattaaaagacattagtcctaaacacagtctattccttgacaccagtgttttctctgtaagccattctgtataataagccgactaacattctaacacctactctaaaatgatgatctctctcctaactgtaaaataattctagtattatttttcattattaactatgattttgaaaagttgaaatgatttagttgtatgacagtatatattagaatttagtggaatgtaagcataaaaaactatttaacaacgttcttctaagagtcagctcataggtcatatccttcataaaacttatcggaagctttcttccacccaattaacaaatccctgaggggtcaactgtaccctatatggttgttcagagtctgtcattccttgagtaatacattataatagtagctctaaaactttaacatacagcagaatcttctggagtgctggttaaactacaaattgcagagcctcacagtcagagttcctgatttatgaggtctgggtggaacaaaataatttgcatttctgtacaatcctaaggtgaagctgatgctgtcagtctggggaccacattttgagaaccactgctttcagagtgtttcattttcaaaaagtctgcctcccactatgagactagaaccactaaagagcagatatggtgcctagcatgttctaggcactcaatacatatttctgaatgaaagaatgcagaggcccctgcaatgtttggaggagaaccaaatgaaaaatgagaagactgacaacgcaagtttcgggaaataaactatatatatatatatatatataacttagcagattcaaattttatttaaaccactgtgaagtcaatactctgaccttacaaatggttcagtgaaaatcttttgatgtaaagaaaaatgcgaagagtttgaaattaatacttggtctaggttcctctaagtccttttccaaaatatgcctatgtgtatctgttcattaagcaaacatttactgaatatataccataagcaatcaagctagaaaacataggaaacgacaagttgaccaaagtattacttcattttaacaaaagtggatcaaacaagtattcatcatacaattctaggaaaggggggtaccaaccgccagaaacaagagatgttctagaaactcaaagtagttcactagtgaggattttgaggtaggtagcagatagggaatcacagaaagagctggaaaactacgtaaacatataaagctggcccgaggacgggaaggctttgaatgtaagactaaggaatttgaacttacttttgtaggggtgagaagaaagcaatacttagcaaaactaaacttcaggcagggtatatgcttgagtagaaggagactagaggcagaaggactagtgagaaagctactgaaatgttctccacagaggtcagagcgacctaaaccaggtggtagcattaggagtgaaacacacagaaggcaaaatcagcagttaggcaaccgattaaatgcatggcaagagagagaaaaatgaattaaatggaaaggttttgagccttaatgacccaataaatgaagatgccacttaaaagctaaagaagccaagatgatagagtcaatatacttaaagacaattaatcataaacttcagaagcactcacttgcaggaacttctatcagagccctgggttgggggaatcctagcagtgtgttcactttgccatatacatgtgtaaagtgtgtaagtcttttattttattttattttatttgtttatttatttgagacggagtctcgctctgtcgccaggttgaagtgcagtggcgcaatctcggctcattgcaagctccgcctcccgggttcacgccattctcctgcctcagcctcccgagtagctgggactgcaggcgcccgccatcgcgcccggctaagtgtgtaagtcatttctatcttgcctgcttaagcttctccttccactcctccaacatttccttagtcacactcacctcccaccagatggccctggagaggctgtggtcatttttatttaacttttggcattctttccttaattggaactccttgaattatattagctttaagccctgaaaaatctgaatctgaccctgcaagaatagtttctggttgtgaggaagctgtgctcagttgtattcttggactttgatgcactacccagaatttcaggtggaaaaagcccaccatgggtttaaaaatctagcagaacatttgggactggggaaatacatgaggatagttgatgaaattactcaagaagagaaaacagacagaggggagaagacctaacattaaatttctgtaccctgacatcaagaacaggaagaagaaactgagaaagaagaagaggatggaacaatcagaatggatgaaaacaacaataaaacaatgtagtccagtgacataaatgccaagggaagaatgaatcttaactaagtaaagatgtagactgttccctgtgctgaaaagaccagaaaagatgagtgctgatataaagccattcctatggattggtggtcactggaagggaagatatgaatagagggagaagtttgtcatgccccccaccaggtcccatggcggagctacaggacagtttttctaacctcccttagggggatggggactaaaatttgctgctgctctagtgacaagcagtttacatatccactggaatatcgtaagatggtaagctagtatgattgacattttacaaatgagaaaacgtgtccaaagtgacaccaccaaccagagctggaactcaaattccagattttcctaactccaagtctactgtcttattctcatggccaattttaatagcaatgtacctatctatcttcactattattaacagtattattcaaataattacctggaatttagaaacagaatagccttgtctaattttaggactgttttctgaggttccacttcaattagaaatgcacacattagaaaatgcacgctattgcttcagtaatattttatatgtttgtaaccctttatttaaaaattaatctgataacatttgtgaacatgttaaaaagctaaaatgtcagcactttacttttccttcttcacagtttctaatctgtagagcctaacaaaaaaatgattaacatttcaaaagaaaacaaggaaaaacctggtagaaatatatttagcagagaaagtttctaagtatgatctgttgtttgaatatattttttaaaaagaagttcaaagtaagcattttacttcttgcattcataaagtgtttatcagttttcatcaaaacaaagaaaataagacacgattttgtttttttcatttcatgggctgatttttcatattttaaaaatattttacgtttgtagtccaatattaatatttaacacatggattaatgtacatgtgctgaaagatgaattgaataaatgccaggaattattaacaagcaatttcaactaaaactataaaacaatttcagcaacaattaccttaagtgataaattttccttcaatttaagaaataattttatccctcagctgtttattgaaattattattttgtacttgctgtatctgaagacagcaaaagacttagcccatgtaaaagtagaaagtactttttcataagtattttaatttcttacgataacacttagctattaaataaaattgcgggctggcagctgtaggctcaggcatataatggaagagaaagatggaaataccaaaggggcaggtagtcatgagcaaggacctgaaactttgatatatttgaagttttcacctgcaaccttatcttcagtttggtagtaacactactatttagtgttacttgcttatagttgtttctatccattaacttgctttgttaccttttgctatgtatataattatattctatgtacataattatatagagttgatgctatcctaaacaatgctttaaagggtatattttgtaattcctaggctgttctttgctaagggacttcagctagagcacacctatggtgcaatttactgtgttgaaactaggcagaacatcaacaataaaatttggaacacaccttaggtatggctaaaattttttaaactgacaatactaagtgtaaacaaaaaaacagaaacactgtaattctcatatattatcagtggaagtttaaaatcatgcacccaccttgagaaactgtgggacaaagtctaacaaagttaaacaaaatcctgtttcctagcctttccacttttaatatatgctcaatagaaatgactattgtgtcccaactcatttaaaaatgcttataggtataatagccccaaactggaaacaaaccaaatgttcttccacatgagaataaataatcaaatcgtggtatatgcatacaatggaatatgactcagaaataaaaaataaccaaccaatgatacatacaacatggataaatttcaaaaatatgatgatccaaagaaaccagacacaaaacagaacattctttacaatcccatttatatcaacttcaggacagggaaaatcacttatgatgatagttatcagaatagcagctgggcagaggagaactgtgactaagacgtagcttgagagtcacttcctagaattacagaaatgccctgtgtatggatgtgggtagtaaacacatgtgggtatatataggttaaaattattccactgacttatacacttaaaaacttgcacaattgtattgtatttaaattatatttcattgttaaatagaagtcaaaaccaaagaaaaccttcatcatgcttctttttcttttttcttctccctccctccctccttccctcccttccttcctttcctcctttctttctttttttttgttttgacagagtctcgctctttcacccgggctgaagtgcagtggaaaaatctcagctcactgcaacctctgcctcccacgttcaagggattctcctgcttcagcctcctgagtagctgggattacaggcatgagccaccttgcctggctaatttttgtatttttagtagagacagggtttcaccaggttggccaggctggtcgcgaactcctgacctcaagtaatctcccgccttggcctcccaaaatgctgggattacaggtgtgagccactgtgcccggccacttctttttcttacatggccacttatttttcttctttttcttatattttttatatgtgtattctgattttcctcgtaggattttttgcttgttgaaatgaagcagttaagatgtgactaatacaacagagagcatcttgaaaagaatgacatcatatagcaagcctgtccaatctgcagcctgcatatgacctagggtggctttgaatgtggcccaacacacattcgtaaacttccttaaaacatgagatatttttgtaattttttttgttttttttttagttcatcagttattgttagtgctagtgtattttatgtgtggcccaagacaattcttcttccaatgtggcccagggaagccaaaagcatggacacccctgtatagcatgagtaaacacctcagcaccaaggctagtaacagaagagatgaatgacttaataacatttaattccctcactctcccttctccaggctgcagcattctcaagaatgaattggaaacttcggttgggtgtggtggctcacacctataatcccagcactttgggaggccgaagtgggtgaatcacgaggtcaggagttcgagaccagcctggccaacagggtgaaacccatctttacgaaaaatacaaaaaaaaatagctggcatagtggtgggcacctgtaatcccagctactcaggaggccgaggcaggaaaatcgtttgaaaccaggaggcagaggttgcagtgagccgagatcgtgtcactgaactccagcccaggcaacagagtgagactccatctcaaaaacaaaaacaaaaaaagaattggaaacttttcatttcctactaattccgtcaccgctataaacttctgtcacctctcctaaattccaaaacctcactatgctagtaagagcctcatgcacttgactcctgacccagaactgcttggtcaaccttctaacacatcttgtctcttgttatttcaagcacagttatctgagtagatgctagctcaataccccctgcctgtggaaatatattaaatgcctccacatacagaatcatctccaaggggtagaagataagaaggctagaaaagaagttaacaatagagaaaaataccaatagattgattacaggaaaatattacattcctaaacattaatagcaccataaacaaaattaaaaggtatgtaattaactgagaaaaaaatgttagcaatatatataaaaatactaaaaagggctaacaacatcaataaagaattcttgcaaatcaatgtgaataaaaggaacacatcactaggtaatgcaaggtaatgaacagataatttggtgaaatacaattggcaaatccacatgtgaagatgttcaaacgcagtagaagttaaaacagtgtaaaacagttaaaacgatgagggtttttttttcttataaaatgataaggactgaaaataataattgcaatctgggaggcccattgtgctggatagtacaggaggtagtataaagaaacatacagaggaggagaactcagtttggcagtgagtattaaaaatctaaaaataactataccttctaactcatttccacacttcgtacacaatacaaatatttagattaaactatcatatataacagtagtgtgtgtgtgtgtgtgtgtgtgtgtgtgtgtgtgtgtgtatatatatatatatatatatatatatatatatatatatatatatatatatatatatttttttttttcccccccgagacggagtctcactctgtcacccaggctacagtgcggtggagcaacctcggctcactgcaacctccacctcccaggttcgaatgattctccagcctcagtctcccgagtagctaggaatataggcatgtgccaccatgcccggctaatttttttaattttaatagagacagggtttcactatgttggccaggctggtcttgaaatcctgacctcgtgacccacccgcctcggcctccaaaagtgctgggattacaggcgtgagccactgcacccggccagtgtttataaaatttttaatggaaaaaaatctatctgtccaatatcaaaaagattggtaaaataagtgcagtctagatgatatgccacgtatctctaaatatttatattatagaaggaaattaatatcaacaaaagatgtgtatgatgccatattagtttttttaaaaaggttgcaatacagtctgcacagtaggcttctatttttttttaaatgattaaatacataaaggcaaactactaaaaggaatataccaaaattttaatagtgattttctttagatacgattctggatattctattttcgttctcaaacttctgttttccaaatcttctatagcgataattataatcactaataaccaatgttatcgaaaatttccatgatctctaaatgccttaaagagttcgacagaaagaatttaaaaacataggctctcctttttcttctttcattagtgatgatgggctattaaaacaaggccacgtccttttgctttaacctcccatccccagggatttcacattagaatgtccttcctcccaatacctactcctaaccttccccaacccagaagttagtttctctccattaaaaaaatccccacagtagtataaattaagcaaggaaccattttaaactgtcagcttaatggtgcacacaggaaatatggctgctctcagtgcaagaaaattttaatgaataaagtagcttaagaaaaagatattttccaactataagtggaaaacttgttcagtttctcagaggttgtttactgccataggaattacctatttaaacttcttcacaacgttatcacttggatatggttaggttattctgcgtgtgggcgactcattaataaagctgaaggaaaagcaggacagtgctaggaaagaaatctagagctggacatttaatattcttgtgtgtcagagactacatttgtaatattaggggtgggaagtagttacttgctaaaatcccactttatactccgtttctgattctaggggtgtttttgtcatccatacaaagtcaaaaagaatgcaaaattataacccaataataatgtcattttttaaagaaaagtatagatgattcaagaccaagaaagaggcagttcataaaagatttaatgttgaaaaaccacaaacataaaaggaggctaaaattggaaaagacattataaaatctaaaactttaaaaatttgatatgataaaatatatgctggaaataatatgcaagaaagctgcatcaaagctttcttggtcaaaggaaaaagtgttaactattaagagattttttaccttaaaaaatacaaagaaacaacttagtttgcattatagactaaaataatcttttcaaaggatattgagaatagaggaccaaagagtgtttttatggaaggacaaaaggagaatgcagagtgagatttaaaagttgtgtgtgtgcatgcatataaccctcaaaagtataactccacaccaaaaacaaagaagtagctgtatctagggatgttctattccatcaaaactatgtctgtgaagctttaaagggaatcttcttgcagtctacttcctatatgaatactctctatgtataacagttcattctaagagaagagcaatagatttaaccacttgttagtatccttgttagcagtatatcaacagcaattgatcactaatgtgaaggtatcaggttttaggtaacttccaacaccattctccttgtgttcaagtgattttcctgcatcctctgaatagaaaccatcactgctaagaattgctccttagacagtacctgctggaggcttgcaaagatcttaggtaaaaagtcgtaagttgaagatattagttgataatggcataaggtcttgttcctcaagcaattgtgctaggaccgtctacattataatctcttaaagtggatatttagaaatgcaaattcttgagccctacccccagattactcaatagaatctttaaaggtacaacctaggcatgtgcagtttcagtaaactccttaggtgattctgatacagtttaaattttaagaattaaaatttaattatatctgtttgtattacatctcttcaacatacagcaaattttaataaaagctatcgaggtactaagaaatgaattgtaaatggtgaaatcacaggcaatggaaggaatatttaggtgttgcaggcaatttattatagcttgaaaatcataccatgctaactgtagctagctttaaagtaagttctgactaacagactgaacatattattgcttctgtgtgagtagaagaggttatttagaaatctttctacaaacatttgagtatctatgaaaatttacttttgcacactgagatataacaaaaaccacactttctgtcctcaggaaatttaatccaggaaaattagagctctgttttgaaagcagaggaagttaatttaaaaaacacagactggatgtatcttaacatcacctcctaagctcactaatgatacctgaaagcattcaccttcacctagttggagagatctctgctgcaaggaaaatgttaaccatcttgccagctaggcatcattcttcatactataataagcaaaaggcatttccaaagtgagactctctttgtaaatttgtttgtcattcttgtgaagaatcagatgctgtaattattaagctttttacagaacatttcaattttccaattgctctttaataattcccagcaagtaattggacattttaattatatgtagcttcttgtcactgttcatctaaaaaacatcacaacattaaactaagatgctcagcctgagtgttttcttgggttgtatgcatattttttgagttatttcaacaatgatcaaaagccagtgagttcatccttcaaactggaatcctcatttcttttccaaaagacaaaaactaataagcaacaaaaaaattaaaccatcacactaacaaaatgtattaaaagtcaatcgataatactggccatcacaccaacaacctctacctttattttattttcccataaagagccactaatccattttgtttttttctactagcttagcaagtccatatggactggaccctttcagtgtttctttcccagaatccctgcagaatcattgatctccttgatctactcatctctttgatcttttgaggatagtctacaaatagcctgtgctcccctacgtgggtggcaatagcagccctggagccttcaaaccagcttatggggttatagtcccagctctgccagttacaaacatgcgactaagtcaggccaattaaagtgaccgggctgcaacgttgccctacctgcaaaatggggcaaaaatcttccatatttaatttacaggcttgtgcagatttcatatgaaataaaaagagaagccactgtgtaaaccttgaaatctctacaaatgtgaaaatgaaaatgaaccaaacatctccccaatattagcatgacatctatcaggctcctatagaaatcagtaatgaaggaggatgtgtgcccacccagccatgccatggtacaaatggggcctctggtgtgtcagaaaagcaactggaaaatggaaaagagatggttcccatctttcctgtgtctgttctaggacactgcgagtcctcccgaaggtgtctgaaagaacacaaggcaggcatgttaagtgtgaaagacagcagaatggatttgacggcctctattaggcctgaggtcttttggcagagagtgagagaatgtcctattccaagcagaaggcacctgataagcacttgattgattggtctctgcattcttggcactcagtgaaacactgatttgccagcagagtgtgtaaacacccacattttggtaataacctaaatatctgcatattgtgaatgaggaggctgactgaatgaaattgtgtaaaaacagaaagtcaactccctgcaagtcttgccttcaccattctctttgcagatgcaggacttttaacagtgaggatattaggacatccacaagtgaaggatggagccctgccctgctctttgggagctttttgcctgtgtgtgtgtgtctggccctcattcaaggatatgctcctctctggcaactcccagccaatgtctagagagcacagcactgtgttttccaacttaactaagaattaggtctctttgctactgcctttccttaagaccaggaccaaatatatatatatatatatatgtatgtagatattgtttaacgggcctcacgtctaggcaaaatacacacacatacatacacacacgtacatacaaagtcattcattcaatagtaagctgcatttgtctggaattactaacaaaaattgaattagcaattattgcactgttgttttcttttaaaagcacaagttaaagtagtgttttctgctcatgcttaataagattgcctttctctctatttaccacatacccatctttcagagcttctctaaaagcctatgtctttcttgaagcttttactgattcccttgctggaaaatgtatctctgatttctaaatacctacactgccctagcacagattgctaagtcatgttctttggaggtcctatttcccaaatggcaggcactccatcacaagggtctccaaaattctccaaaacactagggaatgtatgaatatgtgaggtgggaccgatattcatattggctccagaggagccaggcaatgctttctccagggatacttttcactattatctgttatctagaaaatcgccttcattttaagatatttagaagaaaatccaagttatgtggtttcatagattaaacttattgctggcacttacataccactaaaagttaaccttggaggaggggcgatacagactataactttaatcatatcagcttcttgtcttaaccacatcttgctttgactgaactactctgatcctaaggactcctgactgttgatatcacagcttaaaggctttcttcagactccgggagagaaagtggtgggacactctgtaaagtgattcagttccaaagtatatatatcatcccaggtgatcatagagcttaaataaagttgcttcaaactagcatgaaattttgtctaatacacagtccccaaaagaacctctttagaaagaggatgaaaacatttaaacatggatgttaagttcctattaaaacactcatttattttaagaaattcgctagttatgttttaaaaattgataattaaattacagttgctgagcattttcctttgacttggtattttgaaatgcttgtgttctgtctaaatgctagattcttagcatttggctaaggtatacgcatcaaaatggccacagtaaaggaagtgacattagtaattctgggctaggaagcactgtttctcttaccgaaatctctcgcaactgtaatccagccaggtaaagatagctttgtgtttgctgacattttcagagttgattgggcaaaaaaggtgcaatcattttcctaagtttttcctcgtcatctttaccctctccccaccaccccctgccgttattttcaaaaggcttaatctaaattctaaaggaatgttctaagagagcgaggaaaaaaatattcaacactaaactgcagcaatagccttgacagttcagttctgctgcaggtgtcctggtttaactcccacatggacaaaggggatacaaattgttgggttactacacaatatcctcttgttaacatcgtgttgtcctcttttggaagaatcagacaccaggaaaggatctcaatttcaaccctttgtcttttacttaaagaatctaccaaatcagtctagaatgataagaatgaaatgtgttttaaaaagctcagaggagtctaccttatatctaacctcagtcctttctgttttttttttttttccagagcagaaaagacccactgttggagaggggttcatctgtcacttgaggggcagcagcaatttatcagttcctgtgccagatgtttacataatatcaagtcttcacaacagtcctacagaggccctatttcactccaggcaaaaccaaggctcagaggcttaggaactgcccaaggtcagatagttagtagacgcaatgagaattataagagtaatcctttatgtcacaagggaattccagaattcctgtaatgttattttaagtggaatgtgtgaaatgccagtaaataaacaacaacaattctggtgttaaattgaagaaacaaaagaatctttaagaacaatgtagttaagagactcaaactagaaagaatttaccatcctttctgaatgttgctccaacttatagtctaatataaaaactcataagaaatgagtagtagagatgcttaaattctctatctagtctacaataccatgcatctagaaacgacacaatttgatttttaaaatcttcaaggcttcataattaagagaccataattaaaattagaatactcaaataagtttattaattgtcagtcttttctctatatcctgccttcagaattatacgattttatttaaccatttgcaggattcctttcatctcaggagagtataatcatataatcagactcatcaccactgttcccttttaattgtaaatcatgactgcgcttgcaaattagtctattatcacagcagattatcaatttggtagggaaagtatttgccatctagaatgaaagtagttaataaacattaataaacatcttaaatcaatcactcctttactcttggtgtgccgacagatgtcatttgagattaataaatcagtcagaacaaataaagtgatgaggaagcgaagcacaaggaagcctctcgatgccctgtgtacttaagaatcacaatgcctaaaaactaattggaagataaagataaggcattaaaccttcagagaaatgacttgttggaaattagacaaagtaaatccagatagccattctctgtgggtctgttatgaaccactggcaataaaagctagaggagaaacaaaatgctcagtcagaataaattatgtttattgacagcataatgtagaggttaaaagcatggactttcttttttctttttctttttttttttttttttgagacggagtttagctcttgttgcccaggctggagtgtgcaatggcttgatctcggctcactgcaacctctgcctcccaggttcaagcgattcttctgcctgaccctcctgagtagctgggattacaggcaaaggccaccatgcccagctaattttgtatttttagtacggatggggtttctctatgttggtcaggctggtctcgaactcccgacctcaaatgatctgctcgcctcagcctcccaaagtgctgggactacaggcgtgagccaccgcacctggccaaaagcatggactttctaattggcctgcttgggtttgaatccagggcccacaacttccgtttcagtgacttaactatttcttaattttgctgtgcctcaatatccttatgggtaaaatgggagagtaaagtacctatctcataaagttgttgtaaggattaaatgaatcaatattttgttaagagtttaaaacagcacctggcatataacaagcactgagtgattgttcaataactaaatgatataattggccatttactaccattttatgtgctctagttctttctctgcacaggcttttatgagggagaattggggttgtgaagtaatcccacaatattttaatcacttcctcactataagccaagagttgaattaattcattttgtaaaaataattaaaatttaattaattctattaaaaagaaaaaaacacaaatttttcatttaaaaataagattactgaggcaaaatgttaacagtacaaatagactgttgttgtatagtccagtcattaattaaaggcatccagatatcaataccttgtgtattaacacaagacttttgtataaagatgtttaccagaagcccatcaggagtgttccacttttagttatggcacaaaacgttatccactagcatcatcaacaactcctctatatctcacctaggactagtcccaagaaaaagaatgagtagggaaaccaaatacattatttgcatatttaacagcatgtccaattagccactttgctgacagagactaatttattattcatcttattccagcatatgttactactttgacatccacgtgacaaatgactgatacagcacattgtgattttgaaaatgttaactgtggacttcaagaaaatgtagcttagactattgaggaaagtttctctgcttcaccttcagaaatatggaatctagaaaatgatcaatttttctactatgtaggcacaaatggtccaatatgacataattttcagaaatgagtatgaaataaaaggaaataagctatcaaatggtgccctgaaaaccaaatagaaggttcaatctctacgtacatcctctaggcaaaaattctcagaggtatttaaattagacatgttccagtattatttctctatactagattgtaatatattttataattgaaaaggataactatacataaaatgatatagatgcatagataggaactaaatcattcattcaattaacaaagacagaatcttgaaaaatttgaaagccaagttcctcagaaaaaccacatacttctttcaaatgtgcttggatagttttatattagaaagagaaaaaaaaaaaaaagataaaacaatgtgttgctgcatgccccttcaaaatgtgctcatcggttactgtgagagtactgtgtcacggggctaccacacttttcctgaatgtattttttagaacagcatcacagtcaactcctagtgaagtactttatgctctgtaactatccacactttagatttttcagtcttaacataaaattaaaaatttcagaatctaaaattatctgttttaagtagcattaaaaataccacttctctttaagcagctctgaaacctgaagtcatctagaaaaatatgccatgatgaccaaatggtaactaattgccaagacagactaaaccacataaataattacatgtaccatcgttagtccaatggcaacccagataatcaaaaaaaccatgattatcatggcatcatggcagaagtgttgtccaaataagtaaatttcactgccttgtattttaccacatattaaaaagcactcttttacaatctgttaattttttttctttctttatagttgctgattttcagagatatatcataatgcttttaccaattttaattatttgacaaacaagtcaccaaatatatacaggaacatttaaaagttcacaaccttggtttaaaaaatgtaggtcacattatgcaatacatttaaactggggatctcagagcccaaagggttctatattctgaatttcacaacaaaaatgactacaagattcaaagaaagttcatagaaaacaacatatacataaccacataccttgaaaatacactggagaaacacctttctatactgcctcagttaaaattcacaaatctcaccgatattaagttcccacaattaatgcagcaggttcttcttatctacttgtatatttagtgattaaaaggaagtctgtacaggaatcatcatcttctagtgttaaagctttttagtatagtggttactatttaataaataacattccttatcactacctgagcataacccttcaagtcaaatttgagaacagtcctcatttattaatccatctccatcttcctacttactgactaagtaccacaaggtaatattagataaaattccttccactgaaatgcagacataaatttcacatctatattgacttgaaattcttaataactatgagttagctactcttttgtggctaattttattgttaatgaagaacattttttgagacatgaattggaaagtaccaatgctgggacaaatttcaggtcttctaatttaaatccagtgggttttgtttgttagtcttttccaaaaccctgccttttatattgtcatggaaaagcaaatgtacagtggctatatattaattaggtgaacctgacataatcatcacctctttaaatttgtttccttgtcagcaaaatgatgatcataagccctgccgtggttgtgatgatgattaaatgagacactttatatgaaggcactgtggaaatatatacttaaaagatagctgttttcactcagttctgtcaaaagcttgagggaatgcattgttatgtgatcaacactgaacaatcttgtattttgtgagagaatggaatattttaaaaggccattacaagcttctatgtggagagatattctacaccctacatagaccagaaagggctgggcaaaaagaccaaatgaaagaagcgggtgcttttctaagaggaaatccttgagacctcagttgcgagacaagtactaggccaaatgcaccttgagcctgaccaccacgccatggctcctgtgcacctaagtaagccactcccagaataatcatgaggacaattagatggcttaagggacctgaatataatctttgcaaaaatatctccagttacaatatgtttagaatcaatacgtccctgggaaaagacaacaagaccatgaggattttaagaaatccttatgatcaaaggaaacttagaattggaaatgatcttagaggtctgctagtccaatttaaaaaaaagagagagagaaacagagaaaaacgaaacaagaatatgaatgacaaaacagtataaaaagtcatgctcattattattgagattgttaacatctcaaaacataaattgtgtttttttctttaaaagaggcacacactgtagcataaatgagtcatcgagggctgactgtggtgatggtcaacagtaaaggaaagctggttttctctgtatgaaccaagtttggttgctctattctcttctcaaagaccaagcctctaatcccagttaattgtctaaaaaggactgcttttggtcatacagtatacaggtgagagtgtagatgaattagtgcaggctttcccttctattggagtacaggctttatggaagagtattccataggaggaggaagatgagttagaagatatgggtcctgcctccatctctgctgctgatttgctgtgaccctatgagtgtagttcacttaaattatttagatctctgttgtcacatctgtaaaatgaaaggaatatactcctcaaactttagaactgaaagaaatgatgttcaaagtggtaactgaattccataagtcactgagttaataactggctgaactgggacaggaactcaggtcttctgattttaaggtctagatttcccctacatgtgctctaaagtctcttttaagtatttcttaaaaaaaaaaaaaaatcattgggaacctactatagtctgggcacttttcaaattcatggtctcatttattcttcacttattgtattttcattttataaatggagaaaacattcttagtaaagataagcagcttcgtacatttacacagtgctagtaaatggcaatggccaaatttttacacagatatgtttctgagaagtatttagtcagaccagtctgcattaattattcattattagtgtaaatttaaatcactgaattcctatcttaactacatttacaaaacaagacttatatctgttcgaaaagtagaaattgttatgttttgttagaaaaaatatatgcagcaacttggtggaaaacaactgtataaagagctctttctagaacattaataatgaagggcaatagaaagtggtgtagataaaatttactattttgatgtttttatcagatcatttcatggtgagtcccagatgattgctacatatacataaactttatgttttttgcatttatgcttggaaactatgtatttttaaggaaaaaattgaatttgcctctttaaggattaactctttccaacaatagcttggatttttagaactaagttgtaaacttcttgatggttctgcctccgatatcttgcctcctccaacctcaactctactctcatccttattattctctggtcctccatggtacctggtacacaaatacaaacacatgctcatagtaggaatttatgatatatttagtgaataaatgaatgcatgaatgaacaatctaagaaataaatctattaaagttttgggcaaccaaaaaattattctaaagtgccagggttacttggatcatcattgattcaaagattcttccaaaaatagtagctggccatcttgttgaaaacagcatttaagtgatataacattttgtccaagaatccaaagtaaggaaaaggtgtggaacaccagtgtctgtttcagcagaacagtcatagccaaaaacattctgggtcacacatatgaattcattaccagctaattaatattaaacattaaagctaaatatttccccaatgtagagaatattgtcaaaggttttgctagctctcttggttgccacacaaaagagtaaagggattactctatgaaacattaacctcctgcctcctggaaaaacagagaaacaaaaacctcctcagcagaatcaatgaagtaatctgcaggactccagtgaggtaccaacagctttctaacagtgtgcattattgttaaaacatgcttgaagcaaaacgctggaccatgtatcttgtaattatttcttaagagatcaaccattaaacggcatagaggaccctcttagtttaagtttaagtttaaaaacctctgagctcatagaattgctctgggctatgggccataggccttgattctaattcctctttgactctgatcagacatctggctccgtcttttggcccatttatggtatgcctcagtatccctacaggaaaatcacattcaaactcactctgaaacctacctatcctcttagaagtttggtatgtgtactgaaagtgtctcagaaacagaaacattataaattcaagatataattattatccttatataacaccattaagcaacttcaattacaaaccacacttttaaaatctgttaacacttccttctgggaaagcccttttgccctttaatagtgtaagctaatcatggcaatataatttccagagctcatatttgtgggaggagaaaggatggcactggtggctttctccttcctttatctcctgaaattattgagagactctaagctaattttctaaagtatgcagaggcacttaggaaagccgggagctgagatgggaacctaagcatttcactgacatcattccatgctccccacatatggcacatcacataagcagtactggctgagcacactggtctattctggactcttgttggcgttaagtagcattcttaattacaagcaggcttgctttttgtcatttacagtcacacagttctccctctatttaactagaaaaaaaaaacacaatttttctatggaggtagtttcaccatttatgtttttgagccaatgcaaaatataaaaggaccctgcagtgttctcaaaacctgcttctcacaggcccttaaaaaaaatcctcatcataatctctgcaactgggtcagcttgcacaaagatactcgggtagccatgagcgctctctgcgccctgcaaaccttgtaagtgacacctcataatagtgcaaatgaagcatggcaagatgagaaaatgaagaagaatgaacctggatagtcagcccagcagctttcaaaacataggggactcaattttattccttaaactataccataaatgaatttttattttacacattcaagcatatacatgcattctctattatgaaagaaaatgtcttacgattcacagaaattctaatacaaccaaacagcctagttcatttgttcatctagccaaataaatttgcaatagtctcagattttgaactaaacctcattttcacttgtcttgactttcagctatgaatttatcatattgtcattaacgtttgtgctttcctttcaccctcatctattaggctcaagggttctttacttgtgggtcctttgtcccaacaactagcgaaatattcagagagctattgacccaacaaattcaacatcacctctttcttattaggtttctctttaagccatcaccctgcctgccgtgttctcagtccctctgcactcacacctcaccccatttctccatcccccaccctgagaggcttattttttatcctaatgttccttgattgttctctataaagttaatattattttcaaaagagagaaaggatgaagtatgagaaattcacacctggcttttatttggcaggggttggttactgacatgtaagtttgcgcctctgattgaaaaaaacaaagaatcagaagaggagcagcctcttccaaaagagtaagcatgaaggagagtgggcagaaatccaaaaatacacaaacacgaccatacaacagaaccttcgaaggaaacagaaagttctttgacccaaaagaataataccaaccactatacacacaacaattttctctactatcctattctttctctttttcgatgacagacacctctgatttttcattcacatgcagagacaatcactgtattctggagggaaagaaatgtttgtaaaggccagcagacggcgcctgactggggcagaagcttgcagcggagaggaaaaaggagtgccccactctgcggcagggccccttggtcttctcctctcccacgtccccagcagccttatccctctggagagaggccgagacacagaaaaggagaagttgcatatgagattattagccaagtgcttcccactggcacaattaggtgttccacctgctccatacacccatctgcctcaccacacccacctacccacactctgcccttcctgcaccctggcttgcctccgtccctcaggactcacacaattctgcacaaaggcagggcagtggttgagaactgcacccaggtaaagggaacaacaagctcctagaatactgtgggcttgtggtgagatcaccagaaactccttattctttcagagagatctaatctctgttacttataaaaataatccctagcttgggacatcactctcgtctccatactagacactcttaactggagagaatttctgggagagaactaggagaaggagaaaggaacaaattcctagaacccacagggatgtgttttttctagtatgctcccaaagagggcttgctaggggacttggtctctcttcagttagattatgctatagtttttcatatctaaccagaattgtccccaggtgggaaacccccaccccaccctgcatccatggaataaagggccatcctggtagcaccagcagctgctcagggcagagcaaactcataaggagtggggcaaaggattctgagctgaaacaagtctgaaaggtgacgggtcctgcaagaaagaggtggaaaatggatataaaaaaagtgcccacaactttcactctgctttctaaacaagtgcattttacaccggggtagaataaaaattgggagtggggaacgactcacaaaaacagattgatgttttaatttttggcaattcggggaatctggaatagatatttatctgaaaattagaggaatctggcctcacagtgctggtcactctggaggagaaagctgccaaccaaggcttttctctacactctgctgttttcaaagggacagggcattaggagaatagtttcccttagctctaacttcttctccaggcagacctccgggcttagcccagccagcattgactgacttgcccttcctggaaagcattaatcactgaaggaggaagtaagacctccctggttccaatagccttcacacgtgatcctccgggagatgggtatgtgtagtcaagcctctctctgttccatttagaaaagaactcagcctaattaccaagaaaaagacatatatttatgtgcagagtggatggaaggggaatggtgtccagaggtcccctccatgcctgcgaagggctggcccgcattaaaggggatgactcggttgccctcctagcttttctaattaagggaaggcgtgggggcaaaagtaattggcctcctgttgagtgagtcccaggactgcttcgctgtcactgcagtctgggcgcactttggaggaatgtgcgggctggaatctctccctccccgccccccggggccagggaagatgggcaggaggtggggcagcatatacagcacagacaaaaggttctgcagagccctcttctctctggtgctcaggtcccttagctgagcgcggcgccccatccggccactgagtgaccttctggcaactgacgcccccttcccgcggggcccagccgcgcgaccagggctggtcctttagtaggtgtccacatctctctcccagtacctcgacaaggaacgcccctcccacccctcaccaccaacacccgcgacgccttcccccatcccctttctattgtcttcaaagagataagtggctcgcaccaagcacacccaaatgcacctcccttttgtcgagctcccatttctctgagccttaggagcccaggagcgagtgcagggtagaaagaggggagcgaggggataacccgcgagaacttggcatcgcagacccaccgtgtccgcctcgcaaggatgccggtgacctgtagattgcaataggcactgaatgatgcttgctgctgccatggaaatggtggatgtggtgcgctcccaaactggatgccccccacgccactcctaggaggccgctgagggtgagcgggactatccaaagcagggccaggcgcccccctgcgccgccgccgccgccgccgccgccgccgcccccgggcgagcccagctcggcgccgcaccggagcatcctctggtacatggcggggcgcccgccgaggggcagccgccgcgggaggcaaagtttggggcgcggggagaggagagggcgcaggggagcgggcggcgcggagtgggctgaggggccggccgcctcaccgcgccagggcacccatcctctccctccttcggacagtcttctcggggtcctggagtccgccgtgcctagcaccccaaacaatccgaaacatagccgaggcgaatgcagctggagaggggcttgtccggaaaggcagccccgggaacagcaagcgcggagcgggtggctgctcccagatttccagggctccaggttctcgagagatactcccaaagagtttcgggcgagagtgcgtgccggcgggtggggggccgagaaattgtttaaagctcctcctggaaggtcctcacttctacatgacagacatccaccgcgaatccactaggtaaatccatttagctttgtgtgcggggactagggaggccacttcgccggcccaacctcctttcaagacagaagcagaccccatggaatccaggcgccccttccctccattcagccccggccggctcgcccgctagcgccagcctcccccgggcagcgcgcggagcagcggcgcgcatcgcctgctcccgaggcaatctccgcgtccgccgcctcctgacacttacgcccggcgaggggttcagagggaagagtgcgcccttctgaaggaagtgggaatcgaacggcggaaaggcagctgagaagaagatgcagacgaaggagtaagggagagaaacagaaaaagaaaaagaaaaagaaaaaaagaaaagaaaaaccacacacgctggtgaagcaaggggctctatgcaaatctgcagtctccaaacagcaaatcactgaagctcggatgcaatgcagaggacgagcctatgtaacgagggaggctggtctagcttcccacgaaaatcgccctgctttgcctctcccttgcattctccacgcatcaaagggacacgtgtaaggcgaaacgggaacacctaaaaagcaactctccctccaccaggtgatccctccatctgaactacaatggcaaatggcacccttcccctacccaatggtttagatgtaaccagtgtctttagagatcttaaaagggagagaattcgggtctttttattggaccaaacttgttctaccaggtgtttaaactcaatctgctaaatatggcttgataccttgtactcaagcatcagtcgcgatgatctgttaatcacatatgttactcataacaaggattcttcttcccattaccatattatatctcatataaggcagtggaagttcaggggaccaaaactcacaaggagggaaaaggatgcattaatttggcagctgcagaagaggcagaaagtggaagaatgggaagagaggaagagaagggtcaggagagaaacaggaagaaagcagaaaagaaagaaatggcatgaataaaattgcttgtatttcagtcaatattttaggaatatttaagatcttccaagatctctatagaagccccgctgtgatgatctttgctaacagtggaactcctcctttctctcatcctgtcttataaagaaaatagcatcaggaaatgaaaattcctaaatctagtgcccccaagggaaataggacatttatatgcttttgatgaaatacagcatctttaactgaaagctgtgtgtcctagatgaaagaccagcaaagccagcataaatttaagagtagaaatctagcaatgcaagtgaacttggctaggaggaccacaggcactggatgctggtgattaagacttgggactatgatttaaacatttccctgatttccaaaagatgataaaaaactatgacatgtccagtggctggacttttttttttttgtctttatttctatttaaagccaaaagaaagcaacattgaacaggaatgatttctcactagcttctcaccatctacataattgttatcaacaaatataaagtccagtattttttaaaaaatgtaattctgggaagatttgattcaaatcagctactaacccaagtggccatttagacttgtatattgcttcctagtccaaagattcaaccatgggactctgatgcccactatataaatagtgtccagtggcccccaaatcacacctgtagcaatcacacatgtcacattcctgtcaaaagtttattttatgatactaaaagataattcttcagtagtatattgattgaaacagttcagccttgctaaacatgatgcttttatctatttaaatatgccgtgtctcccaaccttccacagctgctcgaaggccagcagacgcaaaatctatcattttccactgtgaactgtttctgcccttgcccccagtcatttcttactcattttgttattttgcaacatatgtattttaattcactaacaagagtcgtgattattcgttttaaaaatatcaagtagagcttcaaaaagaaaaggaaaatcatccacacagtatgttttcaggactgcaggtccatattctgaatttgacatttcatagtgttagcatggaaagagcactggattaggagttaggaaatccgtactgcatttttgatgccaccatttactggttacatcacattagttactgagtctttccctgaggcactgtggcttcctttataaaatactcatgtttctatctttcctaacaatcccacagggtagaaaggatatcatgcaatatttaatgttggtgttctttaaaatatgtcaactgctccctgacatgaaggcgttatgtctcttctctcatacaggtctaacatattcaagctgatcaccatgcacaatacattcagttgccttccatctaaaagatacgtagaacattgcattgttttccaataccctcatatattgtgttaatctatcctttcctccccaaataaatggtagatgcctgaaggggacaagagtcaagtcttcattcctacttcctctagtgtccagcatatgtgaaacatatctagtctcttagtacttacagtcagttctcattattcacagtagctgtggcaaataaagtccctgtgaacactgaattagcaaatactgaaccattgctcccatggggaaatacagggctatgttcctgcaaacctctgatcacattttcatcactgaatcaatccattgccttgttttatgtgtttctgaatgataatgacaccttccttaatacataatgttgattcatcaacattgaactcatgaccagcagcactctaactcatgcctaaaagaaacatatctaatatgtattttctccataaggcacatcacatctttcttgcatttaggaacattagacagccctttagtattatgcttgagggccattttaaacagcaaagtcaccaacgtaaaacacaaaaacgtggtgctaaaaagacctaaaatagcgcacttgtttacagtgtgagagctgaaacaagaaggaagccaatagtcttgttcaacttcagccaggaacatgtgcattgggaacacaaacgtttgccattctctgcgtgtttgctaaggatcatcaaagtgccagggctacaaataaataacaaggatcaactgtatttgttattctcttgattgctaggaatggataaggctgggactttggagagcgatttgtataaggaaaagccatagaaatagaataagcgtagaagattgtgaataaccttcccaagagcattcaattaggaagatgcttcccctcctccctcactcccctgcctgtcttatattgtctggggccttgggagataaaggcagggttagagaaaggatgggccagaaatcttagttttacaggagtctcaagagctaaagagaaaatatttatggctgcctcaaaagaagaaattgtagctgtagtcttccaggcagatgtctagggcacctttgcaatacttaggaggttctagggtgtatgctgtgatacggatacagcaatatttgttataaatgattgtaattttgtggaacaaggagcaattctctgtctagatagtgtagaaaaagtattgtgggcaaaaacatgagtaatctggatgaagcaaataaagcttgtgtgtacccattaatttgtgtctcttcagctactcagtctttgggcttgcaattttgttatctaagggaaactgaggcagaatctcacaaattgttctcaggtgattgaagaactggttggaggaaacatggtttttggctaactgtaatgtattctaaaaaaattcagcacagacagtgcgatgtaagtgtttcttaacgctgtctgtaccccaagagtgtcagtgcctttatcaggaatttatgccccaacacctcagtcagaattacagcagacagaggtggcttctagaagccttgtgctactatcatctctaattatgatgtggctgtgctcattagttataatatctgttgaaaataagttatcactgatgaaattaagggcttgttaattggtccaacgaaagttaggaggaagttaatcctttgtgaaattattaataggcaagatgcgtgaattaactaaattttacctgaacacgcctcacttctacataaacagagtatgtgactctaagaggcttttcaccctttattatgaggaatggttccataataatagtaataataaaaactaacacttatttctagcacactactctgagtgatttaaatgaattaattcatataatcattacaaaatgatatgaggtaggtactattgttgatccctaacagttcttagtcacttaattctgagagatggtgaggtgggtgctgtcgttgaaatactgtcatatttgcttcaggaaaaccatttttggaagacatttttttcaggtacttaaaagaatgaagagctggaacttcaccaagcttctagaataggctacaaaattttgtgcctactcattaataaatgtctagatctgtagcagaagttggtcttggtgttgaattcattatgagctgtacttgtgtgaactcttggaaacggggttcacactcagttgccgccaacaaccatggctactgagatctacctaaaagaacctaaggactgtatgtgctaagctgtcctaagcccactcacgcctgatgatttatcatgaacaagaatacagggagcctacgttgaacaacagttaagaaatgagacatggatttgaaagttgagaggaaaacacaaaagaaatagaaagagatggaagaggagagtgagtggaagagggagattctggagaaatgggaaaggacaggccatttcaagttatttcttcatattacaaaaatcaacctttttgtctcaaaaaacaggatggttgtcaggcagacactttcattcttttcatattttccttaagcttaattggaaacccttaaagctcagtattaagctttttaaatagaaaagtagacactaaaatcagcagaggggaaatatattaaaacccacaggcagcactaatattttaaaaattaaaaatgagaagagtgtcggtcttgcattttgcatttctaccagtatccccataaagtaaagataagcagaccccacatatccatctacctacttttctgagtttgaactgagcgtcagtaaaaagggacagactcagaagagggtttgttctggagagctgtaaagctaaacccctgatcctgttacccctctggattattgcaggtccctaagagtaagatcagaaaatgagagtaagagcattgataataataataataataataatattataataataataataataataataataatgccaggctaaaagcatctctggagatttactgcaatctttttattattcagatgataaacttgtgttacagaaaagtcaggtttatttatgaagtgtttatttatcttgaggaacactttcacctccaaccaccgatagtccagtcatagatatagattggtgaattcagtcaacttagctattacctagcacctccccaatgatataacaaatcagagggagtgctggggatcaagatgagccaatgcggtactcaagtcactcaaattgaattaaagcctagatgtgcagtttgacttggaaacgtgactagatttattcaagtcaagattggttgtgtttagctctgaaatattctgtaatctctatcttgtctttcattcgatttaataaaaatttcatgtttggtggcttgcatacaacttggtgcttaagtaccaagtcagggtcatagagatttcactataactgcaagttcaagtgttgcaggcatcacaggagcaccaaccaataatatgccatcttttaatcactgtcagcttatatagtttgtagaattgtttcaaccgatttctgttggtgacaaacacttcctaggctcatgctctttcagtttcaatgtgttcataatgtagcgtgacaacatgagactggagtgcctgactgtgagtatgaatccaagcttcattgtttttattcatgtgacattgagtttaagggccccttgtcccagtttcctcatctggaaaatgattataacgctaaatgtaatgaaattggaaccatttctaaaatctattaaacacacaataaatatgttattattctttattcatgtgtacttagtttagcttatttattctttattcataggtactttatgccaaagacataaagataatgagctgcgatgtggtttttaatttggccatattctaaagtcttcccactcagtctatagtcaagctcagccacttcttaatttattaccatagcctctgtttctctaaatctgtgttgctcaaactttagtgtgcatagaacatacactagaggggctagaagggctgttaaatcacagattgctttgcttttgatttccttaatctttggaggaccctgataatttgcatttctaacaagctcccaggtgatgctgaagctgctagtccaggggaatgccaaggtccttatttcaggttttattaactaacacatggagagctttctcattaagctccttaccaatgatctcacctcccgttagttgatccaatataactacaggcagatcagtgttccctaagcatagatcatagtgctgttcccagttctcttctttaaagcattctttaaaaacttcaagatgtctattatataaacctatttgttctcatctcacaccatgtaactataaattctctttactacagttagaaaaaaatattctattttccttctcatcttttgtatttgagctcttttatttgttgccttaccagtggctatgagcaggaactcagacactacactagggttcaattcttgcttctacaaacttgctagctatgtggccttgggcaggttatttaagctcagttttcccatctgtaaaaaaggttaattgtagggttgttgtgaggattaaatgagtcgacaaatttaaagcatttaaaatacaatagtgcctagagtatatgtgtgtgtatctatatatacactaccttagcgtctagagtgcatacatatatatatatatatatatatatatatatatacacacacacactagctttttgctgttgttttctgaaatgggttttttttccccttgttttatggtagggagaaaataaatcagaatttatgataatattgttacatataattcctaatactggtcatccaaatagtcaccataacaaaactaaactaaacaagaacaaaaattaaaaagtcccttccaggtctgggcatattaggcctccagtccaaccagcatcagctagagaaaagatcaatgccatgaactggcaacctgggatctgtgtgcctgaattccaagacactgtctgtcatacacatctaccactgcagaaagaagcatgagattgttgagaacaactagaagtggaaggacaactctaaggcaatttagggtaatattaagactaaagcataatttccaaattctttggtaaacacagatactcaaaccaggaaccagaaatcatgtaccatatgtttaatttcctgaatgtccaaggactcagagcataaaacaatttgatttatctttgtgaatatatgttgtagagcatatactacaatttgaatgcactgagaggaacttaatcatgcgattcaaattgagtctctatctgggatctataatctaatccccacccaattcagaaattcaggatatataaattatatatatatacatatatatacacatatatacaatatttatatatacatatatatatatttgttaggttacacattttgtcagagatattctgatgtcaatactatagataagttggtatgactattctactatcaagacctttttaccaggtaaaattaaaattctgtagcatgttatattaagccctttaaaatgtgcctccatgcctcttgttttacctccatttcaacttctgccactttccccacaaacaccccaggctccagccacatgaatttctcactcttccataaaacacactgcacactttttgttgttgttgtttttactttgacatatcccatgctattctctctgtaaaactatcttttctacttccttcgtctcttagtattgcattaattgttctatcaaatgttaatatatatttccccattggaaaaatttctgaactctgtcatttttttgctaccttctcaagtgtagaatattacaaatacctaaaaaaagagtgaggatatgtaacagtgtattcacattactattgtgcagaataaatgatgatcaaagcaactggttaagtctatcaccatgtttagtggttaaaatcaccaaagccaacagagaaatgaaacaaatcctcttcaacttacccttataggtttattggtgagttatttttattatctaaaatatataagaagtttaggcttaattttaatttgaatgctaagtaagctggttataaagaatgatggaattcattgtcatattttcctactcatgttataaacagatgtctttcttttccatacttcaaaaaaaaaaagaaagtactgccaagctaagatgcttgctgccaagttgaattacagaacaaacatttatagccaacttataaattcttaactgtagggttttataatggaaatactgtcaccattttcactataaccattcaaataatattactatagcaaaacttatcatctaatatttttttctgggatggatgagggaagactagctataagagttggaaaaacttctagtagctcaattcaaattgcacaattattccaatagttcaagtctcttagaatattgattttaaagtaagaagtatatgctccaaaacatttattcttaaaagataggaaattttttgatacctgtataagaaatatatgacctctgaggcattttgaaaaattattaatcaatgttgcttttctaaaactgtcttattttccttttgtaaaagaattactttccctcacattttctctgttctattgctgagatgattcccccggagaactgtgtgtttatcttgacaggtgttagtagatccaaagacctctgtggaattgttcctggttgcgttcaagtacagtagaaaacattatgcctgcaaagcaatgaacttaccttattgccttctaaataaaataaaccacacagcaagtggaattaatctactaatgtcttcctaatgaagctttcattagacatatggtgtggtcttcaatatttaacacgacaggtattaaaacaaagcatatctgatgatttttttaaagcatacttgatgactgcctcttacgttatttttaaatgaactagtttaccttcagattgctttaggcacctaatcaaagagatacaagaaaatatctagacttaagatttttttttaatcaaatagaagaaacaaatgcctcactaccaatgcccttaaatgatgaaaactgggccaggtgctcaggcctgaaatcttagcactttggaaggcgaagacagaaggatcactggagactaccagtttgagaccagcttgagcaacataaggagaccccatctctacaaaaaatttaaaaaaattttgtagaggcatggtggtatatatctgtggtgctagctaacataggaggatcactttaacccagttcaaggcagcagtgagtaatgataaggccactgtgctccagcctgggtgacagagagatcccatctctacataaacaaataaataatacatttatttatttatttatttttttttttatttattattttgagacaaagtttcactcttgttgcccaggatggagtgcaatggggcaatctcagctcaccacaacctctgcctcctgggttcagacgattctcctgcctcagcctcctgagtagctgggattacaagcatgtgccaccatgcccggctaattttgtatttttagtagagatggggtttctccatgttagtcaggctgatctcgaactcccaacctcaggtgatccactcacctcggcctcccaaagtgctgggattacaggcatgagctaccgcgcccaggcatatttttatttatttatgtgctattctcatattgaagggagaggcaaatttccgattttctgtgcagtgtaaaatttcatgcattaataaaatttataaggcaaatattaagaatgaaattgttttagcccaattcacagtggtttgcttcagaagtagcaaacactggattcccaggcaagatggccaaataggaacagctctggtctgcagctcctagcaagaccaattcagaaggcaggtgatttctgcattttcaactaaggtacctggttcatctcactgggactggttagacagtgggtgcagcccacggagagcgagccaaagcagggtggggcgtcacatgacccaggaagcacaaggagatggggaactccctctcctagccaagggaagccggtgagggactgtgccatgagggatggtgctatccagcccacgcactaggcttttcccatggtcttcaccaccgacagaccaggagattccctctggtgcctacaccacaagggacctgggtttcaagcacaaaactaggtggctgcttgggcagacaccaagctagctgcaggagtttttctttctaccccagtagtgcctcgaacgtcagcgagacagaaccattcactcccctggaaagggggatgaagccaggaagccaagtggtcttgctcagcgaatcccacccccctggagtccagcaagctaagatccactggcttgaaattcttgctgccagcacagcagcctgaagtcgacctgggatgctcaagcttggtgtggggagggacgtccaccattactgaggcttgagtaggtggttttcccctcacaatgtaaacaaagctcgtgggaagtttggactgggcagagcccaccacagcaccacaaagccgctatagccagactgcctctctagattcctgccctctgggcaggacatctctgaaaaaaagacagcagccccagtcaggaacttatagataaaactcccatctccctgggatagaacacatgggggaaggagcggctgttggcacagcttcagccaacttacccactcctgcctgctggctctgaaaagagcagcagatcttgcagcacatcgctggagctctgctaagggacagactgccttctcaagtgggtccctgatccccatgtctcctgatggggagacacctcccagcatgggttaacagacaactcatacaggagagctccagctggcatctggcaggtgtcccactgggacgaagcttccagaggtggaagcaagcagcaacctttactgttccacagcctccactggtgatacccaggcaaacagggtctggagcggaccccccagcaaactccagcagaactgcagaagactgttagaaggaaaagtaacagaaaggaaaacaaacagcaggaaaactaacaaacagaaagcaatagcatcaacatcaacagaaagaacgaccacgcaaaaactccatctgaagtttaccaacagcaaagaccaaaggtagacaaatccacaaagatgaagaaaaaccagtgcaaagaggctgagaatttcaaaaaccagaattcctcttctccttcaaaggaccacagccccctgcaagcaagggaacaaaactggacggcgaatgagtttgacgaattgacagaagtaggcttcagaaggtgggtaataacagactcctctgagctaaaggagcatgttctaacccaatgcaaggaagctaagaaccttgaaaaaaaggtagacaaattgctaattagaataaccagtttagagaagaacataaatgacctgatggagctgaaacacagagcacgagaacttcgtgaagcacacacaagtatcaatagccgaactatcaagcagaagaagggatatcagagattgacaatcaacttaacaaaataaagcatggagacaagattagagaaaaaagaatgaaaaggaacgaacaaagcctccaagatatatgggattatatgaaaagaccaaacctacatttgattggtctacctgaaagtgaaggggataatggaaccaagttggaaaacacacttcaggatattatccaggagaacttgcccaacccgcaagacaggcccacattcagattcaggaaatacagagaacaccacaaagatactcctcaagaagagcaaccccaaaacacataatcatcagattcaccaaggttgaaatgaaggaaaaaatgtcaagggcacgcagagagaaaggttgggctacccacaaatggaagcccatcacactaacagcagctctctctgcagaaaccctccaagccagaagagagtggggatcaatattcaacattcttaaagaaaagaattttcaacccagaatttcatattcagccaaaataagcttcataagtgaaggagaaataaaatcctttacagacaagcaaatgctgagggattttgtcaccaccaggcctgccttacaagagctcctgaaggaagcactaaatatggaaaggaaaaaccagttaccagtcactgtaatgtgaaagaccaatgtgtgtaaagaccattggcactatgaagaaactgcatcaactaatgggcaaagtaaccaactagcatcataatgacaggatcatttcaaacataacaatattaaccttaaatgtaaatgggccaaatgcccaaatcgaaaggcaagactggcaaattggatagagtcaagaccaatcggtgtgctgtattcaggagacccatctcatatacacagacacatataggctcaaaataaaatgatggaggaagatttaccaagcaaatggaaagcaagaaagcaagggttgcaatcttagtctctgataaaacagactttacaccaacaccaacaaacatcagaaaagagaaagaggggcattacgtaatggtaaaggaatcaatgcaacaagaacagctaactatcctaaatatatatgcacccaatacaagagcacccagatttataaagcaagttcttagagacctacaaagagacttagactcccacacaataataatgggagactttaacaccacactgtcaatattatacagatcaatgagacagaaaattaacaaggatattcaggacttgaactcagctctggaacaagcagacctaatcgacatctccagaactctccaccccaaatcaacagaatatacattcttctcagcaccacattgcccttattctaaaatttaccacataattggaagtaaaacactcctcggcaaatgcaaaagaacagaaatcataacaaacagtctctcagaccaccgtacaatcaaattagaactcagcattaagaaactcactcaaaaccgcacaactacacggaaactgaacaacctgctcctgaatgactactgagtaaataacgaaacgaaggcagaaataaagatgttctttgaaaccagtgagaacaaagacacagcgtaccagcatctctaggacacagctaaagcagtgtttacagggaaatttatagcacataatgcccacaggagaaagcaggaaagatctaaaatcaacaccctaacatcacaattaaaagaactaaagaagcaaggtcaaacaaattcaaaagctagcagaagacaagaaataactaagatcagagcagaactgaaggagatagagacacaaaaaaaccttcaaaaaatcaatgaaaacaggaggtgttttttgaaaagatcaacaaaatagatagaccactagccagactatatataagaaaagagagaagaatcaaatagacacaataaaaaaatgataaaggggatatcaccactgatcccacagatatacaaactaccatcaaagaacactataaacacctctatgcaaataaactagaaaatctagaagaaatggatacattcctggatatatacaccctccgaagactaaatcaggaagaagtcgaatccttgaagagaccaataacaagttctgaaattgaggcagtaatttaaaaaaagcccaggaccagatggattcacagcctaattctaccagaggtacaaagaggagctggtaccattccttctgaaactaatcctaacaatagaaaaagaggcactcctccctaactcattttatgaggccagcatcatcctcatatcaaaacctggcagagacacaacagaaaaagaaaatttcaggccaatatccctgatgaacatcgatgcgaaaatcctcaataaaatactggcaaactgaatccagcagcacatcaaaaagcttatccaccacgatcaagtcagcttcatccctgggatgccaggctgattcagcatacacaaatcaataaatttaatccatcacataaacagaaccaaagacaaaaaacacatgattatctcaatagatgcagaaaaggccttcaataaaattcaacagcccttcatgctaaaagcaatcaataaactaggtattggtggaacatatttcaagataataagagctatttatgacaaacccacaacaaatatcatactgaaggggcaaaagctggaagcattccctttgaaaaccggcacaagacaaggatgccctctatcaccactcctattcaacatattattggaagttctggccagaaaaatcaggcaagagaaagaaataaagggtattcaaataggaaataggaagtcaaattggctgtttgcagatgacatgattgtatatttagaaaatcccattgtctcagaccaaaaactccttcaactgatgagcaaattcaacaaaatctcaggatacaaaatcaatgtgcaaaaatcacaagctttcctatataccagtaatagagagccaaatcatgagcaaactcccactcactcacaattgctgcaaagagaataaagtacctatgaatacaacttacaagggatacgaaggacctcttcaaggagaactacaaaccaatgctcaaggaaataagagaggacacaaacaaatggaaaaacattccatgctcatggatagagagaatcaatatcgtgaaaatggccatactgcccaaagtaatttatgcatttaatgtttttcccatcaagctaccattgacttcctttaccaaattagaaaaaagtactttaaatttcatatggaataaaaaagtaccccgtacagccaagacaatcctaagcaaaaagaataaagctagaggcatcacgctacctgacttcaaactatacaaggtcacagtaaccaaaacagcatggtactggtaccaaaacagatatatagaccaatggaatagaatagaggcctcagaaataacaccacacatctacaaccatcttttctttaacaaacctgatgaaaacaagcaatggggaaaggatcccctatttaataaatggtgttgggggaactggctagccatattcagaaaactgaaactggactccttccttatgccttatacaaaaattaacttgatatggattaaagatttaaacgtaagacctaaaaccataaaaaccttagaagaaaacctaggcaataacattcaaaacataggcatggacaaagactgcatgactaaaacaccaaaagcaatggcaacaaaagccaaaattgacaaatgggttctgattaaactaaggagcttctgcacagcaaaagaaactatcatcaaagtgaacagggaacctaaagaatgggaggaaatttttgcaatctatccatctggcaaagggctaatctctagaatccacaaggaacttaaacaaatttacaagaaaaaaacaaacaaccccatcaaaaggcgggcaaaggatatgaacagacacttttcaaaagaagacatttatgcagccaataaacacatgtaaaaaagctcatcatcactggtcattagagaaaggcaattaaaatcacaatgagataccatctcacgccagttagaatggtgatcattaaaaagtcaggaaacaacagatgctggagaggatgtggagaaaaaggaaaacttttacactgttggtgggagtataaattagttcaaccattgtggaagacagtgtggcgattcctcatagatctagaactaggaataccatttgattcagcaatcccattactgggtatatacccaaaggattataaatcattctactataaagacatatgcacatttatgtttattgcaacactattcacaatagcaaagacttgcaaccaacccaaatgcccgtcaatattagactggataaagaaaatgtgcacatatacaccatggaatactatgcagccataaaaaagaatgagttcatgttctttgcagggacagggatgtagctggaaaccatcattcttagcaaactaacacaggaacagaaaactaaacactgcatgttctcactcataagtgggagttgaacaatgagaacacatggacacagggaggggaacatcacccactggggcctgttgggggttggggagcaaggggagggatagcattaggagaaatacctaatgtagatgacaggttgatgggtgcagcaaaccaccatggcacatgtttacccatgtaacaaacctgcatgttctgcacacgtatcccagaacttaaagtataattttaaaaaattagcaaacaccagcttaaattgcagttaaaactacatagtttaatggccaggggaaaatcaactgtaaacaaacaaaatcagtatcttttcataggcagcattttgatttagcatttgttgaaaataaaattcaaagcctctcacagaaaacctgcctccttcagaaaaatcaccagttttggagcatgtgtgatcccattccagctaatatttacagtagcatataaaacagctacaaataagtcacatcttcattgctacattatgccaaatgcttaatttcccattttatgttcccttgtcaattctctcctgcttctctcctgtataatcacagttgtccaattgagacctgatgatcttatcagtcatgcacttttactattattatttaaatttgctcctttcaactattatttattgccaagctttgcagagggaagaaaacagacatggtaaaagaagagtaaaggtgggtcttttctcttttggcagtagcaaccagaaacagtatgaaagcaatggatcatgaagaaaagcaatttcctacttgagggattagatagtaccctcttttgtactgttaaatcaaagttttagttattttttccaagtaatactgattttttcaatttacataaacagtctctagggaaactgcaagagacccccaaacacataccctctcagccaatcaacagaaaagataaggaaaatgaaaaaaagaaaagaaaaaccaaacttcctttatgttgtactgctttgagcaaggctttacacagcatggcaaaaattaaactgctacacaagcaaaagataattagcttaacagggaagaatttgaactgatacatgaagctttttttttctttttttcagtaaaagtataggtgatttttattttgaagcagttcacttttgctagcattagaaaattgaaaactatgtaaatttcagcaaatgtttgctttaatgtttaggttcacattgatattaaccacagctatcagttggtaataaattcagatttgagaaaatttgtagcagaaaactactctgaaatgtcatgtgaaaatcctaatcaattttaaatgcatttacattcatggaggaataaaacctactcttaaataataaaggaaaataatagtacatgtataaaatgtgaggaaggaaaatcatgagtctattttcacagttcatttgtaaaggtttatcacttatatgacgtatgtttaagaaagttacaaattttctatagtgaattacttttatgccatataattaacaacaaaaagtcttcatagctaaataataggtttttgataaaaccttataatttatttcagcttattcctgagttgcccagtttttaatgtcttaaaatccatcacactgttgacagatacttgaggtaacattaggtgattagctgacaaagttctagctactattttaattgcctttttcccgctttgtcaaaattctgatgctattaagtcattgttgaactcatcctatatagacagtaagaacaaacaaataagtaaattaacatagcagacatttcttgctttacatataactggagtaatgttttctaaatctggtggaacaatctattgaatacactacaaattctttgcaaaaatgaaatagaataaggaactatgcagggaagccaaattagacgactgcaggtctgtagccaagtggaatataatttgtccattacaataaaataaccttagaagtaggttgaagtcatttagtatggctgaaatttggagggatgaatgttactttcacccaacataaattccttaatccaatagcagataataagaataggttagttgggtaaataaagtttgaatccactgggttttctcggctggacactttttttttttttttttacatccagagttggatttgctgacaggttagagaatgcaacgtatgttgagatttcccagattaaaaaatatataaaaatgaaataatttgtaataagactcagatccaggactaaataattcaatagtctcctatgaattactaggtagtatctatatagaaacaccaagattcatcttaaaaatcagtgactgttcagtcgtaatatttttggagtagccctgtccttggctcactagatggggctatcaacttagacaggctgttgtgacagagtaattctagtttagtattcaatatccattctgccttcttcctggcaagtagaaccatttgaaaggatgagggggaagtgcacagagtagcaatatgtcccactaaaaatacttgctttccaaaacatccttagagtgagagtgcccttgtgacccagttaatcttgaaaaaatgtaaattgaatttacataattaggacaatattttcttaaaggtaggttttggtagactgtctcccccaccccactattttttgccataaaaccttattcctgttgctctcaatgcagagtgaatgcccacgacaataccaattctgagatcatgaggtcaaaaatcacacactaaggatggagaagaaagaagacagaaggagcttaaatgtttgaggtctccctgcaggagttataccagccctgtgtcacctacctttggacttcttattcaatttgaaaactaaattatcagtttaatcctatataagtcaggtcttcaggttttggaagctaaatacacgcctaatggatataactattttcttgaaaggatgattacttagatgggtgagtacgccagctgaggcctccaggcgtctgggagagacatttatccttaaggaaagtagggaacatattatttgctttgggtttctccagatgcattttaggaaagttaaggtactttctttaatacaggagcccattagaaataataactcaaggagaataaggctatcctcgtctcttgaacagaagaaaatgtcgttgagtaaataatactatggaactaaagaaatgcacctatagtccccttcttaaacatgccataaaaaaggaaaagatatccatttcctgtagaagagaattagagcttaatgaagacacactttcaaccaggaggtatctgatgtgggcttattagtaagaaacacatcttcccaggtaatacaactacatgtgagtaagtgcagcctgccatacattctttcatccacttaattatcaatatatcaaattatttatttatctagcaaatatttattgagcacttactctgcaacaggatctgtaccaagccctggactcattcagaaataaatgattggggggtttggttctaaattgaggaaacaagtctttgggcttactgcctcctcatcctgagctgggcagatccccatcctctcttgaagtccatgaaagcatatctaccttctgacatgcagaaatggccctgcaaatggaatctaactggagctgaatgagtattcttgcctcagttaatgtattttcatacttagccagttccaaagcaacaatgtgcacaacttagacatgcttattggccaggtgcttaccacctatttggcaaatgctgtttatgaagtttttaagaaacaaatattgatccaaaatttcccttgcgtttaatattctgtcattctgcaaggccagtattaagtttgatgtacacatacaattacctgtctatctaaacagtttcaactgccctaattcttgggcaccacaccgtgattaaatgtatacaagcaacaagttcttgatttgggcagctagaaaaccactgtggcataagatcaatagttacaccacttagcaaagactgtctttgtcattgcttcctagagtcctcaaaggtcctgataaatacttaaatctagcttgttctttcttttgtgcacatgttgttcatgcaaatgaaatcaaaatttacctaggaagattccagaggacccatacaggacagaagattgtttaaattatggtagagctcatgaaacacattttcaactggtgggatatcctccttatgagactcccaaattctttagagcaagaaacattaacaagcataaatgaaaaaaaaatcctgtatgaagaattgagaaaatagcataagcacagtatgaggaagacctaattctatagttgttattacaaaaaacctggggatttttactaaacaaaaatgtaacaggcaaatttgatggaccttttagcagaaatgtttgtatgaattgaattctagtatccagatcatgagagtaataatcatttttctgaactttgcataagacacacacatgaggtatgttggacatgccatgtgctcattttaaaagatactttgaaaaacaggtgagtgaccagatggttataagagccatattcagtctaaagtaacagagagtaaaggagatagaatagacatgctcaaatctttaaggattttcatatagaagagaagtaggctaattttttattggccttgaaactataggaaaggccaacaggtagaaataggttaataaggaagcacatattgatgatactcaacatacatgaagtggagtttccagaaagcaaacgagtgggggtttggaactaacctacattcccacagggagtttttggtttttcccctgcctaagatcttgcctctgaacatttctttagataaagaaattatagcatttgtaataaataacaagatggctttaggtttaattgtcagccaagaaaacagagtaaattcacatgtaagagtggaagggaaggagcaaaacatcgacattgtgatacatttgggtgtaccctgactaggcaaataactcatcgccaagtaccttcccagggagtcaggtaaccactaataagaaaatagacttatggctataatcctatatattttcattcatatgtctagctcagagaaagaggtgagtggtgagaaaaatcacagcaactgcagacaagggtctataaaaggacatttaaaataaaccaaaaaacccgaatgaatacatttacttaatgtgtattatatatagcctatatattttttattaaacacttccacacttaacactgtatctaccaaactatcagtttcagattaagcttattaagtgtactctgtttgatcataagtataaagagttttctcagcaataattcttattcttccatgccaaatcacatggattgatcttacaggaagttaacaaatcctatatttccaaataaataggcccaaataatttataatgtgatggtgttacttgtcttctatattctggtagaatcgatggacagctaccttatgtgctttcaatctggaaaagtagccagtttgtgatgttctttttgatttctgactataatttccctccataatattccctgttgtctgaaacacctacatatctgaagctaacgggcatctttatagtaagtgatgctgaaataacttctgacctacagctccaggaagagtggctaatcgaagtaatgatcagtgtctcttctacccatttctgtgaactctgatgctttctgaatgtacggagactggtcaagatgttaatctcccagtgtagggctggaggacagtggtagagaaccactacatcaccattgggaggagactgtagtgtgaactaagcaaattagagaatgtagaagaaaggccaaaaggaaaatataaaatgaataatggccatggctaatcgcaaaggtaaatgtatctcttcataaaagaaatttactctatttattgaaagctgacctcaatttctacctcttttcattgagactccattatctactcctatactctcttcagttgttttctctgcaattttgttggcatgattttagttcccatgtattgttattctatctctgcatgtacattgtccctccaactatattgcaaatacattagggcagggtacatgtttgatgttgttttgagtctccattttgtcagcaggtgtttttcttcttcccaaaatgcagcctgccagccacttacaacattttcccataaagccatggtttaatattgtacatcaccctggacttagtgaatttgtaggatgtgcttaggaatctgcattcttaacaagaaactaagcaacaccgatgctcacaaatgtttgctagcctaaggcctaccacagaacaggtgctcgtaaatgtctggtgctgctgttagaatgatgctttctggcatgtctgtatgtatctataaaaaaaacaaagagatgttgatttgctcaaggtgtcctctctctgccactagctagtaaataccttgagggttcatgtcctttgcagacagttctctgtatctccttctaaatttttttctatagcactaagtacttcctagaatgtaccataaataattgtttatgttaaggagtagaaagggaaaggtggtggaagaggaacagaaaaagaagatgaatttatggttgggaggcatacaagggaggtgttattcagaaaactcctttgctttagcgaacacgaattcaaaagtgctaatgaagtctcttcctaatcctttctacttaattcctttgctctgctcttgctaagactgaaaattaccctcctatgatatttttgagattactaaagacagtcttgtgtgaactgaagacaggtcacaaatgactggcatacaacaaatatgtccttagtatctgagatactaaggaactgccggtacctatttttcctcctcaaattcaatcaaaggaaatcatttccatgtcaacatgcacatgcatgattgtatatatatatgtaagtataattacttcaagtggataaacttagcaatgatctttgtcgattgagggcagtgttaatgagctgtaaaatggactcaccctggtgcccaattgtcttttattacaaagggcattctttaacttccactgaggtctaactcccacacaaaccttctgtgctttcatttgattattaccaatagccaaaagtcaaaggtggaaattgagacttaagaacatgttgcttacacccaaagcaacagggaaatgaggctttattgcctctcttctttaggcttcaatactatcaatgttgagaaaacccttgctctccatttccatttgattatcctgagaatatgccttgtactcaagaatttctaacaaaaaatcaaatattttatttttaggaacagaaagacctatatacattaaagattgtctaatcactacaccttaattatggggattatgtggtcagttgagttaagtgatttattcagagttgcaaggttaattaaattatagaccagatttttatcctgggatctacgaataagtttcaagggaaggatgaaccttcaaaattttatgcaaattgtgtgtgcacagctgtgcatttttttcatctgtgcatttttatggaaagtggatccacaattttatcagaccctcaaaatgtccctcaacatagctgggacagttactgttgcaatttataagatatttttatatttataaaatatagtaaaatattaaaggtcatgtaatccaagcttacagccaataaatggattccttaaataataactctgatggatagcatgcaaactctaccttgtatcttaagataattgataaccaaccacctctcatgttatcatggttcaaagcttgaattaaaaaggtattcatatagctgaatcatattatttctttcctataccttctcacattggtctaagtactaccctttgcagccatgagaaacaaaatcactgttgcttactccaatgtctttcatacatttgaagtaaattcctgttacatttcttcttcggtcataagagccaagatccctcagtattctagtcaccactctagactcaaacttagagctggaagaaacacatttcagtttgtcagtattctctaaaatccatataacaaaaaacttaaaaacaatgttctacttgtgatctgacttgttgatgactatctccttctggtggatgtgttctctctttttgctggggaaatcatggtattttacggtctaactgggaagatcagagcctaatgatttttatataggttttccacctgaaatgcaacaaagtaaataatatgcagctggccattcagacccaactctagataatcacatttcaaactttaatagtcatgaggttcacctaaataaacactggcaatttccaaaagagaaacattaagcacttttatttagatgaataatccagtactttgcccagaggttgagtcagaaacaaagaacaaaaaacctcagatttataaaatgagtacagcaaagatgacttagagtataaagtttttctatttcaaatgtcagaaaaatgctcaccagatttacttgattacaaagttccaaaaaaccttttattttgcaatactcactcatatcgcaaactttagtgatgtagcaacaattatgcaaataatttaaacaaagtaaatggactacatgaaaaattcaatcctcatttctatattgattatttataccagcactccccaaagactgttagaagcaacattgatcctaccaaatgctcagaaaagataaaaggccaacaactgaatacacttcaaaaacacaccttaccatacctgcttcttgggactcccactgcaaatgacatattttagtctccaagaacccctctttttaatgacatccattagcactccacaacaccattgttccttataaaagacattgagcattgctataccatgttgatctaattaaccaattttctgcaaatctctactttactctgtgttttaacatctcaacaagtatgagtgtagactcttgggtaatatgatctcattctcctctatgagagcctcctctgcctggttccctgtgagccaaaccacaccccaaggaggagttaatataattacttagattagggcattgactgttttacctaaagaccaggatgtccatatcagatttattttattttattttttattattattattattattattattattattattattttgcctcagattgaggtagaagactctgagactgtgagatcaggataaaaattgttgttgatattcctcttccactcccggcagctggatctctaattgaactcttctgctccctagctcccatactctcacttgcaggaagatataagaacaagagtgacaaaaattcaaatttgcaaagaaatctctcttaaatttcaaggtcatattgggtgatttaattcaatttttatagagagccctgaatttggaaagaaagaaagagagagagaaagaaagagagagagagaaagaaaagaaagaaagaaagaaagaaagaaagaaagaaagaaagaaagaaagaaagaaaagaaagaaggaaagaaagaaagaaagaaagagaaagaaagacagacagactagtcacatattctgtattgttttctgagaatcctggggagtaggggttactgaggatggtattaaaatcatttgcaggtcttggctttaatatcatcaaattagccccaaagttatttgtgattattatttgcttttgagttcttgtattttaaacgttatcattaaaatatttgcaggtagataaggaaaagctccagatttgcttcaaaatgatgcagttggaaggtagagattgaaagggttagggttacacataaaatggtagttagaattgcacgatggaggctgggtgtgggctcacacttgtaatctcagcattttgggaggccgaggtggggaggatcacttcatctcaggactagcctgggcaatatagcaagacctcgtctctatttcaaaaagaagaaaaaaaaatagccggctgtagtgggggcacacctgtagtcccagctactccggaggctgaggcaggatgattgcttgagtccagaagttcaaggctgtagtgagcatgctattgtgctccagcatggaggacagagtgagactctgtctcaagaaaataaataaataaataaataaataaataaataaataaataaataaaattgggtgatgatttcatttggcttccttttacttgcctgttctcttacttgtgtgtgactgataaaatctgagattataattaaataataaagcaccaaaatctcacacagaactatcaaccatcataaataaactcatagacataagtggaagagttggaaagtttttgccaagtggtcaagatgttcactgctgtaactaagagcttccactgaagttactattatcaaccacagcactcataaacacatagcactcctgggcacattttctatttatttaagtgacttaccttatttgatcaaaaagaaaatattaaaatcaccataaaactatgtaattagtgattgcatggtgatctttatgtgatgaaatttttaacagttaatatctaatatagaattaagaatcctacacaatattttaaagttatattttcaaatccatattttgtggatttcaaataattccagtttgaatgcttgcaactgcaacaggtttctgtaaaagcttttgagtttcacagccttccttttgacagatttcttaagttatggaatgcagccatcagcagtctgtagaaaaatgaaatgctgcaagtctatttttatgcagctgggatcaagttactaaatggatcaaaagaaataatttctttgaagaggtggctgttgacaccagtgccctaaaaataagtgcaattttgtgggcataaaaatttgtttatatcttagtgaaagtaactatagatatattttctatatatacacttgcattcatgatatattggatgccattctaaacatcttttaatataccttagtttaacattgcttttaagaggaaagttgcatgctttctcttgaataattgatgtagctaaagacaattattcataccaggcttagcttactgggtttataataaaaacaatgatagtaatttacctaactcttactttgtgccaaataccagccaaatacttcccaacattatttcatttgattttagaattacattttattttaataactagctattattttcacaattgtatagatgaagaagctgattcttagagagtgtaacttgccaaagattacacggctagcatgcctctgagttaaaatttgaaagctagtctgtttaattctgaagctcttaatcactaaattttatactacctctttaggttggatggcatatcaactgatttgaaactatagaaaaaaattaggaaacagaataatcttttaaaatatctttgtatgtgaaagtaagcttgcttatagaaaatgtagtaaattgaaagactattactattgcaatagcaatagtcaaactgaagcctatagaactcaaatgcatgtaagtgtcaaaatagccaagtaataatgcgatatgatataattttttatcataataaaaagtcagaaaacaaaattcataaagagggctctatgatacaagaggaaaggttgatctaagggtacaaactaaaacattttaaataaagtttttggaaaaaacaattttaggctccgaaataagaaataaatacaaccccttcacagataataataaagaaataagccaataagcccttaaaatagaacgatatagtcttagctctggaggacaaaatattctctacttggaccctgactcatttagaactcctgcacataaatacatatatatatacacacacacacacacacacacatattgactatattgctgaaggggagagtaaaggaaatggtgaaaggatcatcatttttattatttcattaattcctgaagaaaacacatacacaaattgcaattgaagcttctaaaaaacctagaaaacagtataaaggacttagacacagtacaagtatttcctaccatgtaagtctgaaagagagaaaatcaatttttatgaaaacataaaacagtgatttgggttgtgaacaaaattatttgtctccatttgtgttctattggcttactgctctgccaaattttgaagcaaaatgaaaaaaaaaaaaaagagagggaaattatagcaaacctcccaaaacatatcccttaaactccgcaatgtatttaaactacccaggttctgttcatggatatactcaaacattgagaaattgtgggtgtactgggttttgatgctgtactttttgtaacaacttgatattggagtcaaaacatgtttttctatcttgtgttgctcagaaaggtatgagcaaatatatttttcccacaaatttcaattaattaagaatgattaaaatgtggatacttgcaagggaaacattaataaaaacatgaagtgtagacatagagataattttctctgtggcggatgactgatcatgtcattaggcagagctttgttcccttaggctctgtagagtcagagctaggataaagaatcacagatttagagttgaagaaactcttaacaataacttaacaaccattccaatccccttgatttatagataaggcaggttagtcttagaaagaggaaccggttctttgtgtgagactcaacaagtcacatcaccgctctgcgcttctgttcccaaattctttttctttctttctttttcttttcttttctttttttttttaaatgagtaagggatttcctttattattagtgagattgaacatcttttcacgtcattattgaccatttttatttttctctacaaactgattatccaaatctttctcccatttttttcttttaaaaaattaatttaagatccaagatacatgtgaaggatgtgcaggtttgttatgaaggcaaacatgtgcgatggtggtttgctgcacctatcaacccatcacctaggtattaagcctcccacacattagctatttatcgtgatgctctccctccttccaatccccctaacaggccccagtgtgtgttattctcctccctgtggccatgtgttctcattgtttagctcccacttataagtgagaacatgcagtgtttggttttctgttcctgtgttactgtgctgaggataatggcttccagctccatccatgtctctgcaaagggcatgatctcatcattcctttttatggctgcatagtattccatgatgtatatgtgccacatgttctttatttaatctatcattgatgggcattttgattgattccatgtcttttttattatgttctcacattcttaaaattaaagttgggactagttgatctccaaagtgcccacatactaaacgctgaatggtttcaaaagaaaagtgagttaatggcagacaataacctcagatctcagttcctaccttgttctcaccagtccagtttgtgttctgccatttgctcatatatttcactgtcactacgtacttatgaaatttgtaagtcaataaatggtgaagaaaagaaaaacaagaaaagtcatccacattttagaagggcaaaattgtgagtaaggagctgagtggttgaatccgaatattttcattaattccaaacaaaggcaatggaaagtgggaaggaggggaattgcagttctataagctatagttgctccataggagaaagggaagagccagcagtaatcaggactttttaaaagaactgtccaagttcaatgacaatatcatctagctctctgactctaggcatctgccaagaatcatggaatcttcatctcagtaaactaaaaccaggctagacaaagcaggcacaaagaagaagagaatcacattcaataggttagtcagtatatggtaagctagatcagccatggaaatatgcattagtcaataagtttgatacctaaatcaatggagacatggtctaataactgacctttcattttttggggtgattttcataggcatacatgtttacatagcaactccatgagaatttacaataagtagatgctgatattcattgactattcagatagtcttcaacttaagatggggttatctcctgataaactcatcgtaagttgaaaataagcagaaaatgcattcaatgcacttgatctatggaacacaatagcttagcctagcttcaaatgtgctcagtgatatgagcttacagttgggcaaaatcatctagcagcacagtactctgtagaatttcggttgcttaccctcgtgattaggtggtttactgggagctgtagctaccagctgctgtccagcatcttgagagcctatgaactgctttctacccacagttgcaccaccgtaaagttgaaaaatcctaagttgaactgtattaaattgggggctttttgtaatcatttaggagtattaataatatgtaaacagtaagagggagaaatatacagcaataaatgcagatggctcattcctaatttgagaaacaagataatgcagtttattctgaaaagtgattataaatttgaaatttatggaaggaattcaacatcaaacaggtaactttaagagggaaactcttcctgacccttagctagactaagttatgttcagataaagcaatctgacttcacacacatatgggttgccggacttttctctcacttacataattttgaaataatttgtggaatcatttgtttaatgtaaacattcttagattttccagagagattatggaccttgccttggtcatgggtgtagtcccagcccttagaagagtatctgtcatgcagcaggcattcaaaaaacatttgtttaatgaagaaatgtccatgctacaatatgtttgaacagaggagagggatagaaagaaaaaaaaagactggaaaagaaagagagagaaaggcattattcagaggaagaagataaaagagatgaacagagactggactatccccatgacattcaaaactgaccaactgactctttgtttcacacattgagtgacccaggtcaaagccctatcagtcagtatactcactttgtatccctgacacacatatattttcctaagaatggttgcagagaaaggctggaaaaaaaggggatggaaatgaacattaaagagactgacagggaataataacagtgaaacagacaaactctattgtgtacaactccacagtcgaacattttctacctccctgagaatcagtctcgcttgcaggtagagtattgactgctaggcagagcaccatggctataaaacagaccactgagctaggcaataaaagagagagagggagagagagagaataagaggtctaatgtcttgtttatgtcccctttatagcatctttgagaggctctgcagtcccacagctggctttagttcatatgcttttctgattaaggcaatacgtaccaaagcaatctaatattaacgtgcaatttagaaaaaaatagaagggtgtaaaaaaggaggaaatctccacaaacagtgtaactaaacaataaacagaatacaagacttgcttaattctttattaaatacatgctttattttaagtccctaaaacatttgtatctcattttaaacacccagttctaccatattgtgtttagtgacactaatccttctttatagcctaaccctttgagaaataagattatgttcccagtaaatagtagtaacaagttttattataacaatcctgatcacagatttataaaaaccttaaagaaaaaacatggaaatagaaatggctaggataatatccaatatgagaaagatctttatttaacatgaagtataaagcttggctgatgaaatgtctctaagaatatttccaagaatatatattttttacttttcattaagaacttgactactctttttaatcttagacattggttttatgctttataaccttaccattgtgaaactcagcgagcctagagaagtttgggtactgtgtgcaaatctactcaagtgtttagcttaccacattgctgagaaatgaccacatatgtgtgtgtgtgtgtgtgtgcgtgtgtgtgtgtattttttttcccaagagaatctatcttaactctgctgattatactatataacatatcatgactatcttaactgtcaaaatggtcctaaggttttgacgcaactgtttcaaataaacagttgttttcaattcttttttatatatttgtatctgatcttgagatttagattgataataatagtagagtggttaagtgaagaaatttaagagtcagagaggttataattctggctcagccacttactatctgactgagcctctgttttctcatccataaagtgggaaaaatacctagccactagggattgtgtgaggattgaataatgtgccttgtgcaaagaagacagcacgtgcccaatacataatgtgcactcaataaatgatagcaatttataactacaataagtgattgttagtattaataataaaagccacccgttatagtgcagtactgttaccataacaaagcctgatgtctatctcaattctaagaaaggctattttctacctcctgtcttctctgaatttctacttatgccatattatcatcaccaataaatatttcttgtaagcctaataagcataaggtattacattaggccctctaaagaatacagccagaatcaatcattctctcatgtgggccactaccagatctgtacttcctctatcatagcagcaatattctatatagtgatgatttatttgtctctatttaacccactggatagtgtgctttcatagataagtcttactctatattcccagcacccagcataatatcagggacataataaatgcctatccaatgcagaatgaatgaatggaacatggataagcccaaagagttcaggttgaagagagacattatggacattcaaaagcctagagaacaagacaaagtttcatatacttatgaggaaaaaaaaattgccttctctgtgtcagtgaaatgctattgttaattcataaatgaagtagtagtctcatcacgacagtcttctgggtggtttcatcttatattgtgaacaaaggaatgggtggcagaagagggaggaagaaactcttaaaggatgaattaccaaagagtacctggggaaacaatgtgattttttactgggcttacggcatgccaatcttgttagttttgcgaataaactgacaagtagaaattggaatttagtgagaagtctaaaggggactcaggcttttaaacacacacacacacacacacacacacacacacacacacacacacacacacaatctgcttttggctatgaaaaggagctagagtgatatagaatggcatccaagagagtaatgcacatcagaagaaactagctccagatactattaggttggtggaaaagtaattgtggtttttgccattactttcaatggcaaaaactgcaactgcttttgcaccatcctaatagttttaaatgcaaggtgcttaaactaattgtagaaccagccttcttggccttatcaatcaactagcaaatatgcttcagtgtaagtcaactgatcagagggacttttgccaggagtagtttcagagattctaagatctggggccatagatgcatacagtaggaatgatttaagatgggtctttagtgtagaatcctatgaattccagagaagactgttacaggacagagaagttatttagtctgaccaaccaggactgggcttgaggtagtttctgaagagggattctgcaaggcccagagtagagcagagagagttgctcaatctccgaccagaactaggagaactagtttaaaaggaagttgtaagaaagacctattactctatttatgaatgaagtaaaggaatgaagaccttacaagaaagatcagaaatccttatcactagcatacaatgtctactatacagtaggcaccaaatatcatcttgttaaattaatttgttgttgctctgatacttccccattgtattgatttatctttaaatgcttatcatgattttaatttggaaataagaatagtcttctcataatattggagtgtcaagtgagaaataacaaattgtggttagacattgacaatctctgataatctgtcaagacttttacagactttacttagtttaattatcatgggacgtcagagggaatatttacaccagtggatactagaaaaatgaaaaatactggtttcttcaaaagtatagggaaacaaagaggaaacctttctcctgggcatcatcacttatttttctttgatatttattaagtgcacacagcattccaggtctgaaatagcctatggccaggaagcttctcctcctggactggcattatttctccctagatagagagttatgaaactccaaagcggaaggaaaagttcagctgtatacgtatcatctgaagttccccatgggcagaccagttctgattcaagtcaggacgagaagagattagcgagtgggaagacagacatacggtgaatgtcagttgtctctgaatcttgattctaatgaaaagtcacagcttttactggtaatgccctgaagaccaggctaactcagagataacctttgcttaggaagacttcttgagccgcctcaggttcaccatactttttctcttgctctgaatcctcctggtacttatcctcacagtatctacctcactcatttgcattatcttgcctttttttattttagaattgttcccatcatcatatatgttcttggtcacaagcaacttgatcgtaaataatattaattttccttatgatctgattctttcagggccaatcaggttgtgcagaatgaattaatgtgaattgaaattttcctaaaactttgaatcccaacttaggtcttcctggtatactattgtgaggatttcagcagagtacaactaggacagaatatggtctggtctgatcattcagtattgaattgacctaggaaatactctagaagatacttggaacccaggtatcacgcggcctgttttccattcagattcaccatcatcagttagcgtaggagaaaaagggcagaaggaagaacaagaaagtaaacagctgctaccattaagaggaaatctccatacagtctgagatctcccaggctcaaaacacatgagatttaaaacaaaaaaaaattcttttaaagttttatttttagttaatacacaataattgtacatatttatggggcacaatgtgatgtttcagtacatgtatacattatacagtgatcaaaatatattttaaggattcccttcaattgtgcattggccacaccccctactatggctttattttcttctcagaaagaataaacctgacaaaagaaaactaggttaagagtgggaagaaaaatgggtcctggtactccctgaaaataatatacatttgacaaatcttttacattgcttctctccataactgtaaaattaaaattcttgagcggaatgatcccttacagattttttttcagccctaatagtttatgctgctatgattctagctaatcaaatctactcctgacagtttctcaccactgtggaaagtactacaaaaagaccagttgggaactggcagctaatcttccatccttctgatagctttgctgaaaagccagttcaacttaccccgtttatacatgttgaacttgcctagatgcctgacctttgtcagattttgaagagaagaaagtaaaggaaaggagaaaccttctctccatccaacttttactacacatgaagtggtaggtcagcattaaatgactttttatctgtttctgccttgtgtatcagaatatggattttcctaagtgacatcaagcttaaaaaagaaattagctagtaaatgttttcctatctattgacacaaagtaaaattatgatggctttaaacaatgcattctcagccgggtgcggtggctcatgcctgtaatcccagcactttgggaggctgaggcaggcggatcacgaggtcaggagattgagactatcctggccaacacggtgaaaccccatctctactaaaaatacaaaaagttagccaagtgtggttgtatgcgcctgtagtcccagctacttgggaggctaaggcaggcgaattgcttgaactcaagaggtggaggttgcagtgagccaggatcatgccactgcacttcagcctgaatgacagagcaagactccatctcaaaaaaaaaaaaaaaaaaaaaaaaaaaaaatgcatcctctacataaggtattgtttagggcccagtttcagttgctgattgtccccttctctactaaattcttcaggtctgtaggtagtactctttcccatgcacaaatacccaactaatcttcagacttggaaactccacttaatgggttgtcccaacattttctttaaatccatgaatttcacacttacttccttttttgttcaatacttcaaaaaaattattattacttttagagccacatacaaccctgtcttgcatctcttgtatttttctccacctacacatgggcctgttttctttgattctcccaggtctatcccagctgctccttagaatcattcacccactcaactcttggcaacttctacattgctgtcccttaatcttggaacagccttccaatcaatgtgttttgagccacctcctaacttcagaaagaaaattcctcaaactccatctgtttagagaccatctagtttcaatgatcagtctcctcaccattttgagaactcttctaacatgttgaaatgtaaatactaattgttttcacataaaaattagcaagcactttagcgtttaatccaaacacccccaagctacactttgaatgaaaatcttcaatttcccccaactttcccattttaaaaatgggattgttttatgctgaagttaagaaatgaatctccattgcagtctgtgcatcaatgcatgagtgaaggaatgtttgcattgctttgggcactgtagagcctagacactgttcatgtacacatggttaacaatttacttctctctgcagtattaaatcttctcatgtcagagactaatagatcacagcatagttaacttactcaaatgacttccttaattcagtactgccagaaagcatttgaaagcagcaaatcccagaagtcttagtgacttctacattaagctaatgaaacgcatgtattcatgctacccgggaatgttggtggcatgtggcttacacctcaaaccaacactctcagtgggtaaaccaggagtggcagcgtgccattttcgtatttcttttcctgagctgcacactaccaccactttgatttctatcacagctgattccctttctaggaaactttccaagcttgttctcacacagcctaagagctgccttttttcaaccttcatcacttagaataccaacaatcaacatcctcatgtatttcccatactggtcaacaattttatcaatggctttgataaaagtaacagaaggcatgcctcttatatttatgaatgacctcaaaataaaaaacgtcaaccttaaggtaagtaaagttcagaaatttcctaagaaaaaaataaaattatttattattaaatgtatgtaaataaaactttcttaaaatatgcactacgaaaaggtggaataaaatatatcaaactaaaatagtgatatattttatcactaaaataaataactaaatatacatgcatatatatttatagatgtataaatatctatgatatacaaatgtctacatagatctctacataaagtttttctatactttccaatttctgtttaatcatgctatagtactttgataagaaaaatatattttaacaagtcattcattattgaaatgcattttgttaaatattaaagacatcaatcatacagaactgatggttgtaagcaaaatatcattttgctatatttgacagagataaagttaaaaatttctgcacttaaggtttaaaagataaaatctgtaagtgcaaaatattggagatttgtcttaatagtaatataattgaaaattatcttagatttttttttcaaattaagagtgatctcaacacaagccaatcatgagatttggctgccaaaaaagtaatggttcataggaggtaatttcaactaatgagtcttacagaagtaggaattgagcggttgtctttttttcagcaaacccagaatgaaagagcaaagtcataataagattatagactaataagatgaatataagcaagtatgcccaacaagcaatagaacccccaaattgagaccttcaagcaaattgtgggggcaaattgacagggagctactgatggcatcttatgcccccttgcaacttcaatgattcaggataccaagttgcaatggaaatgggaatgacagttattgcatcctgtggagacaaacatatacttcccaagaatgaagtgtgatctgtgtagtgagaatactgggctacgcaggagaaatactgaattggtggccttgagcaaggcacttagcttgcagttccttaatctgcttgtatttagtgttatgctgcccaggggctggacaaggaactggatggtttataaacacaattatacctatgccttatacaatactccatgagagctaatactattttcaatttatagttgacagaacaagctgagtgatctagtgcatagtatccgaagtttttttctaaagttagcattccttgcttcattgcaaaaagaaaaattagagccacctcaagtttcaaatctgatcatatagggtctgattcacccaatggttcctcacatttttcatgtgttgtaacttttatccatgaatatacaatttgtctggtattgtaataaaacaatagactttcaggaggaatgaaaaggaggtggtgaaggaatggaaaaaagtttcctttaagtaaagctagagtaatctgcttggcattcctcacaaagtttaaaatatatcccatttataacaattataatggacttcagggtgggtggggtaaattgatgagagataagaaaacacctgaaaaggtaaaatccatttctagttaattgttatcaattaagttgtttttctctcactgggacactgttctcagtgccctcaggccccaactacttacagtgaacagaactaatagcagtcagtttcattatgtctccttaacaacacgggaacctgttgtcctttaaaaatatataactgttttaacctttacattttttatttactcatacctaaatagagaacttctgctaaggtaggagaagtgaataccaagttcagctcaattcagttagttgtgctaaaggctaaaattacaggaacagtatgaagaaataattgacagctgaagtgcatggtcctatgaagcttctcttcggggaatctgtgattgctcttaatggcattttcaaaaaaaacaggtcctgttaattttcaagatatttttaaacactcgattacttttaaaataatcagcaccattatgaactcccaggaggctgtgaattaagaaatgaatacctttattttataacattttacaaaacactcactgtggacaataaatatcaaatccactaggggcttgggtaatgaaacacacgtcttgaaaaagtaaaactgaaagatgattagataattaatcacaattaaatttctcaactgattttgaaggagctaaacacaagagagcagtccacagcttcatcttttacttgaaactttttgatgcctcaaccccttacagatttaaggtacatgctgagtaaaccattttggagaagaaccaactataccaggtagaaaaactacattttgggcaatctggggtggggagtacaggcatgattctgaattatgccattcataatacagtgaagtaaaatagactgattatgaatataccatgtacttgaattgtccttgcagtggcacagggctgatatcaaccaacacaaacaataaatataatgtacctacatttctaattgtttataatgaccatcaaatatgattctagttctaatctctttgacgatcttctagaggtcataattctgtggaggacttgccttagctcgggcaacactgagaatccagtacatgtgtactggcactttcatagccacttggaacacatacaaatgctgtatttatctttattgccctgtatacaaaccagggtttggctttcctgtatcctgacagtcaaaacatcttccggaaatgcttctcagcaggaagttggcagtaactctaaaattgggtttctgacagggcattctctaaggagtatcgttgctttggaattataattttatgctccttagattccattcaattatattgaaattcaggatatttgttgaaaccaatcctgatactctgggaatgatagggcattcttttcttatcatatttcagagataactatcaatcattcttttagtcttccatttctttgacacccttttattgaacatctcccactaaataaaggttctctgattgattttatgcaacagcaaagtaaaaaaaaaaatattgttactttgagatgtttatagtctggttaattatgtggtcactacattaaacaaaagaaaacacatcttgtggcgttagcagtatgctgacagcctgggcaacgtggtgaaacctgaagtctacaaaaaatcccaaaaatcagccaggtgtggtggtgtgcacctgtagtcccagcttcttgggaggctgaggtgggaagacagcttgagcctgggaggcagaagctgcagtgagctgagactgtaccactgtacttgctagacacagagcgaggccctgtctcaagacaacaacaacaaaacaccaaaaataaaaagtaaatatgtgtgcaagcacaacatcagaccaaaatggtgataaacagacagattcaggcatatgaataagttgacatgtccaatgtatctagtatcagtcttctttattcctaaaatatggaataaaatatgaacaccatttagtccaatgataattcttacatagagaaagaaagttagacaataagttctgagacaatgtccaccagcatacaagctatttaaccaataaacttagatttattggttaataataataactggtatcaataatatatgaacatgtcattgatacaagtaaatctcttgattagacccaaatgtatgaaattctaatactgattctttgtcttttctctcttctcttatctatgtccaattagtttttcaaggcctctcagaggttatttctttcagttcccaaactacattaggttctcctataatcttttcttggtttgaagcatcttcgataattttaagttaataaattgctattttttatcaatgtccatcttccacttttaaacttaatttcatttagctgacttgtctgcctttgccaatatacctatgaccataggagagtaactggaatgtagtggatatacatatcgttaaaaaagctgttgaaataacccaaaccccagggaaggcctcatattcaaatggaactttaaatacaccattgctggttatacttggtgatgttatggtatctaatttcttttcgtgaaaaggttaaattaacaaattaaaatttcagactggcatgtcaaactcagaattatttataccaagttaggcaatgaaatgcctacatcttatacttgattttatatactttcttcgtcttaaatagtagtattagactgtattgagtatcaaaccataagtatgcattctttctgtaaaaatggtcaaataaagacaggtaaaaagcatggattttcctgtatgtttttatagaaatttcatgtaagctaataagttataggtttgcctatttaaacaggctttcacctggaggacaatggggtgttacaggaaataggagaaattctcataaggatgattaagttttcctaacttctcctcctgccctttttttaattccatgaatcaaaagggaagtcccctttgtacattcttcttttaacttataaaatctatttgaaaacttataatttaagagaagatctttttgtgaatttaggaacttattcctgagagcaactaatttacacaggctagtgtggctcacgcaatgacttaatttttaaaatatcaatgctgtgtaactgtactattgctacaaaagttggtgacaggagaccttggtaagtgttatggtttgactgtgttccccaaagttcatgtgttagaaacttaatctcccatgcagcaatattgagaggtgaaaactctaagaggtgattaggccatatggatctttcctcataaatggattaatgtcattagtataggagtgggtttgttacaaaagaaagtttggccccctcttgctctcttgtgctcccttgacccccacctcccctcaacacacacattttaccatgggatgatgctgcaagaaggccctctccagatgctagccccttgcttttggacttcgcagccaccagaactgtaaggaataaatatctgttctttataaattatacaatctgtggtactctcttatagcaacacaaacagattaagaaaataaatcatattagtatttcacaacctagaagagcaggaattttaagaataaacccctgaagcacagagttgatgtcatttattctaatatgctctggactgattttcccagactttggaaatgttttacctttaacttccagaataactttcaagaattttggcctccctagtagagctcagagagctaaaacagcagaattaaaaggtcttgggagtgaggcagggcagatgaaaatgagaatgttgtctcagatatgttagagagtttcacaagtttgcagaaagaaaaaaaagcaagaaaagacaactgaaagatacaagtaaataagactgagataaaatgctggaataaaagagaagatccctgagttgactgtgcattaatatggaatgggaaggggaattgaaaaaaaaataaagcctatagagcaaaattttattagaatagcaatatcataagttaatgagtttggttataactaaacctaattatagtgctttaaaaataatcttcttgggaagagaatccatgtgtttcaaatttacattacatttgaaatacaataaaagcaaccctcttaaaatatagttattagggattttatcacttattttgaaaatctaatacatgatattgaagcgttgggaacactgggacaatgttggtttttgtcacaatgcagctttatggcaaggattcctattcttgtttatttaagttccaatgtactaataagataggctggcttttagcaaatggatcaatgagtcttaatcccagatctgagactctctgttggttacaaagcttctaatttacacagaagaataagaattaaaatggtcaggctgcaacaaatggcttagggatgaatgagaaacaattgaaagtaatttcctcaattatgtctcttctctttttacatgcagtttctgtacaattcagagaggtacatacagagggaccacttcatttagtaatctatgtttccgacaataaaagaaatcttatgaacaattgacttattttcatttgtaaacatctctgcagattaatttttgctgctacttaatgaggcagattatgaaacttacttattaatttatcaaagttgccatctatgataatcattgaggtgtccctctcttgaactactatctgttcatcaccaatacagccaatcatgcaattctaaaatgatgtgatcacaaggcttacatgataactagcgatgaattcatcaaaccaaacttatttaataataccagaactagcaaaaatacactaaaggagaaattaaactgcaaataccttctcaggtaggctttttatatgattgtcttactgcctttctaattcccatagcgacctcctttgttattatcctgctacataaagagttgactgagttgaaattacttacagattatcactacaggatgcattttactatactagcgttttgatagccctgactgtaaaacattgccagatgataggatcatagaagaggaatagaaatgtcaatgcatttaagtcatgagaaggtgccttagactgcaataggtaaggtgaaaaagagatgtcttttacaaagatatgcaaatattaaatatcataaatcagttctaaattttgagctaaactctcagaccagaataatttcaactttaggggaaaaggtgaattgatatacagtaatagaggacaaagagaaagctcatagtggaagtaatattctttgtaattggtcatagttggtgcttgataaatacatgtttcatacatgaataaacatgcgaaaacaaagacgtagtagagaaaagttttcaaatgggtatcctgaaagctatatcaggactgctaactagatggtttggccaaggtagtgtattaaaagcaaaatgagcttggtacagtggtgtgcacctgcagttctagctaccagggagggtaaggcaggaagattgcctgagcccaggagtccaagaccagcaaaatgtacagtgtttaaaaatcaacagattttactttaaatcttcatttctttaaaatttggatgacatggaaacattcccgggaaagaagaaaaaggggagaactataatggataaattgcaggcaacaaacccaagacattttcaaatcaacaggtgccatctcaagagagaagccattctattgtccagatgttatcaatttctaggtattgtaatttaagggccctctccataccaaaaaaaaaaataataataaaacatatgtatactggatgttttccttctttgaaacaatttatttctttaacatccaaagcgctaaacattacgtctgtttttcttatcatactgccatttattctcagaactcaatcgcctctttagacaaagtgcatttctcacggtacctggtttctttggtcatttaatttatctgcttgctgaaatttgagtcttgtgaccctccaagtagaagttcaatgaaatatttcagggagaaggattacaggatagtgtgctgttttcaaaatacacaaaacaggaaactgttaatttaagaagtaaagatattttggctgtggaaaacagaaagaacttaagaaaaatgagaaagataggtaaaattaggctgttccaaagtctggattttttgaaaacttgagatagaatgtatattgttcctcacttttatcataacaacttcatttttactagtatttttattctctgaagtttgttacatcgaagtgttcctttagcaggaatagatagatttgaaaaataggcttaatctactatttcttcaggactttctccctacatgagaatctggcaaaattactgctcacttgctgctgacacatacaattcccaggaaaaaagaaaataagaggaagaattatgcgagaaaaatcacaggcagcaaataaacccaagacattttcaaatcaacaggtgtcatctccagagagaagccactttgttgtctccatgttgccattttctaggttttgtaattgaagaatgtttctctacactataaataaaacatctgacacggtagattattctcttttttgaaacactttattttttcagctttcaggatgtcacacgctagttctatttttcttagcttgctgaccatttattctcagtattctctgctagattctgttattttgtgacctccaaatatgagaaggctcagttttcatatctcttccccatctaaactccctttctgggtaatttcatcttgtcctgcgactacaatctatctatatgtgatgatgcttatgcttgcatctccagccacaactctccctgaaaattctgactcatgtatccatctacctacttggatgtccactaggtatatcaaaaccaaagtctaaaaacaacaacaaaacatccacttttccactccaacctcccccaaaggataaaagtcttgattttccattcgcaacaagtcttccgctaataacaccactattctcacaattaagtgggtcagaattaaagaatatatttaaattccgctttcttccactccacacctctaatctgtcggcaagtgcagtctgctctgtctctaaaatgcatgtgggattttaccacttattggcttgaacctcacaaccacctaaatctaagccaccactgtctcttttgtggacgcctgctacagcatcctaatacggttttttttcctccctcttctctgcaatctattgtccacactgcagccagagttatctttttttaaaaaataaaagtcatcctcatgatcaaatgttcccagtggctttctaacacacttagggtaaaattcagatccttttcaataacctgaatgatatgagaaggcatctggcctccttcctgctcttcctggcctcctactctttttccttcctgctcatgctcctccagttacccaggtcttcttattcttcaaacatctgcatttgctatttccatgccttgtgatcctcttcaccaagacagtcacatgactacttttcttatttcattctagggtataataaaaggtcccctttcaaagaagcctctcataatttttcctaatataatctcctattactttctagctcactttttcccatttccctgctatgcttttcttcataggtattatattatactcacatcatattatttcttttttctttgttattgatattctccaatagaaattatgttctaggaggataagaattctattttgtttacacttgcccataaagcctgacatatagttgacactcaacaaatggttgccaaataaatgaataaattaaagactacgagattgaaataccagaaaatgatcataacacttgtcctaattctttacctcacatcaaaaagtgctaaaatgtgctgtttaggaacccaacaaagatcacttaaaatattttattaaacatactcttctacaagcagaagacattataaaaaagaatttttttctacacattatttatcttgctcacatttactctgatataaaaatggattctaacgtatatatcagctctaggaaaaatcaaagcaggtcctttatatgcttgctagttttaaaatacagtctgatttcatccacttcaattgaatacgcaactaccatttccttgtactctgctgaaacttgtgaaagataacaaaatgaatcacaataactattgtttatagaacaacttaacttatgccagggaatgtgctaaaagctttacaagcactatatcatataagttcctgtgacaactccatgaggtataaggttccctatttcagagaagacaaaactaagtgagtcagacaacttgtcctacaccagacagctgttaagtggaggtgaaatttgcatccttgcctttctgatggctacattggtcatttttagtgtagaactcactgccactagcaggactcaagaacactcctggtgaccctgatgactcagttcatccaaatatgtaaatcctctgctctgtcgttagggactaaggttgttgaaggccatttacctatgtctagagtatccttaccagtagattattgaaaagttattgaattactaaaatttagttttcataaactaaaattagtacttaatagagtttactgagaattctaattcaatatcctaatgagaaagctggctgctacccaacacctgagagcaatgcaaatcgcaccctctgcaagagcacatgcaaacaggcagaactgccaaaatcttcagcacagataaaagtgtaagtggttttcaagtgccatttaaagtaacattattcctactctaaataacaaattcctgtttatttagacttcattattgtcaatttaacatgtgaaagtttctttgcttaacagtatcacatgtaatggtacttatttgaatcagaactatttgtgatctaaaattgtattatggatatatttttagatagctacacatagcaaacaatatgaatcatccacattcctgctacaaagcaaatatatacatatatcacaccctgcttgaattttactaggtagtgaattttttgttatcaagagtttgagagttttttgttttgtttttggaatgggttatgaggaattgtggtcaaaaaacgagaacttctttttggtgttaacagggctatgtctgctttgctctagtgattcctaacctactgtgcgaaggaggcatagcaaggcaagactgtttaagtataaccataaagggactcacgcactctcaggtgaagtgcaaaaatactgatcacggtgctcaaacattctggaggagtaagcattcaaattcagaaatgtaagatgatttctcaaagaaaagaggaaaaacctatcattaattttttaaaatatatcttccagagcaggtttctcaacaattttacatagaagacgagtatttttgtctccttaagatttggacttaaggtcaaagttgttgaaggttgatcggctattgtaagcttcaggtgaaacctagagaggagaagggaagaagataaatctactatcctagattctttttaagaagcagcacgttccactcctgactctcccgaagatggtctcaggtcttcaggtgaccctatgcaaggaccctactgtgcactctgctgagtgttctggctctctggtatcaggtcactgggcctactctacttttggtgtcattctggccctgtgaagaaactatgaggagaatctggtcgatgcattttgtagttaacaccgcaaaggacatgagaaacttagccagagagctattagagtggcgatcagtgacgctgctgctctacccagtctgtcttgtgtgctttaagatggaagacacctaatgctgacttagccttccctaaagtgaacagaccactcttctaaggtttctgcttgttgtcaggaagtataagcaaagaatgacaagcagaacaatggacatttgttaagtgattggcttgcatacgttggctccttcaatgctaacagcaacgagtaggtgccattattacagccatgttacagatgaacggtgggtactattattaagtccatgttacaggtgagggcgtgaagcttatcaaggagttcattggtcatttcttgaccaggacacaagctcctaatgtttctctcttttttaaatctgagttttccaacactttttgatttaagaattgatctggaaagcccttcattcacagttgttttctggctactgtcagtaaaaaggataggctcaaaggaaatctgttgtgtttagaatggtggaggtatgagagatttcttttttatctttaaaagcttcattacttgttttactggtgttagttattgactctttttcctttatagtaacagaattatttctgtatgaaaggttatttaaaaagtcacattctaatggcaatcaattaattgaccaacaaatacagtaaaattgcaaaacaaaaccttgcaatgttcttaaatacatttggacactcaaaacaagataaaatcttacagataatgtgaatacattattagttatttcacattagaaaggaagaatgttggaaaaaaacatcatatttggtttaaacattgctttccacacacacgtttcagaggctgtgacattttcaggatcatagattctttggctgtttttccccttttaagtggggatgatttattggctaagtttccacagtaactcccagcacttgtagaactgtttagcaaatctgcattattttgcatttccactaaggtcacggttttcatagattcaaacagcaaggaattttaaaatttctccctctactaaagtttactggctattgtactcattatcttagcattcttattagtttcttttgagaaagtacacctggtaaagtcgagtaactaaaaagggtatactattcaaacgcaatgttattcaagcattggaatcctactcaaataataaaagaaaagaaaactgaaaatagagtgaacaaggttattatgttaggcagagaaaaaaaacagtattgtggaaaacataagtatgtgtaggatacacatgagacctcaaacagatgcatctttgtggaaatgtaaataatttattatagcagataaaactgggaaggagcttctgctaattaacatacacagtcattttccctgtgtagagaagtccaaaaactgtttccatttgcaggcatgtggtcattagactaatgggcactgcctttggacaggatttacttataccccagctggctcaaaaaagtaatcattctctaattaagaggcttcctcatgtgttttctattgtcatttctagagttccactatatctagcttggtagtacaaaagtggtatgctatttaattatcagccagtagtggggctgagagataccctgagtttcatcatgcagtcatttgtttctattgatggtagaggataggagggtaggtatacaagcatatacatgaaagaaactttcttttcccactcagttggaataaattataacatgtctggacaaatatgtgcgtgactattttcaggactgattggaggtcataatggattttcgaaagtaaaactcaaatagagaataagcttgattattctactaaccctctgtttttatgtttttcacttagattttaaagggttgagtttttaaagggctttagtaattttttaagagacgaattcaagaacaggggaaatggccactcctaaatattgcataaaacctggttgacaccacatgaggtctggaaggatatatttcccattattaaacctagctgtccctcatataagaatgggttacttgcattattttttacttttccattcttgatcaatattttcaaatgtttctggaaatgttttccagcactgttagagggtaacacattttctctactcctgagttcatgaggaaggattttatttttcttctcggtttttccctatgcctttgattaccacagttgggaaaaataattttaggcatgttctgttcagttccatgcttcttcctattgggagagcttttataaggaagcacagggccctttgctctttcaagggctctaattcatgggtgccccttgcccagggcccatcacttgtgtgcatggagttaggcttgcctaacccaggggtccagtaagcaggttcgtgtggctctcaccactaagtcatgttgtccaaattggtctttgtgcattcaggtgtttttgaaaaaccttgttcagtattctgcaaaaacttacactattccaaatctacccagctctgtaacgagagaactggtaaaaaaaaaaaaaaaaaaaaaaaaaaaaaaaaaaaaaaaaaaaaaaaaaaaaaaaaaaaaaaattctcagaaaaatattatcattgaaaggcatttaatttttaataaataaatataataagaacaggtctttagttaaaaattaaaaggataatgttgcttgatagatgggagtccaggaaagaattgtggttaggagacatgagtaaaatgcacaaatgtcaggtagacgagtacaattaacacttgccaaacagagcttgtggcataatgcaccccaagaaagaatagtctgaacaaactgtacttggttcctctacagattgttcccttcacctatttgtatactttgcatgaaactactgttacttgctgatataaaacattaatatgctaggaaaaaaaatcacaaatgaaggaagcgatgtcgagtttcctttatactgacatatttcccatattccaatatgtgtaagattttccacattactgaaatggaaaacatagcagaacagacaaaatcaaggatgataattgtttattcatctacactttccatcttttttaaatattcaaattgtttagaactccataaggagtgctattggggggtaggggtcttcagaaacgccgttgctcatataaacataataaagtgggaacatgattaaaatacttagatttctgattgtaatgaatataataaagaaaaactagcttaaataaataatgccagagggtatcaatggctggacaagataagagtttcattagcaaaaccacaaggcactagaccagaaagtttccaggtgaaaggacattaaaaaggttccattggactaatgaaattggaatacactaacaaacatgtcagtgtggacaagtaaggttctgctcaaaatctgtaaacttatcaagaaagtatctgctagaattctgaatgctgaaactgaaaaaaagtgtgctttgggcaaacaaagaggaatgttttgcattcaagaagtgtatgttttatttttataagatttggtagaaactgaagatatgaatatgtttaagaaatatacagttgattatcaaagggcatgttgtgatgatatttcacacacctgggttgatgctccgcaagatatatctattcatgtcatagtgctgtgtgatcaccttaatgcaaaatcccagagcagaggctcttgtgaactgcactgagaagtgcccactctaataatgaaatattgtggaccttttctgatactcagaaaagtgggttaaccaatgtaacatttcaaatttaaattttcttccatgattttctcggatatttttggccctgttatcaaaatatgttcatattagataccaagcgctttgtttaggccttcaggttcctcattcacactcaatgtgggaagatgcttacattaatttttgtttctaaaatggaaatattttaaaatctataccttaagatgggaaggcctgctagtaaaattactcttaatgtatatgtgtgaatcaaataccaatatcactaatggtttgaaaaatcactgcccaggagtagcagtaactgcaggacagtcaggagatgttccagtctctccctgaaagcagacatgtgtcctttggcaaatggtttgataactggggacttggcttcttcactggtgagagcggggagggagagggcttaagtggcccataaaactaaaatttctaagattccttctagatttgattcccttccaaagtatgactaggggtaccctaagggaagacaggacactttactagatgaattcagctgggatcctacgtgagacgtctttaattggttatattaatagctaatggcaaacaaaaggcaaggcagagaaaaggatggagcaattattgcatgctgagaccattttggggtaggcaagttgccacaagagcctatggttggaattttattttattttattttttacaaacaaaacaattcatttaaaagcaacttaaaacacaaccagggtgattttcctaacagctctttctggtatttcaatatcttgctatattcaaagctggagataatcatgcaaaccagccagccttttcacttcctggaagccctagttcagattattttactcttagggaagtgacctctcttcccctattgacctgggaaggggcagaaaaatcccagtagagtgaactgaaggtttgatacaagaagttgctcaacctggacttgcctagaacagcagccttttattctgattgaatctgtggaaaataagacccagaggaactcagactagtatagcttgtcttcttttatctattactgtttggaaaataaaattaatctgtagcagaagaaaaataaaggtgacaaacatttgctctaggtacctagggatcaaagtaactgagccttcatgtctttttttccactaatttaatacatccattaattttataagtatggatacaagagaaatcatttttttgttggtttttttaaatggtagacttatttgctacatcagctataattttttccacaccccttttttaacatcaaaaaaatgtaaaaacctttgcttcaatgtaaagtatgttgaactgtttccaatgatgaatatcatctgccaatctaataaatgtgagtaaggtgaaaacggaataaatagaatgtgggggcgggaaacaacccttgaaacggtaatcagcaagtaaagctgaattcctatgccatagtgtcccctgctggtcgattacggaagtagtagctttcggagagcaagtcaaacctcttggttaggccatatcatgttttgaacaaaaaaggcacaaaaacgaaaggaatgtgtgcatattgttttttgtctatttctttttacatagtcatcattggcagtgggacgaatgggggaaggattgttttatgcgtgaagaatcccagagcccattagaactaggcttagctcagccacttctccagtgatacgtgatctggcactcacagatctttctttaagcctcaactcctccctgtaaattgcaattagtaataataataaatgatagatttactgcagagagctgttacaaaaacataagaagagaaggaggaggaggcggaaattacacacagtaaagtgtacttaaaatgatatagcgctttccaaaacaaatattaatgtaagggtgcggattgggggagacacttccattaacaattaaactaacttcccttataatcatcaaaaggtaatccaggctgggcaccccaggcatggttgctgagctatcagactttcaaattcctacaacatcacctggtttccaaggacttacttgggtacctttgaacaatgtatgttgctcagataatttatattacacagaatttactatatacttagagaggtctctactggttggtaaacagaggtgatggggtaaaggagattaaggtgctccttgtttgcttgataatcattaatgattgagtctccatcctgttgctagttgtctgaccagcagcatctgcatcacctgggagcttattagaaataaggaatcttagatttcatcccaaacctactaaatcagaatctgcatttaaaaattatcccaggtaattcttacatatgttcaggtttaagaaactccactctttcacatttgggctataagctttctctggcaatacatcagttgttatctagtacatatgtacagaatagtatttttgacttgaccttattttaaaactacttggagaaattaaattagaaggaaaaactatggctaaggataattaatttttatgagcctcaaaagagacgataataagatgactttcctaaatgtaacttagtattatgctactttaaaatttttacagctttgtaatactaattttaaggtaatctcatgtatttgtattaatatacacattttatatttgcccttagtatctgtgttgataagaattttaaaatgcagattatttcattagaagagattttagaaaatagactcaagtctaagcagacgtttgaaaaatctaagagggccgtagcttccattaaaaataccatttacccaatcttttgtcagttaatgccctctgaacataagacaatgttctgagttgttggaagtggactgctatactagcaacacctatgatcacagtttctctatagatacaattttaaaataaaccaaacttggaaaatgagtggatgggtattagaaagaaaattcattctttttcacttactccctaccccctaccacttaccctaagctccacctcacaccctctgttgtgtcttcttcctttaggaatattttgtttagtttttttttgtttgttttgttttgttgttgttgttgttgttgttgtttttggtcatagctatgctctatttaataggtgaaaagactttaatgccagtgcttcacccaggatagtttctttctaactggtccttgctataaaagtatccattctcctcctattatttagtgtcctggctataggtgaaggaagtcatctgattcaaccagtgcacactgaggtgtgtgaactctgaacattcttctttaacctccctagtggaaacccactgagtttttaggaaagacactcacacaactcagtgaaaagcttcttagcagaacttcatacaatttaagacacaaagagttttagggttgaagtgggagatatttcaggacccaggtacctttctgggtccattaagcccctccaatcttctttagcctattttctacctaaactataggctctagctagctacacaggtaatatccttgtagaagggtaacaattgtgagaaaatatggatttcagagtttgtctgatttcctttactgaacactcctttgaaagtattgaaaagtcatatgtttccaatcactaaagttggacattaaggatcaggaaaaaggcctggagggggatctttgcagtataagagttttgactccctgctctagtggtgagagacctttcagtcagagagaaaggatcttgacttgagagagtaacagggtttccaatctgttcctttcattgaacagagttcaaaagaggctcaagggtgcacctctcttaggctctttatattgacacactcttctcttgccaaaagcttggtttgcagaacaaatcaaaaacacacccttgacaaacgttctggtctagaataatcacctcttccccaacttactatgccaaagaggggagcttaaaaatgacaaggtgtgtgtgatattgtctatctctgcattcttcataaatcttcaaagtcaatatatctggactgaactaaggatatatgatgtttctcatgctttcatttaaagtaagatcttgaggatctttccacttgcagattgatatgcatcacagaaaagtttccttgttgatgttcaatgaagtcgcaggctcaacacatgagcctaccaaacacggcaaataaaaatttgttcaagattggaattaagggcaaaatatcaaataaaatgctattgcaaacaatggtgtctcttcaaatgctaggtttggcatagaaaccaacaatctccaagaggtggaaagaaaatgaagatctcttaagggcaatgcaaacttccagagacattaggatttgcttagcatatagaaaacaatgaaaataaagaaaataaaacaaaacttctttctattgtgtcacagtaatccacctgttggtagcacccaatttggggactgaaataatggtgattttcaacagagaaaattgtacatttcctttatgcatcctttcttcactatgtttctgactttttcttctacctcaacatggtacagtgggaagcaaacaaaattgggaatcagaagacttattttgctcccaggtttattactcactcacgtgactcaaacacagtgctttaatttcctgaggaattaattatatttgtatgaaagaagtattgcactctatataaataataattacaggaaaaataataatagctaattcttaatgagtatttcttattctccagtcatttttgaaggtgatttacaattgttaattcattgaaattctcacaaaactctgcaacgctagataatattattatcattgttttatagatgaggaaattcagccacagattggtaaatcatttgtccaagatcatgcagctgataaatagtgaaatcaagattaagtttaggtagttgagctccagagcttacagtttttcatgttaattctcctcctctgatacattttcaatcccctattttgatgccatatcatgcttttccaatgttttctgctttctataaaatgttgatacctctaggaataagtctttaaataatggtttcacacctattgggagaagacatgatgggaaaaccaccataaaacaagatggaacttttaagaggagacacagtcataaatctgttctaataaataaaggggaaaaaaaagaataaaaagttaaccccttaaagaaaaacatacttttaaagtctgtctggatcttttgtgaagagcaaaggaaatgctgaataaaaaaggattttgattgtcctttccaaaatattgtcccttacctcttggacattggtgacaccacccacactccacccacctttaatgacctctactttctagtaaaaaactttatctttgcataaactttgttgttttgactctgcaatcaggaagatacttcatagctatatctagccaggtgtaggtaggatctgagtggaaagacagaaaaggaagttatattcattataaattaatgacatgccaggtattaggcatgtccacatccataattaataacattgggttaagcatttccatttaatacagagagagacagacagagtttgcacagtatctttcctttggttcttatctaatgactgactctcttccatgtacctttaaaaccactaaaataaatggtctacttgggaggttgatatactagccaagctataggtctaaacttcaaatgcaatttaatctatgcagcattcctttttcatagtgaatctttaaagctcaattttttgcattgattgatcatcctgggaaacagaaaaacctcaactcacagcttcaagaacttgaaaagccctaatccagtgcctatatccatcacctctgaggacaacaggaaaattgaaaaggaagaaatttcctacagactcatgataaacttattgatagtagtaatgatatacattttttaaaaaattatcaaattgtgtattttttaaattattaaactcccatggcctcaatattctactctgccaaatgatgggaaaatttaaattgtttctacaatttcccacatctctataacattaaaagatcaacttcttaaaacatatgtaacattttctttccttgccccaagatgcttttaaaggttttataaactacccttctttggacatttttgtcatcaatttgctacttttctgttcaaaatgaataacagcttcccataggcaatgatactattatcctctctgcatatgtaaactacctcgccttcaggacacaaaattcagtcccaaatcactgtcttcagcctcattgatattgtccctctcctaaagactcctatggcttgaatatgtgtcccctccaaaactcacgttgaaattttatccccaatatggcaatattgagtagtggggcttttaagaggtgattgggtcatgagggctgtcccctcatggatgtgttaatccatctgtggattaatgggtcatcatgggagtgggggtggtagctgtataaaaagaggaagagagacctgagctagcacacccagccctctcatcatgtgatgccctgcaccacctcacctcaggactctgtagagagacctccgcagcaaaaaggccctcaccagatatggttccttgaccttggaattctcagcctccacaacggtaagaaatatattccatttctttataaattacccagtttcaagtattctgttataagtaacagaaaaaggaatatgggaaagaccacagcctttattctctgtacatggcttgggcttcatcgtcttctcactcatactattttaacatctgttgtatgtttgtttttcctatccaattaaactaaatgttaaataatgacaatgcactcaataaatacttgttgtccttccaatatttattcagtaaatgttttcagtgtatagtatctatatgcccatcttggaaatctaagaataaataagatataagcccagccctccaagatcttaccatctggaatggtaaggtctcacaagaatggcaatgtaaattcagtgaaatatttccaagggctactgtgaagaatgcaaatctgagtctacaatagattaacatgagaatttccaagtagtaatgagagtctggttaagtttattgcctggcacaagatcacactaataaagaatatttattgagcacttaccatgtccacatttagttctcactacaactctaggcagtgtttctatcttcattttgccagtgagggaattttggctttggagaccagtgttttcccaaggctgcatgatgtagctgagatagccagggcttggtggaacagtctggctttcagtcagctgtaaccactctgcactacttcctcttgcttacttggtgcttttaaaatatttgttgaaagaatgacatgatgtagcatgcatcaacagtgaaaaatatgctctgcaatagactccaaatttcgaggtccccctaatttggctgtaacattgattgtgtgtatgtgtgtgtgtatgtctgtgtgtgcgtctgtgtctgttttagaaatgaatttacattctacacctgacttccatttgcccctctgcattccctattgccacagctgaagagtagaaatgctttatggctctaactgggagcagaaatcactgcaagtcaagagttgggtgaatcaatctcaatctctctctctctctctctctctctctctctctctctcatatttatatgctctaaatctgactgcaccttttcagaacatcatgcatagtatgaggggactaaattaaaacatctgacacaaacattgagagcaggaaaaaaaattgacatgtggtaactttttggagtggcattctggttgatcctttttcaaggggaggggagggttgtttacagatgagcccaagcttgatgcatgctgcagccaagaggcagctctcccctttgatttttcctctatataatctccatgtggtccccaaatgcttaaccctctctgccaaatgctgtaaaatctgtcttttgatttcacagatggaaaagacttattagctcatgaagctcacctccttaggagacaaggaactcatcaaataccatttaccccacccttcgagtttgaagtctttatcagtttcctggccaaaactgttcaacctcctttactcatatgacatcctaagtataaagaaaacaaaacaaaacaaaaatccatctttttgtttggcttctagtggtcttgggactttcttccaaagtgtttctcttgctgtgtttttaggcagtgccctaggcaaagagaaaatgaccatttgcatctcttggttataagtaggcttgtcattctcaaaacaacaacaataaagagacatacttaagcaccctcttttgcattgggacagcatcacctggaccagtttaaacctttcaaacagtacataattatactcaagatgaggattttaaagaacactcgacttggaaaacctactttttgagttaagccctgttaccaccaaatcatttggttttccaaagtttagtttcccagatgatgaaatttcaagttcactacaatagttacatgtataagaatgtaaggtgctgtgtcaacataaacacatgatttgattatctattagaatttagtgcaacctgatagatatgattaggcaattctttataagtggacacatcttttgtaactgattttattatactcttcagttaaaaaataatcatcgttccttcattagttacaggacagagttcaaagctctcggtattattttcaagccttccctaaatctggctttaaatgtctctctgatctcatgttgacattccctacgtgaaccctttactcctgccacattgacctttttgtcctgtgtccttcccatcagtgcctgatctgacatgccccttctttctatccctcctgctcccctacatacaagcaaggatgtagaaactcgacaatcctattctccaatataaccagcaatttttaagcccttcaccaggatagagtgaagaaaaaaaaagagtacctctaaatttgtctcttttttgccaacacttaatacaatttcaaggtctggctggaatttacttcttctctaaagcttgcactgctatcagacctgtgatgctctcctctcctgaattcctattgtttttgttttctaaaacacacatgtgatacttaacatatcctaccacctatgatgagctacttttgtacctatctgcctctcagaagtatgcaggatgtcaactgcacatgtgcaatgcatgttctcatatgtgtacactcttgttgtatgttgtatattcttaactaagctcctggagcaaagaactattcacacactcattctcccaaagaccagccccatggatagtgtgtaatcagtaaaatgaatgaatgaatgaatgaacgaaagtaaactaagatgaaattttaactgctgacctttgctaacactcccatgctaactcacaaatatttcagaaaaaaaaagtataaaaaagacataatgatgagaaaagcattctaggcaggcctattgatcttgccaaaaggagatgcagagtatagatggcacagactatgaagctgctgagatgtgcctcacccactttgaagagagaccagggagcacagtacttgcattatcattccactgttggtctctgaatcaaaagagaaggaggcaagttcctagcttaaataaattatttagaatattgatttaactgcctgaactgtgttaagttatatctgaactaaaagacaaacatttgcgtgtttcctttaatggaatctgtgaattcaaacatatatttgggtttttaaaaataatctccctctccctctccccctccccgtccctctccctctcctctttgcatggtctccctctgatgccgagcggaggctggactgtactgcaacctccctgcctgattctcctgcctcagcctgcccagtgcctgggattgcaggcgcgcgcctccacgcctgactggttttcatattttttggtggagacggggtttcgccgtgttggccgggctggtctccagctcctgatggcgagtgatctgccagccttggcctcccgaggtgccgggattgcagacagagtctcgctcactcagtgctcaatgttgcccaggctggagtgcagtggcgtgatctcggctcgctacaacctccacctcccagccgcctgccttggcctcccaaagtgccgagattgcagcctctgcccggccaccaccccgtctaggaagtgaggagcgtctctgcccggccgcccatcgtctgggatgtggggagtgcctctgccccaccgccctgtctgagatgtgaagagcgcctctgcccggctgcgaccccgtctgggaactgaggagtgtctctgccccaccgccaccccttctgggaggtgaggagcgtctctgaccggccgccccgtctgagaagtgaggagcccctccgcccggcagccgccctgtctgggaggtgggggggcagcccccgcccagccgccaccctgtctgggaggtggggggcgcctctgcccggccgccccatctgggaagtgaggagcccctctgcccggctgccaccccgtcccggaggtgtacccaacagctcattgagaacgggccatgatgacgatggtggttttgtcagatagaaaagggggaaatgtggggaaaagaaagagagatcagattgttactgtgtctgtgtagaaagaagtagacataggagactccattttgttctgtactaagaaaaattcttctgccttgggatgctgttgatctataaccttacccccaaccccctgctctctgaaacatgtgctgtgtccactcagggttaaatggatgaagggcggtgcaagatgtgctttgttaaacagatgcttgaaggcagcatactcattaagtcatcaccactccctaatctcaagtacccagggacacaaacactgcagaaggcggcagggccctctgcctaggaaaaccagagacctttgttcacatgtttatctgctgaccttccctccactattgtcctatgaccctgccaaatccccctctccgagaaacacccaagaatgatcaataaatactaaaaaaataaataaaaaataaaaaaaataataaataataaaaataatcttaaagagacataattctctcccttttaaaatacatattcataagtatgtatatttataaagggttatataccagggcaaaagttactgataatgattctgcaagaactcttagtttattgccttcatttttaatttataaatgaaataatctagttcttaggttggctaatacaataatgttttgcttttttttcactctttataaaattcattttacttattttagatacatgtcataaaatcctcacttgcatttgcttatttttgtggtaagctaagaatttaatcttactgaaataattataaaaaattaaagcaatcatacaatataataaaagaacatagtctgatttttgtaaaataacactcagggtatgcagatatatgacagacataccttttttccacacatctacaatgatacaatgatcttattttcaacaaaggcaccaaaaacatatcctggggaaaagacaatctcttcaagaaatggtgctgggaatacaggatccatatgcagaagaacgaagctagaccccaatctttctccatatgtgaaaatcaaaccaaaatggattaaagtcttaaatctaagacctcaaactatgaaattactacaagaaaacactggggaaaatctccaggacatttttttgggcaaaactttcatgaggaatacactacaagcacagacaaccaaagcaaaaatgggcaaatggaatcacatcacgttaaaaagcttctgcacagaaaaggaaacaatcaacaaagtgaagagaccacccacagaatgggagaaactatttgcaaaccctctatctaacaaggaattcataacaagaatacataaggagatataacaactttacagaaaataatctaatgatccaatcaaaaaatgggcaaaagacttgaatagacatttctcaaaagaagacatacaaatggcaaacaggcatatgaaaaagtgttcaatatcacagatcatcggagaaatgcctgaatagacatttctcaaaagaagacatacaaatggcaaacaggtatatgaaaaagtgctcaatatcacagatcatcggagaaatgggagaaatgccaatcaaaactacaatgagatatcatctcactccatttaaaatggcttataaccaaaagacaggcaataacaaatgcctgtgaggatgtggagaaaagggaacccttgtacacagttggtgggaatgtaaattagtacaaccactatagagaacagtttggaggttcctcaaaaactaaagattgagctaccataagatctagcaatcccaatactgagtatataccccaaagaaaggaaatcagtatatcaaagagacatctgcactcctatgtttgttgcagcactctttacaataactaagatttgggagccacctaagttttcattaacagattaatgcataaaggaaatgtgttacatatacataatggactactgttcagacataaaaaaatgagattcagtcatttgcaacaacacagatggaactgggcattattatgttaagtgaaatagccatgcacagaaagacaaatatcacatgttctcacttatttgtgggatctgaaaatcaaaacaattgaactcatggacatagagagtagaagaatggttaccagaggctgggaagggtagtggggtggggggtgggaagaccgtgtgcaggggaggtaaggatgattaatgggtactaaaaatagaaagaatgaataagaactactgtttgatatcacaacagggttactatattcaataatagctgcattgtacattttaaaataacttaaaagagtgtaactggattgtttgtagctcaaaggataaatgctaggggggatggataccccattctttgtgatgtgtgtatttcacattgcatatctttacgccataaatatatacacctgctatgtagtccataaataccccataaatatatacctactatatactgacaaaaaaattataaaaacataccttttttgggggaatatttttcgaaatataccccataaatatactccataaatatatatacctactatatacacacaaaaatttgtataaacatacctttttttcttttgggaatattttttgaaagatgtttttttaataaaaaacaaacaagatataaaatacatgaaaatctttgagtattgtctatctttctttgggtaaaagtcttaaggttttggacactactatccttcttaattcatactaaaaatcataatcactcctaaagtgtagtaagtccctcggaaaattattaaatgataagcttaaaagaaaaatttaatgtatatactataaccatttaaaaaggagagtgttttgaggttgtataacctttaaaagtacattttgaatttctatattaattttaaagtgcatcaattttgtcatatgaacgttcgtaataccaaatatatcaataaactgtaaaaattgagaagggagactatgttgaacttaagaaaatttcatttgaaacctattaatttcagaaacaaaccatacatatataacagaaataatttacaattaaaatttttactgaagctctttcaatggacacccttcatctttcccattactctcttgtcacttcataactatgacatggatcaggcacattaaacatagttctacatgaaggagtaaagacaatgacaaaaactgtggaatggtacataggaaggacttcatagaagcagggagtaggcaatgagttttagtgcttttaaaattgaaaaaagaagataatcattactaactgaaggtctttctataaaataaaaataacaaggtagttcacattaaatacattaaattacagttaaagttatttttaactccacagattaatgcactttccctttcacagaactcattttctattaactttagcaaccagacaccagaggttgcagtgtaaggtgtatttttttatggctcaaatataatttaatcattgtattttctcttcactagattgacaaagtgcactatgaattggtggaaatgcgctgtctcatcatgtgatgatcagaagctgtgataaagatatcatttgctccaacatttctagcacacgctgcatagagtctgcaaatgttctgatgaagcatggataatgatttgaatttacacttcagatccacagcatattaggctatggtctcactggaggcatgtgaaatattagccatagagatgtcttaaccaccatttacatttgttttaacataaaatcagctagggtataaaaatgcacaagtctctctaactgtaaataaccacacatcatcataaatattgagtccaggaccaataccttatcactcgtagttacatctttttgcattaattcaagaagatcttgtgacatagtctctcacaatgtgatatgctaaattacattaaaaaaaaacagaaaaaaatagacaaactctgtagaggcttgtagtttcatcactgtgaatcactttcaaattctatattcctatttttatggccaactgttagtagttattcaacaacatacaaaaaaaaaaaaaaaaaagcttggactagtaccattgatttgttcattcaaaaagaatttgtttagtacctcctatatggtagccctatcctagccactgggaataccatggtgagcaatacagtcaacagttccttccctcaaagagcttatacttcagtggagacagatgggcaataaacagaataactaagctatataataagatcaattgtattctgtactatgggggaaaacagagcaataaagagagagaattggaagtggtggaagtgattgtaaatgttaatagggtaagaaaggcctcactgagcaaataaaatataccaagaaaggagacaggaggaaggcaggaaagtaaaaggttgggagaacaaaatgcgcaaagaaagctgagaaacactaatgtgactgctggcctctgtacctaccttaagctttgtgttccctctaccagtcccaggtgacctccccaaatatccctttggtcttatgctctatttcactcaccataaaattaataatttctatttccttctattttaggagacatatgaaaataatatattatacattttcactattgtattagtctgttctcacactcctataaagaaatgcccaagactgggtaatttataaaggaagaggtttaattgactcacagatctgcatggctgggaaggcctcaggaaatttataatcaggcagaaggggaagcaaacatgtccttcttcacatgatggcaggaaggagaagtcccaagcaaagagggaaaagccccttataaaaccatcagatcgtgtgagaactcactcactatcagtggcatgggggttaccacccccattattcaattacctcccaccaggtcccttccacgacccttgaggattacaagaactacaattaaagatgagatttcggtggggacacagccaaaccatgtaaactattgtttaggatatgtgtatacctttttcagaaagttatattttgcattagtgcagtaaatgaaactgcaatatttacacagattcattttgaaatcttaatcaaaaaacagtaacggtttcctttttacagttacataaaaaatgaagaagggacccacccattaaacctaccttgaatgaggaaagagattgagactgaatttcatttctgcctccagtcatgttttataaaagcggtcaaaccagttttccttacaagcagatgtccagttgtatctgtatctgcctgcctcctcaacccatcctccacaagattgagaaaaggaagacagtgtgctcttgatctggatacacatttcaagccaaagttttataaagaggaagttcaattcaatgtagaaatatctgaatgctgtgtactattttattgggtacagaataaaaggggcagcagagtaactttttgacttctcactgcatcttttgttttcctaaagcttctgcttcactacgaatgaagaagactaaaatttctctgaagagaaggaagccatccatgatttttgacaatgttaaaaccctgatattctgcttggtcctaggtattctgctgtatccctgacattctgcttggtagtagggatttgcactgtgcttggtccagaagacaaattccaagctcctacagagtctgatggctttacaaataacctagctatcacaattctaaataagtgtgaaaaccctgttaaagcacataggaaggggacataacttgtttggtggggagggagaaggcaaggctttcttgaggcagtaacatttgaattgaggcctggaaaaagagtaaaaattaaagaaacaaagaagaaatgtactgaaaaagcaacaaagtccaaaagaacgcacatccaagaaaccgaaaagtgcaggatcacaaagagaagtataaaatgtaaagaaggaataagggatagatggggctgcacagataagaaggctaaaatatcacatgtggattaagaaggaccatcctgaaggcaaggtggaggaacggagtactgagaagttttaagcagaaaaataaaatgaccaaatgtgcattttagaaagattactagttcttccagaggtctaaccgagaggtcaccatgatgatgacctgaaccagggtagaagctggaggaaaaataaaatcaaaaggattttatttcctttgtacttgagagttatttaggagatgaaacaagtgaccgatggaatgtagggaggggtttccttcttggttcactgagcacgtgcctcttcttatatctctaaagcaagcaggaatctccactgagtcctgaacaggctcaaaaagtttcaccaagaatgaatgtgcaactatcccaacaagtttcaccaagtataaatgtggttcagactcattcctcaacacatggtgtaccctccttgcagcctcccccaacacacacagctgttttattttagatgctgcaaatcataaatgtgtattacagatctaacaattgtaaaatctccaaataaagttatttctttgagtgactggaacggagaaagggagcggtgctttgtatttggcaggaacttagattagtgtcttttcagaaagcccagtacattttgattagctcaatcatcattcaacaattattctctctctgattttaaaattttcattaaaagcaaatttttaaaaaggcatacccttgtacaggagaactcccttggtattgagcaaattcatccagggatcaagggaaatacaaaatattttcacaccattatcaatgtttatgctgtagcagaggaatcagtctcaaacacaggcaaaatatgcatatatttttaaataccttagatgctatagtaataaaaatattaaaatatatatggcaaatccattaatctactctgagtatgtctattaacatgtttaaaggcataagtggtttatcatatttttatcatatttaagttacaaaaatcttttttattttaagctttttatcatttaaatcatatttttattgtagttaagttacaaaaatctttgactctcctttgaatattttcaaatcaattccataagtgaagacaaaatacacaattgaggaaggggccatgatttgccccaaaattgtcatcaaatgaatgaactcaatgacttctgaatcacacttttaaatcagatgttcccatttgatctgtcaatttctccaggtttgatacataggtgtaaaatcatcacactcttaaggcaatgaactgcaggcttaaataaatagtatatctgaaagagattaaggcaatcgtatctttcagaagaatcatatctttcagaagacatacttggtaatgagttttggactgcaagtatcagttcttagacacagcatgtgacagtttggttgcttggctaaagtttcacagcgaataattcatctctgcatcagctggaccctgacctgcaatctcattagattcattctagcccaatattaaaagtatttcttgctaataatgcaaatgccattatcatccaagtaataactagtgtctggtagtatactgatgaaattttgggtattcttttgcatttttgtccaattttcattatttctcagtgggaaagaaaaaagaaaggaagggaggcaataaggaagaaaatgagaaggaaggaaaaaagaaacggagataaagaaagtaggcaggtgggtgtatcttacaaatttgcatacatacaatagtttgagtaaattggaaatacttaaactttatcctttgtaatgtaaaaacattaaaacaaaaattctccaccatgaaaacagaaaatatatatttgtatctcctcccattatatgcttttatgagagatggttagtgaattttacacttaaatagacacacttctttttgaaacctcagttttacttggtaccaataacactgaaataatcctccactgtatcccagctaatgcttctgcatcccaccaaatacatctgaatgcatggctaaaacagaacacgtgatctggccagccttacacgtgtaatgaaaatctaaattaaagagaatgagacagcagagataaagaggatttggggaaggaataaaagagactaaacatagcactgagaattctcctctttttacaaaaatgacagacttaagagagggcatggaacagattaagagaattaacatggagaggagagcagaggtataaaaggtatccaagaaaagtaaaacatacaaaggcaattcaaatcaaagtgagcactgcctatatacagacagaaagcgagtcctctatgaaaccatacttggcagaaagtactcattattaatagaaagtgaaatcattttgatatctacaccagcagtcattaaataggcccacagactacccctggttttgcaaataaagttctattgtaatacacacatacatacatgtacacacacacacacacatacacacacacacacacggcaaaaaccaagcaaacaaaaatcatgagtgacatttattggcaactaaagttatcattgatttttgctgctattagtggagtgtttgcattgccctaacactggccaatggagaaacaaatgtggatgagccagctgtccctatgatacttaacatcatcaattttgtgtttaacatttgaccatatgaggtatttcacttaaaagtaccttaaggatgaggttctagcattgtgtgataaagtacagctcatgaaatccacataattttctggttgttcgtaatttccttgttcatagactgatgaatcaaagaaaaggactggtaagaattctcaaccatataaccttggtctgtgttttgctgtggtaatcctattagggtaatcataatttaccacccaggaaaggacacatgatagtggaaggtgttaatattaataattaataccagtacaacaagaatacatttggattcctctaagtaaacagatgcatctggtcctggtcaccctagtcaaaatagacctgtgtgtgtgtgtgtgtgtgtgtgtgtgtgtgtgtgtgtgtgtgtgtgtgtgtgtgtttcacattgttctatccctctggcctaccatattcttattcatatatcttgcaatggacccctgttatttgctaggtgggagaggagacattaataatgcagaaatttttttttccgggtatttttcatgtcaaaggacttttacactaacgttatgatatgctgcatttctacaaagttcaatattgtgcttgttttaagaaaaggaattatttgtggttttccactttgcatgccaaaacagcgattttcaatttcaaaactgttgtatgcatcggtaaggatataatttacatctattctcccttcccccttcactttctaaatggagcgacattaaaatataaattcatgcaatattaggtaagtgggaaagtaaggcctttcttttgactattaagcaaagaatacatcttaggaacaccataaatcatgcttgtcaggatattcaaaagaatcattctgtatagttaccattctattatttagaaagcacagacatgaaacaatataattcagctgggctgcatgtatctgatttgcatatggctgtatctttttaatctgtgttttcacaagatgaatataattagcaagatttaatttatctttaaaaccactgaactatgttgattacctgcaggatgacatcacccatatgcactagtagatttggactcctaaacagagcaattcaatgtattttgtagctaaacaaagtgcatactgcaagttaaaaagtgataaactagtcatccatgcaagatgcataattcatcatgaagagatcagaactgttgttttatcctgttttcctatttttttctcctaaagaaaccacaaatgatttgggatagtcaatttacaagtctgtgaccattgattaaaaaaatattaaataaacccttcagtggaactgcatggatatattctctgtacttctcccatctgagcccttcatccacctttccttcatatacgctttcaggttaagaatttttcacataatgaattatctctgacctaacattctcaaaggagcttatttgtgctaggatgtttgactttaaaggaacgataacaagaaatatcatgttaaacttgtcagctataaaataaaaagtataatttctaatacaatgcattatttagtcatatccaactttttaaaaaattgtacaaattcaaatctgtggttctgggatgttagaggctctaattgcacacaatgtaacatgataatcaacataatttcctctaaaacaccagtttgtgtccccatgaattctaactatagcctagagtaaaaacaaagaaaaacattttaataaggacaatgtattaccactgggctgattattttcccagagaaagacaaccatgaaaataaataaaaataaaattgtttgcattagaactggcattattagatatattttactcattatggaaagaaatatctggacatcgaagaggaaaactcaaaccacaaacctcataatgaactgcttctcaactgaagttgccatttagtctgactgacagtattttatttctagggttggctttatgttggtctaatctagattttgtattgaatacacacagacatagcagaatatttcacaactcctcatcaatctagatcaattacttatctaagtgcagatgaagatttgattcgtgatgtgctatttctcagagaattgtctgcttaaccgtagcaaccagaaccacaaatataactggtaacacaacaaaaattgagagttaggtcagctcatagaagaaatatacaaggcagttacgtggataaatctttagacatcaaacacatgcaaaattttcccaggcttcctgaccactctcagttttatatgaaagtgcactttaacttgttgactgatgtcatactgattttcctcaaatatcacttttaacccaccacattccatggaaaacgttttgctggccaaataaaacccaaagccttgaattcaaatctcatcacagtctggcataaactaacattttcagtctactagctcacaattttccacattgaatccttgacaagtgagaattatttcctcattccctggtgaaacatattcctttcctgtctatctttacttaagccttctctcacctggaattttgtcttcccttctatcatcaaacctgtggttctttcatctgatttatctaactctcatagctagaagtaagcccttaaaaacagggatatatctgtatgccccagcatgaaaaacctatttgtgattgattgattggatcccctcctatccaaactcatttttaggttttattgtacacaccctaccttgcctgacttttcccagcaataagtgctggtttgatctgccaggttacccttcaatgctgtttggctttgtgtcctcaatgggccatcttattctatctttagcaaacacaaagaagtcaccttaagaagaaaaacgactagaaaagaaaaacgagagagcatcataccagttccattgccctagaaaagagataaggaagcgagatattaatttttttcataattaattaataaaaatctttattgatcccctacatatctactaggagctgaagatacagcagtgaataaggcagataacccacccaccaagagcttccattcctgtgttggaggttataatggtgatggagagacacatgataaagcatcagatagtatcattattcactgttattcaggaaaagaaagaaagaaatttgaaaggattgccagatgtcaggaaagtgcttactatagagatgatgtttaagcaaagatctaaatatgagagggagccagccagaccagcagctgggtaatcgctggtatctgccataggcaacagcaggtccaacagccatgaggtgagatctcctttgcccacttccagaactgaaaatttacagtggagaaagaacagcatacagataggctggagccagatcctgtgaggctgtgggccacaataagaagttcattgaaatgggccacagtgggaggttctgagcaagagagcaccatgattctttaccttacatgagaaagaagaagaaggaggcggaggaggaggaggagggggggaggaggaaggggaggaggaggagggggaggaggaagagggggaggaggaggagggaagaggaggagaaggagaagaagaagaagaagaggaggaggaagaaagtgaggaagaggaggacaggggaaggggagggggaggaagaagaaggaggaggaggagggggaggaggaggaggaggagggggaggaggaggaggaaataaattttgggagagaaacaagatagggatttaagaggagaaatgtttgcaaatcagagagacggtacctggacctagaacctctgacatttatgaggactgggagacactctgcttgtctcttggtaggctggttgagtgcaccggcttagagagagtgtaaatgacagggagaatatgggtctacctaacactggctctctaacaataaatgacaaagacctaggtaagccagctctgaaaatctgtgatactaaaaatgttttcttcatatgtaacagtatcaagcacaacttaatttaattaattatatgacttctattagcactttataaataccctgttctaggctaagctttgtaaagaattcaggaattcagcacccatatctaatgagtatcagtcctggatacctatttgtactaaaaaccaaaggcttctccttctttgctctgattctaattttctgaccttgtatacactggttacttacagattaataccagtaatatcagttatttcgtattgcataatatttttctgttaaaaaataagaagcatccctttctaccaattcactgtagttcttcattctacatttagtaacaatgagaaactgctcattgaagtaaagcttctcaactatttaaaaacaagagactggacctcagaataagaaaaattgtgtgcagtgaaacaggttgtaatttataccaccacttcaggccatattgtgcattttgccagaaaaataaaaaataccaaacttgatggtgagcatgcaactgactcctgaactcttttgtgataaagtattctttcaagatcctaagatgcaacactaaaacataattgcttgtattaattgtcaatagtagctcataacaactaggaaactaagactttatactggaacaagctctgttttgttgcctttcaatcaatgtcttccctggaagtacaagcctttatttaacctacacgtctggatatctgagaagtttcaccttatgacttgtttcaattataaacatccattacaaccagcaagcttcctgtcttacaactactctccagctgctagatttgtaacctgcaagttattgtttgtgttaatggcatcctagtttttatttttatttctgaaaagctatggaggcaggtagaggcagagatggaagaggtggaacagcatttggtattaaaggccaacatgagcccataattatgtacatcttgatctttgtaaattaagatcaagtatataatgttgaaccctaaatgctttctattctaggatttgttcaggttcattttcctttgttaaatgctctggttggctccatgttatatatttaacacctctttcttcttgtgagtttgatctaagggtttccaaagaagcatgatgcctttgagatgaagaggcatgtcgtcataggttacccccgacagggcccctgttgctgcctgccacaccttctcaccttttcaagaagcttcattctttcctacgggaccttgaacgtcacttcaccggtattcttcaaaaacagaaaatacaggctactaaagaggaggcacactgggcatgccaaattgtggacatccttatcatatcccaacctctgtgtgcatctatcagtgatacttgttacagagacattttaacatcctttcaaaaggtaactacttgtacctacagcttttgtgatacctgaaatcaaatgatattatttgaaagatatgagtcatgtgcttcaaggtaaactgaccttgcctttttgatcttctaaactatcatgtggaaacttgaaatttcacttttcttagtagagaagcttaaaagaccaactctaggataaagctgcaagcgttaaagcttaaagaaccgtgaatgccaccaattgtgtttcttagttgctgtaactgtaagagattgtataggtgaatgatctaattctcccaacaaaatcagtctagatgacttttattaattaaaacaattcttatcctagtatacctcctcagaggaggacaatctttttaagcttcatttagttgagaaacattctcctaaatttgatgtattttataaatgaattttttaatagcatgcgtactgcacaaattctacagcaacacagtgtattgtattttgttttctacattcacacctcccagtacatggtgacatgtatttgagagtggagagaaacttcagaagcatatctgagttcttccaggacaatttccacatctaatgtaccaattctttagaggtcagtcttgtaaaatcatctatttcattttccctgagggatgcagttatttttgttgcattcggcccggaaaaatttcactgcaaattcagtccctgacccatgccaaagaacagaatatagctacccaaaccttaagatgtttctatggtataatacatttcaaatgaggtccctttgtcatgccaccatcataattgacaaaatatacattctctctgctccacacagtatttctttaaattcacagcctttctttcaatatttgaacatttagaattgtgttgtacactgacagcacttaatgtacctgtaaggggaatgaaagagatatttggatgtattttcaaaatttgaagacaatatatttactgccaaatttgctatgtcttagtgctgccactctttactgtcagaggaatattgacattccagtgatgtctcacaaactaaaagggtggattccaaattacaagctatcttgtttaagatactaaatcactgacatcatctaaatctatttttgtgacgataaaaatactttaattataatccattgctctcagaaagttataggacgatatccaaatgagaagccatcagcttgtaaatacataaagttgtgcaagaataagttaaattactggctatctctttaggacaaattgtcaacatgtataattatacagtagtttaactggtgaggggaaggtatgcaacatatattctgccaaaaaaaaaaaaaaagcccataacattctgacaactcatccatatctctcgcctttgctgccatatctggaaatggcagaaatgcttacatttttggttctgctcatatatcagagtatgtgtgacccattaggttggtttctctagcagatttccctaactggaagtgtcatgtaaggagacatccacaaagtgtgtggtattggtgatgtgactgctatcttcctctttctctaacaagttgtattaatgcagcaaaaatcaactggaagggcatactcttgtccagaaaatttagaatgataaaaatatctaacctaaatcaatttggcaaagttgaggtgctacctgcccttgcttcagtcagtaattgaactttcctttggttctgttgacacaataacaagacctaaaagtaacttcttcgaatacatttttaaaaatttcatgtcttatccattcccattttctttatattttgtcttctgccatgtcctgagaaaaatgcctgactttagagagaatccttagatttaccacttgaaacttaaaagatcaagtctgaaaaatggatacaaagacaagtagcctttttgttggcgaacagaagaattagaaataggtagtctaaggtcagactcactttcattttcctcttctttataggcaatcttctgatgcttgcttttcctgaaagaactcaggcccaaattctttagggggattgtcaatcaagagaagcgaggataagatgaaaaataaaggcaaggcgaggctctgtggctcacatctgtaatcccagcactttgggaggctgaggagagagaatcacttgagtccaggagttcaagaccacctgggcaacacagcaagacccccgtctctacgaaaaaataaaacatttagctgggcatagtggcacacacctgtggtctcagctactctggaggctgaggtgggaagatcacctaagcccagaaggtcgaaacagctgtgagccatgattgtaccactgcactccagcctgggcgacagagcgaaaccctgtctcacacacaaaaaaggtaaattgtaagaacaaaatatggtacacattttcattgagagacacatttagaacttggtttttaatttaagaacttttgtaaatacatttaaattgttctattctgtaaactgtcttcagtcataaggtagttagatattcgtttcattgtatctttccaagaagacataccttatgattagaggcgggacggggaagtgggagagcaaggaaagagattagctttgctaactgtctaatctggatttgtgtctctgaataacatttattagctctgggcctttagaaaaacaacagataacgatagaccttgctttagcacatatatccctatgctaagaggtttacattaattttctcatttaatgtgcacaaaaatccaatgagaaaggtactctcatgattaaatccatttgaatagaagaggaaaaataactttgccaatgtcacacagcttctaagtaccatatttatatatttaggtctgtgaacacagtatattgcttgtctgaacaatatgaaactatgtataagtaaaaaaagcatgcgggtattaaataaaacctaggtctacattctttgaccattgtttttactcatgtattttcccatgaaagaacaacatttttgccatacacattttttggaaataattttaaaattccttattttatattacatttagaattaaaagtagtcataataatgggaataataatgagagcatttcacagctctcatcgactcctaacctgagaggttgttaaaagtatatagagtgtctctaaaatatggaaatcatctctttttttaggaaaaaaaaatacttttttttcttttcttttgagacggagtcctactctgtcaccaaggctggagtgcagtggtgcgatcttggctcactacaacctccacctcccaggttcaagcaattcttgtgcctcagcctcccgagtagctgaaattacaggcacatgccatcacgcctggctaattttggtatttttagtagggagggggtttcattatgttggccaggctggtcttgcactcctgacctcaagtgatccacccacctttgcctcccaaagtggtgggattacaggcataagccagtgcgccagccaataatattctcaaaattttaattttgaagaaaataaaaatagatccaagagaaatagatcaagagtaactcacacaaaatctttctaggaaaaataatatctttttttacaaaaaaatcctactgaagaacaaattatccataattttgtatgtattacctaatatttgaggcaattgagcatcagccttcaaaaaggaaccaccccagtttctgagatcatgagttgtgccccatcaatagaacttctattgtgggcataatggaataagacgagagaagcacggtgatcagatgaagggctatagaactaaaaagtgatcaaaatacctgctgcatttgctatcacttaagcactttaattatatatctattatgaaaaattgcattgatttacatattaatattctacatttcagcatgtgccctttatattcacataaaacagaatacactctgtcacacacatttaacctacctgactcagccattaaactaaaatttgagagtgggagaaaaaagaaacagaatgaatacagtactcccattgttctattcaatgccttggattttaaatccttaactgtcactcaattgaactctatttttgtcattttgcctatcagtcatgacggggagtttaacctagggtgagccatcagtttgtctccaaaccattttttaaaatggtcttatgttcctggggtagggacctatgtgcaaattttttatatcagtctgtaatttcactttaatctcaatgactcctgggcaggtagaaaaaaacagcaagccaatttgtgcagtataccaacactatccaatagaactttctgtgatgatggaaatgcttcttgtctgaccagtcccacacaatagtcattcgccacatgtgactagtgagcacttaaaatgtggcaggtgcaactatctggtttttaattttaattaatttaaatttaaatagtcacatgaagccacagtgatgtcttggtatagtttatgtacttgcagctacattatttaataacaagcacagccctgtaccaggccccaaatttctaggtgactgtgaaagacaaaatgctggaatagtaactgtctttctctataggcttgtgtgtgaattaccagtcttagttaatgtgtttctgggtttgtttcaggaatactgctgagaacatttcaacatctgttaaattacaccaatgactacaagtcagggtatctaattcctaataggaatccttactaccatttggacaccttttgattcttctcatttgaaactcttgcattggccacagctgctgttctaaattgcctccacattcaacatttttgtcctactcttcaccttcaagctcagaaaatacactaatgcctcatccacaaaggagcccaagttcatatgatactagttctgtgaatgcatacatcactgccaccatgcctcaacctctctctactcttccatattatactcttcttgtcaacaaagatgcccatgctttttaaaatctcatcctcatacccgtgacatcttattaacccctttctacctgatctgatctcttcttcaaacattatctctgtcttctttttgtatgtccaatctttgtctacccactggcttctccacttaacataagccagcaatttttcccagttccctccactaatcacacttaacactatcataattaccatggcttacctattcgtttcccttgacatcctaggtttttcctaaatgacttctttgaccagtgacctgacaatcacctaatccaagatactttaaaaactcccttggttctttctgtagctctttaattgctcattcttatttggtatgctccatcattccattgcctgagattgggcatttttcaagataagagaaaatcaattttcagcctacaggttaagcctgctgaatttttgtatggcacaaaggctaagaacagatttgtttttgtttatttttatttttatttttttaaatttaaaagtatttcacattaaaaaaccaaaagaatattaacatttgacatcatgtaaaagtattataaaatgaaaacataattgtccaggaagtgttattataacacagccatagtactcttttacctattgtccacggctgctttcacactacaatcacagagttgaatagctgcaacagaggctgtatgatctgcaaagcttaaaatatgtattatccagtcctttacacaaaaagtttgttgacttttgcacaagatggttctcaacttttttttttctttttaaaccttctccctcacttatcattgctgttcccagcactttcatatagtaaggcaagaactaacaattgttgaatcctataagaagtcaggcactatgccaggtgcttcacaagcatcactgtatgtaatcctcaccactaaataaggcaggcaatgctactgtacagatataaaatcaggttaaataacttaaataacttgccaaaagtattgctcgatgttagctagcaatttgcggagaagacttcctagttcatttcagggagtgaatacctatgctccacacccaggctcattttctaatccctggagctccacatcattcactgcattccaacccggtcacttcctcccctagaagggcttcttttcctttgaatttccctcgccattagtttaggtcagaaaataactacctcttacctggattaggacctgttattctttaatgcctttattctcttctgccttccatttaccctgcattttcttatcaactaatccctccaaagaaatactgtctaacccatctcacgcacgtatttacatctctgcaaggatcttgtaaaatgcttctcaatttgtgatcttgccactcctctagttaaaagccctccacagatgctagttgcctaaagaataacttctatacttctttcctgttacttaagtatatttataatctggtacaccctacaacaaataaagccagtctggattgctcattgttcctcttctttctgccacttggaattcctgtcccttcatttacatctgattacttgagacaggagagtttttatccttctctccctgaaccactttcctttcatgtcatttttttctaactgcctggcaggagaattttcagtatgcatatctaatctccataactctactgtaatctcctcaaaggcatgtactcatcttattctctttgtacaaaattcctgatagcatccaatacaattcaaggtagatttttttagttgttaaccaacagctatactctcattttcctttttgccagcagaggctccatttttgtttatacagtgaaggcttcccatccccgatttccgattccccatctccagtggcttggtcataatggacctaaaccagttaaggcaaataaatggctcattgacatggaaatgagtccctcagagaaagaatttcctccttaataaaaaatgatacatagaaggaaacacccttcattgccagaaacaagcttcaactatcttaaaacagtgaggaaaagcatagttatcacactcaagctattctatggaaagatgtaaagctccttggtatttgatgacttgttttagccactgagttagtcaatcccactgcagtcttatttctagacttctcattaagaagtaatagaaattcattactgttgaagctacatttaattgtgtccattattatttgcagagtcttctgattcacatgtcaataaacatttcttgaaatttaaatatatgagtgcatgtttaaaaatacacaaacttatattgcatgtatgttctgtactcagctatgccatgtgttattattatttttcattattacataaaatactatttggtactgtttttggaagatcttcagtggaagaaacgtttcttctatatattttctcagtataaaacacattacagttgtctaacattgataggtagctagcaggaggtaataatttttttttttttttctgatttcttcccagggagttatgggcagcgaaaacgtagtagaagtatgtatcactcagattattcaaaaatgaaagagaaacataaaagagagaaaggaaagaagaagggagtgagaaagggaaggatggaaggagttggggagggagggaaggtggaagggagggaaggaggggaggagaaagggagaggggaaaggaaagaaaggaatattttgtatgcaaatgataaataggttgcagaggtcagtagcctgatactgagacaacttcagaaataaaagcagatggtagagcttttgctttttttctctcttggccacaaaactcctgctaattgaagtagcaactgaacaagctgctctttcactcccctgacaatatttatgtttcacttaggttctgactttcacattaaacactgccacacctcctgcttactccttgcttccggtatctaagccatttttttttttttttttttttttttttttttgagacggagtcttgctctgttgcccaggctggagtgcaatggctggcgcatctccgctcactgcaagctccgcctcccgggttcgcgccactctccttcctcagcctcccaagtagctgggactagaggcgcccgccaccatgcccggctaattttttgtattttttgttgttgttgttgcttttttttggtagagacagggtttcaccgtgttggccaggatggtctcgatctcctgacctcgtgatccgcctacctcggcctcccacagtgctgggattacaggcgtgagccacctcgcccggccatcttttgctttttctatgggtggattcctctcttcacatgacttcatcttgaagagaaacaaatgaataaactaccactacctctcaaagtatctcccaagactgaataaggtttcctgaaagaaggacaatgagctactgtgagtaagtgacatatcctgaatgagaaatggcagtttcctacaagctggacgccagacttgaaagaaacagcacgaaatgggaaggtcatctttaagagtctattcttatctgtgaaatatatttacagccaataaaaacaattttttaaaaaaaatttctttgttcactttttgaatcttgaaaccatggaatggaattaatgttaccagcagtaattttattgtctatcttggactgcactcttcagaactttctcactgctgctctcataagactattttttttttccctcctgcagatcagactttatttccagaaatggaaacaacatgaaaactgctgagaaatttgccaacccagcttgcccacatatttatatctgtgtcaggatacagtattgtatttaccaagattaaattatctgctgtcaaaactcaatgaaaatcatggtatacaccaaattgcactttagaaatataagcacctattttttttcaaaatgcaaataacatattgaactatgtatatttacggggttatactgtacaaaatagaaacaatataaaatacaatatataaaagcattttagagacagaaaaaagtacacggttgctaagtttagcagagagagttggatgctgaataactaagaagattctgcagaaatgggttcaagttccacatctgccactcaccatctgtgttcttatacaatcatttaagtagtcacctgcaaatcggggataattcctgccctccctgcttcatttataatgaataaatgtaaacatgtatgtgaatacattatgcaaactataaaatatatataattaaatgcaagaaactttgaaagatgacatatttgaattcccgaagtacttcaatttctgctccaaaactcaattcttctttctagaatcataagattttaaaaatgtaaagaaacttaaacattatgtagtctgcatagtattccatggtatatatgtaccacattttctttatctagtctacccttgatgggcatttaggtttattccacatctttgctattgtgaatagtgctgtgatgaatatacacaggcatgcgtctttatggtagaacaatttagattcccttgagtatatacccaataatgggattgctgggttgaatgataattctgctttgagttatttgaaaaatcaccagactgttctcactatcaagtgggagctaaacattgagaacacatggacacaaagaagggaacgacagacactggggccttcttgagggtggagggaaggaggagggtgagaattgaaaaactacctgttggttactatgcttattacctaggtggtaaaataatctgtacaccaaaaccccgtgacacacaatttacctatataggtaacctccacatgtacccctaaactaaaataaaagttataaaaatagaaaatatcatgtagtcaaactcctttattttacatataactaacataagcccagaaatttttaatcacttatccaagtttaaaaaagaaaaatctaaagaaaaagaaaattttgaaaaagaagtctagattacaatttaatctattgttcttcctggtaaccagctcccctactatttaatatagaagtgtttaacacaaggctgggcatggtagctcacgcctgtaatcccagcactttgagaggccgaggcaggcagatcaccagaggtcgggagttcgacaccagcctgaccaacatggaaaaaccgcgtctctactaaaaatacaaaattagccaggcgtggtggcacatgcctgtaatcccagctacttgggaagctgaggcagaagaatccctttgaacccatgggcagaggctgtggtgggccgagatagtgctattgcactccagcctgggcaacaagagtgaaactccgtctcaaggaaaaaaaaaaaaaatacaaagaagtgtttaacacaatttactgctttaaaaatgattttacattgatatgaaatgttttagttgtaagacatattttctaactaaaatcccattttatttttactaatcccagataggtttcagggcagatattactttcttttgaaagtgtgacttttcagaacaaggagatgagtagcagaaccagtcatggaatcaacattttgtacttcacctggtatattcttccatctttcagcaatgctcatcatattttggctagaagggattctgtttcttttaatagtgctgaatagcatatatttcaaaatgtaggacaaagtaaaattaattttgctgagggagtcttgcaataccctttgtgatgtctggagatactcaatggtatctcaaaactaggataaagaatgcttatactagattattccatctcccaaagtaatttgtctcctaataataatcataattaccttctacagtatccaaactgtagcctctttactaggcaaattatttactgcaggtaggaaacctctggtaaaaactgcttgacaatatgctgctagaaacagtctttcattttccaaatccattctgggaaaccacacaagcacacctactttcaagctcatacgtgaatataaaaggctattttatttttacaaaatgacttattacaggaaaacctagttaagtgaagtattccttgctaaagacataagtaagcagtataaatacacactagacctgctcaaatcaatatttaagcattcaacatatccacaaaatcccaagtaaaacttttgtgcccatttgtcctcttggcaccaagatttttctactctctacctacctctactgccaataaccttataggagcctttcccccatgttctcaatcagggaaggatctcgtgtcatttatatcttccaaataaatgttctaacgcaagtcccagtgttattttcacctaaagccgtatctgtttttgttagtcaagaaaagattttgctttctgtgaaaataatttcagtgtcagtgaataaattgtagcagtattacatgcttctgtgttcagtgtgtttgttgatatcatgtgttgagggggtgaggctgtggggagaagagaaggaaggaaaaggtggaggcaaactcttgtctctgatcttgaaattatgctagtcagttcctactaactacttcatgatacagggagttctggatgcatttgtgtgtgtgtgtgtgtgtgtgaaaagacaaaaagggaagattttctaaattactgacattttggttactaatacaacgctggtcaccaagaatccatggataatgtctgggtgaaatgctttgcatcctctgagccagaaactgctcaaacctattaaaattcatttgtgaatgtccattctataacaatcatcaaaacacaatttcttccaattaaacagcagaaaaatcttcctggggactgatagtgcaacaaggaaagaggatcctacaacctcagttatcacttcacagcagactcactgtggcatgttctaagttctacagccagaaacaccaaaaataaatttcctgttcttccacctggggctctattttcctactgccccaaaacctgacttctagtagaatcaaaaaaattttcccaggtcatggccaggagttaactgagtatagcacagccttctcctttctgacttccagtaggatcaaaaactcttctccaggcatggttagaagttaactgagtgtacaagaaccctgagtttttgtgtttcaatttgcctgatttgcatgtggatatacagccccagatggagaaaactaggagtgggatttatcttacatgattcactgtagacagccaaagcaaaatgtcaaccagtgaatctttgcttctagcctgtccaggaataggccctgggaaaaccttctgactgcactggaactggggggagtggacttgttctgagctgactcaaaaatgctaacagaaaatggcaggctactgcttaagcacagatgtcactttattgtgtcaacttggaaatgatcagtacaatctggcaagtgcaatttttctcacattatgagtgtgtttgagcaggtgctatgcttcactgaggtcatatattgtttccatgttttttaatttttgattcaaattataggatgaaaaagattctcaaatatagacctgtcctaagttttactggagaataaaaacgactaataaatgttttattaataatcagaaaagggtctaatgcttctccccaggggcatatttggtatatatgctttaaacttctactaaatgttgaagaaggaaaaataacagtaaggaaaaatatagaaaatattctccaaaatagatcttctggtggcttctcctatgaccacgatgcattctgttgtcattcacatattgtcttgtttggcaaaagacttgctatttctatagtcactatggaaagttgccacagctactcaaagtaagctgtcattggagggatatgcctttacataaaatagtacctcacagtcggcaggggccactgtgggttctaatggctagctttaaaaagccaaaattgtgtctgtaggatcggtggctctcttgtcctgccaaaagattgagatcagacatggtgactacaatacctccagcactaagagttgcagcttggaaacaagcaatgcaatgcagttgtagctaggttgctgggtagtatgtttagtagatgttttgtctttgaatctttctggttgcccctgaaaagttgtcacatacagtaagcataaggtagacaacagtgcactaagttttagaacatagagaaacataataaatagtcattgctttaagaaaacccttaaggaaaactacagtcaacaaaactgaatatacaaatatctgaacacaaaagtgaacattaaagacagtgttatacatgcagtagcagttctgacagacgcagagagcctgatatacaaagcaattggaaaaacagattcctagaaagttctaaaaaaggccgggcgcggtggctcacgcctgtaatcccagcaccctgggaggccgaggcgggtggatcacgaggtcaggagattgagaccatcctggctaacacggtgaaaacccatctctactaaaaaaaaaataaaaatacaaaaaattagtcgggcgtggtggcgggtacctgtagtcccagctactcgggaggctgaggcaggagaatggcgtgaacctgggaggcagagcttgcagtgaaccgaaattgtgccactgcactccagcctgggcaacagagtgagactctgtctcaaaaaaaaaaaaaagaaaagaaagattactgaaaggtcattatgtgctaggccttttccataatagatttatcttcatgttacagattaaaagaattactcaaaatatgcagactaaaaatctacattaggcactttataaaaggtatcagagctagtaaattagcagagcatggatttcaatctccacccaaagagtccaaagcccacactggatcatttatgactagaggaaaaagggaaagatttacggacacttcaactcatcctcaagagttgtcaggatttgttccgttggaagcaaggatagcaggatattccagtgaggatttcaatatgagcaatgacagcaaggcagggactagtatggcatacactgggcatgaggagataggctgattagaaagggggaaggaaaaaggagtaaagagagagtctggttccagatgacatagggtccagaatctccaaagagattcttagagctggacttaagtttggagatgggatgccgagagtatgtacaaccacttaatgtttcaaacctgacggatctagtttctgaaaccaaatctgactatagtctttattattattattattattatttagaagataaaatactataccaaactgattgtatctctgcccttatgaagtcaagatgaataataaataaatactaaaatagatggtttgatagatgtcaagtttaaatgagaaaataaggcaggaaaggaggacaaggaggataagataggaggtgtataattttatataaggtggcaagaaaaggtctcattgaagtagtaatgtttgaacaaagaactcctccttcctcagtttttttgttgcattgctgcctctctttcccccagtgtggtttaggattatcacaaacaataatcttatatttcctctaagagttattttttcctttgtgctcatatttttgatttatgaaaaggtgcacataactttcaagctatcatgatctttatgtttaagttcataccctgattttctatctgatcaaatgaaaattttcatttgtttttgatataagaagtttaaagtccatccattgtgacacaggtgaaatatgaatctttaatagatttatgtgattccacttcactctgagtcttcatcatagatactctctgtagctttttcgattaaagaaaagccagacacattaacacagattttaagcaattgaaatacagagaagattatcaaatttctagaacttctgattgttctgtatttgatgccttttcttctacagaatttttgaatttggtttttcatcagaacaccattgaagatatcacttaaggaatctagggaatttaagaaatgttaatccccgtgattcaaagtagatattttatcttaaatgtagccacttgtcttaggggtccccaaattataaattggctatataattacctatttcatggtaaatggattattagttcttttttacttctctgatttcacttcttcttcctctttttaaaattaatttatttaaaaagaaggatctgggtgtgaataagtagagatatatttcttgtatgtcttaaaatttaaaaaaattatacaactttccattgacacggaacatttaacaaggtttactttagtatgatattaaaattcaccctataattttaattgggataaatggcatttgttctttccagcagtaggtgggaaagttagaaaacagtatgtgtttcccaagagtctaataggaaaagaatggggttgtgcattttgtccaagactcctactccatagaaacaacaaatcgtctgtataacttgttctgggctttttattttgaaaatcaattattttaagtgtagtcataaatggaaggaacagggaagatgctgccatatagacataaaacagcttgatattattttggtcttaaaaatatcgaaaaaataaaaattttattgaaaatttctgaaaacttatgtaaaaaatggtcatccatcagcatctgatttggtggtttcctgcccataaggcagatacacctactattcaattctgtattgtcaaaaatcttggaaagaatcatgggatgatatgataaaccatcagctctttccaagcactgttatatgtttacagagttggatcagcatccactggtagttccttccagtgaagtctctctagtcagccttcagtacactgtcttaacatatgtccatcactgtggctatactgcatactttctatagtgaacataattgttatgaacaagtacccaagaatgagacttcatgggctcaaatctcagctctgctacttaatagctctatgatcctgggcaagtttcttgacctttgtgtgccttggatttatcatctgttaggataatactagtgcctgtaaaatattagcaccatgcctagcacatagtggtcctacatgttgcctatcattattatttctaaggtctatatatatgaaatattacaaaatccatactttaaacacttgaaataaaagaagaattagatgccacacatatccttaaatttcctttgttgtaactttttaattaagtgcacacctatacacctattgctgaagtttcaagttattcagattatccaaccagataaactgaggcaccattttctaaaaagggagaagatgaaggagggagaaatgtggagagtgaggagggaagtaccaggacttcaatttagaacacataaaggttgagatacctgtgagatatacaactgaaaatgttaagtacaattttgcatgcaaaaatctgaatatgacatgtctgggctaatgacagaaatatcagagttactggcataatgatagtatttaagggcatgagaatggatgagattagttggacgagggatattaagtgaggagacttctggaatcatgtcctgtgaaacatcaacatttaggagacaggtagagcagcagagttggtggacaccttggaagaagtcacagaggaaggaggacaaccatgtgtgtttagtgccttgttttgaaattgattaagtattgagtaggatgattagataatgagtaggatgatatctgaaaaatatttaatgaatttgacaatgtgaagatgattggtgttctttgcaataggagttttggctacatgctttcacgggagccagattggagtgggttgaatagtgaacgtgggtgactaattgacattaggttttattcataattgaaaactttcacagagcttggctgtgaaggaaaaccaagaaaaagcgcatgaggtagatgtttaaggttaggtcaagagaagcaatgtttggtttatttgtttgtaagattagtacaatccattaaataatattgacaattcaagggggggagagaaataacagaaagactaagtacttgaatagataagcaggataagacagtaagcacagttccaaaatacagtatatgaagaagaaagtggagatggtgtgaatataggagaattttcttcttattgcttttagctttgtcttcaagtacggccttggccttcagtcgtatagaaagtgtgaggccagaaatgggtcatttgtgagtttgtatgaggacagctagcagctcatgttcttattatctgtttgttagtctgaggggtggagcactggtaactaagtgatgtcatgttaccgagtagaaagggaacttcactgagaattagaattccagggtcctagtttgcaatgtgcctctaaatcagtatgtgatctgggcctaagcatttgaaaatctctgaacctcagcttttattttatagaaggagaggcttggggatcctttagaatgaccagtgaatgatccatgccactgtttggttcattacagaacttaaagaaggtcttcaaactgcagctattcacagtcaaaatagttccatatatacaatacttatttgtgttcatggactaaacatgtaaaaccttccagactttcaatatacactttataaaatctgtcctctgttgtctgtggggatttttttctgtcttatagattgccatttggaaatttaaaaataacttaaatatttgactgtttaattacaaaaatgtacctggggcataaaaggaagaattaaacataaaatttgatttgaattcttggtattatagatggactgcttttgaggagaaaactactgctaaccacaacctgttcatcaaggatttttcacttcctccttcactgcttttgtgactttaagtgtgctttataaatttccgtccaatgacagcacaatcaaggcatgcaatgattctttcattcttctctgataaaaatctttagtcttagatagctaaaagtgtagtcaaagacatttaattttagccttggggtatccattctctgtcacaggaaaaaataaatatacataaaagtaataagatttcatagaaaacagtgtgggacagagctgcctgactttaattttctgaaatgcaaggggatgcaattaactccctggttgtgattagcctcttggaagctgaataacctcagtaaattacagcacccacagaacccataatggcgtcatatactcaatattgtttacttgtctttggatttacagtcctgcagatgagtcataggatttatgcattaataatgaatcaagccaacttcaagaagcagcgctgcctctactcgaattacgtgtctgcctatcggacctttttaaagtaggtattggccaggactagtttgaggcactggctcaggggcaatatttaagaggacaccaaaaagtcagtgagtaagataaataacattttaaatcaataccttaaaaatcaaaattaatattttaaaaataaaaagttgttcatgatgaataacatatcaaaattttaaataaagacaagatcaataacagtggtatcctgagctgtactggagcctgaggcaaaagggaaattcaataatattgatgctgtctttatttaaatttttcacattttgttcatcatatatttttgcattattcagattgtttttttcaaatattgcagtaaaatataatttatcttgattactgagctttttggttcccccttaaatttaacactcaggcaagtgcctgaccctcatctcagcatttataatttaacaccaaaataactggcatgcaggaagcactgtgcccgtaacttgttcctgctgccataataaaagcagactttgcctctggaagcattccacattttaccccactaagttcttttccttttagtttccataaaagggtttattcatgtgctgtcctaaaagagtcctgctggatggcccgcaataccccacataaccaaaacaaccactgcatcaggagagataaagagtatcaggaaggaaaataaattccatatattttgctcaaaatcctggaacagttgtaaggaaggcagtcgcaaagaagtaaagtttttcaactagaggaagtacgtgaatctctcagtgcatatacctaacaaatgtagatagtcaatagcttttatccacataactcttggatcacaaagggaatgaatcattgcagtcaaagaaaaacaatttacaaggaggctgtgtccaatctcaaaaggcaactaaatgaaattctgagctctgaaaaatctgagatccgcctttattatcctcccaatttgtgaaccactcacctcagcaagactacaaactccatgaggggaagaacaaggacttcttgtttgcttatctttgtatccttagtgtattaggatacatgggaatttcacttatccctatactctgcacgaggaaataattgccacaatgtaggtggatgggtataattgtcaaccttaagcaatgacatatgaaaggactttcacagcaaatgagcaaacggtatgacagaaaaatagggtatgttagggcaaggacacctgtggcaatatttctacctagggattggaaagaggagattttctcaggagaaggcccctcaggactagggacatcccctactctttgtccattcctcctctccattgcttttctaaaagataggtcctgaaacatggtattgacattctcaatttctttatctttttaaatagacattaaaaaattcataaactgcaaggcctggtttaagttatccctcactcataaagcctaagatatttatactgtattgtatcatattattcttgattatacaccaactcatattgctcactaaagcacataaggtaactttgtgtgaactggaaaaaaaagaaaaaaaaaagaaaggtgtgccttcatcaagacacatagttgcagaaaaccgtatcaaaataatggtgcaactagttgaggtggatggtgccttttacatttttgtaatatataaattgtacaatcctatgcaatgacccttggtcactatgtctggcttttattttatatctacatagtaaagttaactccttacttccttccctccttcccccagtcccttcctccctccctcttttcactccttccttcctttcctatctccccctgcttgccccttccttccttccctccttcctttcctccttccttccttccatcctttcccctgttcctccctcccttcctgcctcccttccttccctccctccttccccgtcttcctccctccctcccttccttccttccctcccttccttccctccttctttccttccttccttctttcctccttccttccttcctccctccctccctctttttctttgttccttccttcctttactcttctttgttctcaatacttaacataatcctaaacccatagcaaatactgagtaatactttttggctgttgaattgaaatcctcctttaaaaggggagacacctaactgtgaaatcataggtgattttattttgtcttctacttgttctatattttaattgttatacaaatatgcattatttttataattagacaaaaatgatttaaacctgccaacaaatttagatgttaagtacttattcaatggccaagcccaagtaattgtgccttgtctgatttgagggaaagtgccctgcatatttacaaaaatgtattataataccatgcaattcaggtaatgcaatcctttatcttcttgttaaataaaattatctctttaccatattgctacattttagatctctctaataatgactgcaactgtcatgtagtgagtagaatggaaaatccctcaaatatcagattgcattctgatactttgaccccaaactaatcaaactaaatataaattttgacattttttctggcccttccacagatttaaaaagcaatgctgtctgggcatggtggctcatgcctgtaatctcagcactttgggaggccaaggtgggcagatcactggaggtcagaatttcgagatcagcctggccaacatggtgaaaccccatctgtactattaataaaaatacataaattagccaggtgtggtggcacacacctgtaattccagctacttgggaggctgaggcacaagaactgcttgaacctgggaggcagaggttgcagtgagctcagattgtgacactgctctccagcctgggtgacagagtgagactctgtctcaaaaaaaaaaaaaaaaaaaaaaaaaaggaattctgtcccagaaaaggtcgatctgaaatcaaattcatatatatatacatatatatatatttcaaaagatagctctgtttacatccaggattttctttgtttttatttttagaaataatcagaaatctcacttggtttctattaaaaatgcatttagctaatattcacctgtgtgagtgctgggagattcctagatttttaaaaatcacatagtaagcaggggaacgttatatatatatatatatatatatatatatatatatatatatacctaattccctaaatgtactatctatcctgcttatggcttcttcagttgaaataaaaatctcaccacaaatgaaatagagaacttcactaatttccattcaccaatgatggcagaagccccccatgggttattaagtctgagagatgtgtgaacaaacatgataataagcaagtaaagtgtatcgtaaaatatactgtgttcatttattgtgacaactggggtgtaattatactaggaaatgtactgcactttagtcagtgaaagtaataaaatttgaacaccaggagacctttctctactccgtgctattaagctacttttgaggggaaggtgaaaaatctaaaaatatagaatgaatgttcacttttatagattagcaaagcaggggttagtcagattctctggtcgtctaataaataaaaactctgttctttcctcattagctgtggatacaccaccaaagaacattttcctcaatttctgggtaattataatgcctaactttatgtggattgcttatgctattcatctcactttctccctccaattaaagaatagaacggcaaaaccaaacctgactccattgtattgtaactgcttctacaaagctacaagtagaaaagcaggaaaaaaacgtgcaaaaagataaggaaacaaaggggccctcggagatgataatgttgcacaatgaggagtaggtgtaatgattaaagcattagtggtggtcactaggaaacgtgaaaggaacatgtaatttcagattaggaaaccctgagcttcccagagtgaactgctatttgggaaagtgtagttaattgaattttatgacactttttactaaactaaaatgcatatcttttattaccctaatagtttcattgctactgtgatacttatgtgcagtgatacactaaaaagcatatgcaacaattcactaaagagcaccggagtggattattaccgtttccttttgtgctttggcagccgacaatccagatcataattacaggattggagccacctgccgactcactgaacagaagcacgtggctccacataaaatagagcaattctaacactaaaatatacaaaataaaataaaataaataaataaaagaaagaactatgttaaaccaaagagaccttcaggaacagcctatggaaagctggatatttattttttcatgaacgccaaatgactgactctcacattattactggcccagaacgaagcagagtttgccaagatcttcctggttaaactagatcatctaatgaaatatctgcatcccaaattgactggtgaattcagaccttttatggtcaaattcacaataaatctttgattttagagcatattatttctaatgcatagacgcaggaatgcaggaattgtcttcacttgtataaaactgttgccttggcatgcatttagcctgctaaaccagtggagattaccaaaaagtaaaagtaatgtaaaaatggtgaagtcaagaaagtgaatccatacagaatttttctaattggatattctcatttactaaacaagttaatccaaaagacgacattatttctttctgaatttttccaaatatcactttctaagagaagtcttccctcatttccttaagtcgacttagtcactccttcctctgccctttttacatgcttctattagagcagtgcttcttacacttccatgtgcatatgaatcatctgggatcttgttaaaagcatattcagagtcagtaggtgtgtgggggagggaaggtctgtgagtttgcatctttagtaagcttgcaggtgctgctgatgctcctggtcctctgaccacattaaatttcaacttttattttaaatatgggagtgcatgtgcaggtttgttacatgggtatatgtcactacattttgaaaagcaaggtattaaattacttcataaattgtcccataatgatctgtacatgtcaggcatttcctcttgtgtatgagctccttgaaagcaaaggcaaaggcagtatctcaatagctaccaattatataattcctactagttttggggtacagggaggatgttaccatacatcatctttaattctcaaatcaaccctgcaagatctgtaattgtgtttccattttacagatgaagaagctgactctcagatatgttaatcaacttgtctatggccacacagatgccatgtggcagtcagaatgcaattctggatctatttgtctccaaagtctgttttttctactgcacctgaagcctcatctgtttacttctgtaaatatagagtgtagcaaagtacctattgttatagaaggtgctcaagggatgtgtcttgctctgtgatcactttatatataaattcacctttgctcacagtatctcccttgtgtgaaatgctcttcctgcttctgtcttcccaattaaggtccatctcacttccaacgctcatttctacttagccagcacacaattgtgcctttcctctcttctgaatgcacacggcaatggtttgcagcacacaatgagcacttaaattgttagttatcttattaacagtatatttacttcattccataaatatatactgagtatatattaaacaccaggcatggttggaagcacttgtgataggtcatggagcaaaacagaaaaaaaaaaaaaatcccttctatcctgggtcttggaaataatttccccaactaaaatgaagacttctttgaggcagggacccaatcactccactttctgtatttctcattatgttttgcacatagtaactgctcaattaataatagtctcagtaaggtaatttaccatgtagatatgttcctaatatacagagtggaactacacacaaggcctttctcttttctcataagttatccttggaaagtgaaacgatgctttcacgctgtttctcactttcctccaactgcgttttaggccagaagcagaggtattaaagtcacacacagtgcaggtatcagccagagagacagaattcactaaaatttaatcatagcagcttttagcacaaaaaatatcttttcacaagtgtagaaattataggcaggagagataacctcatgaaaagttactttcactagcaaatatcttttttcctttacactccgaaacaattgactagaaacctgctaactaggagaagtcacatgcttaaaatttcacaatattttgttgtcgtttgagtcaaggtctccctctgttgagtgcagtggcatcatcactcactgcaacctccgcctctcggattcaagggatccttctacttcagcctcctaggtagctgggactacaggtgcatgccaccacacccagctaatatttttgcattttttgtagagacagggctttgccatgttgaccaggctggtctggaactcccaggctcaagcgatctgcccagtttggcctcctaaagtgctggtattacaggcgtgagtcaccacgcctggcctacttcacaatattttgttcaacaacattttgaatgtgcactatctgaaataaaaagtataaatgttttcctggttatttgaaatgctccattttctacttcacaaaaccatcatttttaaagtctgctcattcactgaacgaggtatacaaagctattctttttgaaggtatagctcttctaaagcttcattaggttgttagtcacatgtattaacatgtacaggaggcagacctgcagatgagcaatttagaagggaaaatagtactcaccttgctctgcatcggttcttcctcatttttgcaatttcttatgttaaataaatctacatatattaatctaccttgtatacattttaaaacatttgaaagagaagaatgcagataactcttctcaacttagctattttattcaatactgagatatttcataacacgatctgtggatggcagaaaatggaatttgaaatgagttctaattcttattaacatgagaacacaggcatacatcttaagtacagtttttgtaaaattgatgtcacaatttttattatgcaagaatgttatgagaagaaatatatttaacatatcaaatcctagtttattgctgatgtttagttagtagtagtattcctgcctatattaacacttacacatacacaattatattactgttttttaattatgaaaaagcatttatttacataccagtaataattacaccagcatttagctaagcaagtacacaggcatgatctctgcattcgcaaaatatttcaacttaaagttgatgtaagtagatatctgaaagaagttataaataaatagctacataaacatgaaagaaaaagaataggtgaagtctttgccctgtgtctcaggattaattcaaagtttccttgctgaaaagaggaagacatcccattaatcagatttctttttccaagttcttcctttttataggaattggcaggaaaggtctttggctaaaatacagcttaagattcgtgtactgtggctgagctgtaggctgcatcctagaagagccttaaacataagtaaaaataggtctgagggttgaggaaaaagaagagaaagaatatagtgacaatgaatcacggactcttagctctacagaccttaaagacaaggcaaaccaaatccctcattttataatgaggaaactggggcccacacagctgaagtgacttgctcaaggccacatactgggattacagccgaagaatctttgcatgtaaatcctatgtgatttaaaaagaaataaatatgaagatcttactagatatgggctgctaaccagatgggaaactgtgtttggaattgctggtaaactggaatcaatttgtttagcaagtggtaagaatatacaaacatggggaatgttttaggcaacgaaaaagaatgtcatgtgaagaatatgtacctaatataaatggcaattttgacagtggttctgttgattcaagttttttgtgggtttaaatctctttacagacaaggatgaaactttaattctcaatctatataaattatcaggctattatttcaaagaacacaaaagaatagtaatagagaaatgtacacttggatttggtcattctcctcacactggagggaaaattttgccttgaatagcatgaataatgagaacaggaacttttcaaacattttcaatattgccagccaatgggagaggctgataatcaaaatgaaattttgtattcttttcaaatcaccatatattaaatatccaagatagtattaaaaccctctcataaatgttgccatgatgttctatttacaaaatttctttgggaacaactttcattctattaaagtctttcattatctggaaagcaaagaactaaagaaaggactttaaagataatctaatagtctaatagtccttcaatgtaagggtatattagaatcatatggaggctcctaaaacatagatttcagagcactacctcccagagttcccggttcaggaggtctggggtgagatctaagaatatgtatttctgacagattcacaggcaatgttgacaatgctgatccaggtaccaccgtttgggaatgactaatctagtcaaactatctattattagtctaattaccttctttttgattcaggtagacaaattctagtattcttggaacttattatttaaactttttttctcaactcctccaacaaccaatttgttctgtttctgatgttgtcactatactcatcacctattaagctgatttcaggtatattctactaaaatattgaaccaaaacaatcacgcaaactaagtctcttgttcttggtacggttgcatatataaatgctatcttttgcataattaatacggaaagaaaaatcaccaagaacattttcaattccaactataccacatcaaatggacatttgggtctcctgtggcttctgcaaagggaacacatagagaattcttcagggacactggaggactaaagcagagcacagaagtgatatgctactactgtaagagaaatgggattattatctccagagagcttatgttattgctggaaaaatacttcaagagtgtcaaatcttaaagcttacataaaaaagatcaaataagtattgtagcatttcacaatgatctgatgattcccgtagtatcagctaatcagtgggaaaaaagtaaagtgaccaaaaaatagttatcttgaaatgacaaaatatcctagcagttgtcaaaattaatatgataatatacaggccaggtgaggtggctcacgcctgtaatcccagcactttgaggccgaggtgggcagatcacttgaggtcaggagttcaagaccagcctgggcaacatggtgaaaccccatctctcctaaaaatacaaaaagcagtggggcgtagtggcgcatgcctgtaatctcagctccttgggaggctgaggcacgagaatcgcttgaacctgggaggcagaggttgtggtgagccaaaatcatgccactgcactccagcaagggtgacagagtgagaatccatctcgaagtaaataaataaataaataaaaataattaatatgataatatacaaatcagggctgctgcaatggaatgtgaagaaaatagaaaatgtttgctaaatccatcatctcccatgatatgtatacgtgcccatgaacatatacacatacacactcacatacaaacttttcctagatacacacacagaacctttactcaaagcattttgttcctagttacggaataaagatattgaaaaatgcattttcattaatgtgataaagcataataaattactcctgccagatgtgatgtgacatgtacatattttcttaaaagagctgtagaaatgggcaaagatcacacacacacacacacacacacacacacacacacacacagttaattaacggatcctccaagacaccaatcttcaaatattactgagcatttaataagtgttatgagaaataataccaaaaacagaagaatgagataataaactacagatgagaaataaagacttatacacataaaaagacaactctagacagtaaatatttgggttcagaagcagaagaaccatcaagtaatcaaagactgcactactctggatgaacttgatgtgagctggatcatctccacaggctgaattttcttaggcagagcggaaggagggaaggaagaggacagcccaaatgagggcatcatttagcagggatgaaggcataaagaaaaggtattgactacaccagtgtgtctctatacttctctgaatcaaagagttgatgccagagcatgtgaagaacaaagcatgctgtagagttgtcgcataagattgtggaggaacttaaatgtggaaagaataaaagaatgccagaaaaactgcatgttaacaaaacctactgacaacattagaaaaggaaatattgagatagtggagagagaattttcctggagacctcaaaaccataaatgagagataatactgaagacctactccatttggctttacatggccatagctttcagggactcagataccgtaggcactgaatgtcaaaagagaggttgcatttagaactcaggcagcagcctctcatactgcactctatagatcaattttagtttaatgagatttaattttaaaatccttaggttttatctttagcacttcaacacactgaaaatgcttccaggttttgatttacagaattactgtcactgtcaataaaagaaatgtgcctgacacaccaaaatccagtttaattacttctgtaatgtctcctgcagctaagaggaaatggtatttctctgacacttttctgtttttaatttagcaaaatggagcactttcccttaataggacctgggacagcagattcagaattgatgtcatcaaagatggaccccacagtttcagcaacactgtcttactctgactgtgcaatgattgcatgaatctggatccttggtattggattccttgaagctgggcactcatcaaagatttgacacggaatcatggctgggatatttagacattatgtcatcacttggagaagctttgcaagcaaattcaacagcctgcttctacctagaactcttaacaatgtcagcattgccctgaactgctggaatccagatgaggccttgaaagcttccaaatagaactgccaaatatcaaaatatacactgtaccactggagtgaagaaaccaagaaaaaatgtgtactttatatcttctgctacatattccatctgcttctctccctaaagggtcatatgttatatatttataagaagtgttcacacctacgcgaacagtttccactgtctccttcaaatacagcctcctccttgttcaagacccatttttttaaattcttctatggtagctgaaccttttatgaaacttgttccattctgaaatcatttcaagttaagaaatgcccttgtaccttcctatctcaccaaatcctggggagattaagcctcacactctataggcctttttctgagagatgtgaatttagatcattagggtcattaaaatcacacaatctataatactcagagctaacatatcacctttgtgctttatgctgctatagaatgctacaagagagttaaaacacgtatagcatcacagaactgtagagaaggccataattcctccccataaaagaattctatactttttaactggcacagtaaatctcattaaagacacagaatgctttgttcagggaagcaaaagggatccctgggcaaggtgcgtttccttcacagtaatattttttttccttatgacttgaattattccttaatgcaagcacaatgttatttttatcttgaccttttttctggactctacatgtttccccaggctttttttcccttccctacaaaaatgaggggcccttggtcttcactattaatcttgtattaacttttaatacactgggcttcatgcatcctcttgtatttctctgtgtatctaccaaagaccttcataggccacactaataacctccgacttagtctttttttctttctgcctcaacaactgtataaagaataaactcaggtataattaacataataaatcatttggtgcacattcattggtcaacacaattctgaatcttaacagttaatttcccactatacagattgtgaatctgattcacataaaagtactttgggaagtattttgtctgatttcactatcaaatattagattattatttttgagaaactcagaaaggctgtcatggaaaaatcacagaaaattcccatctctctttcataatcagtacctttttaataacagagctggaagttaatgacagtatgcttttgacagctcactctgaaattttaactcatctgtagaagtgccaactgagcagttgaggggaaaagcataaggtttaaatttacatctaagaattaagagtgagaaaagcatggaaaaacattacacagtgttaaagtgcacttattactaatttctctagggaattttgcagctagggaatttcagttgcattattattgaatctatccccctttaacagagactgtgggtacagaaaagaatatggccttgaaggcagacgcattcaagttctgtttgtgccaactactaaccatttcagcccaaagaagttacttaaaatattcatacctcacaatcagcaaagggaagagacaatctaaagaactggagaaaatatttgcagactattaatccaaagaaaaagtaataaccagaatacataaagaactcaaacaattcaatcataaaataattataacaaataattgaatttttaaaatgggcaaaagaagacattcctcaaaagaagacatataaatggtcaacaggaatataaaaaaaatgcttgatatcactaatcatcagagaaatgcaaaaatcacattaagacatcaaaatcaaaatcacaatgagatagcatctcactccagttaatatggctattataaaaaagacataaaataacacatgctggcaaaaatttggaaaaagagaaatgcttgtacactgctggtggaaatgtgaattagtacaaccactatggagaatagcttggtggttcctcaaaaaatcaaacacataactaccgtatgatccagcaatctcactgctgagtatatatccaaaagaaaggaaatcagtatatcgaagagataattgcattcccatgtttactgcagcactattcacaataaccaagataagaaatcaacctaagaatctgtggataaacggataaagaaaaaaatggtatatatattccaatacgagttgaactggaggtcattatgttaagtgaaacaagccaggctcagaaagacaaatatcgcatgttctcactcatatgtgcgagctagtaaaattgacctcttggagacagtgaatagagtagaataggtggtaaccagaggccataaagggtagaaaggtggagaggatgaagaggggttggttgatgtatacaaagataaagataagtagaagaaataagagtagtgtttgataacacaatatggcaaatacagttaacaatattttattgcatatttcaaaatagctagaagagtggaattggaatgttcccaacaaaaataagtgataaatattttaaatgatggatacccaattacccagatttgatcattacacattgtgtgcttatattaaaataccacatgtaccccctaaatatgtacaactatcatgtattcataattttttttttttttgagatggagtttcacttttgttgcccaggctggagtgcaatggcacaatcttggctcactgcaacctcctcctctcgggttcaagtgattctgctacctcagcctcctgagtagctggaattacaggcatgtaccaccaggcccagctaatttttttgtatttttagtagagatggtgtttcaccatattggccaggatggtctcgaactcctaatcttgtgatccatctgcctcagcttcccaaagtgctgggattacaggcatgagtcactgtgcccggcataaaattttaaaaaatctatttatgcttcagtattcttctttttacatttaaagtaatcagatatttttggagaaaaggtaaagcttataaaatttaaatggcatgcatataatacatattaattatgatattagcactgaaatatgttgatgtaatctacataaattttttgtagttctttttatgcactagctaggcatatccacagcaacaaagtatagaaacaacctaggcctgatctaacacttctttccaaatccaatcataattatattattttaaaataaaagatttcataaattataaggtaattatgtgtaatcctatactttaaaaacactcctgataatttgatttcataaagtgggagaagtatttaaccgtttgctctcttcaaatatcttcctgattaataaaatgatactaagtatttttttacttttattttagatccagaggtacatgtgaaagtttgttacataggtaaacttgtgtcacatgggtttgttgtacagatcacttcatcacccaggtattaagcctagtagccaataattattttttctgctcctctccctcttcccactccaccctcaagtagactgtggtgtctgctgctcccttctttgcgttcatgagttcacgtagtttagctcccacttacaaatgggaacatgtggtatttggttttctgttcctgcattcatttgctaaggaaaatagcctccagctccatccattatcccacaaaagacattatctcatttctttttatgtttgcatggtattctatggtgtatatgtaccacattttctttattcaatctgtcatactaagccatttattatttgtacttatttggtattgtgcaaggttctgataattcactgtgatttatcttcagtttgttcacacgggcttttggtacatcatttttagagaagtaaaatctatataaaaagtaaaattaaacttaatggctccaagtgtcaacagttagcacctctgattaaggcagtatccccatcctgccttgattctgcacctgttgtgttgctacagatggaagtaacatgataaacacggatatataatgcattcgcatggaaaaaaaacattcagatgaggctatctatttgaatagcatttagtgataactaaaaccattgtctttccttgagaatagttagtcaaggtgactagcaaaacctcctctgaatgcagctctggttagctgggctctggtgagataggatagtgttaccacagtaagaccaacattgaaagccacctccatatttacctataagatcgatgatgaagagtgctaacatttgagccaaattaaggtctacacagacagagttttaatgaagccagaaaaattagagcatactagcaggaaaatccataggtgaagaaaacattctgactgggtttgcttcctttttgatttctaggggccaaggtggcagaattcacagactaaaaggctgctgagagttgaatcatcaagctgctcaacagtgcaagggactaacatagataattcaaatacagcattactctattcccttttttgttgtttttctccccacctaaattttctcatatagatacagactgaaactattattcagctgcccaacaataatataaaaagaccaatgcttccatttatgcatctacttttatgatgtcaattctaaaaagaagaacaaagataagtttacgtaaaatagtagcagatagcacttctatgacatattacatttctctgtcatacattatgctttattttctgtccttcattacattttcttacttagtaggaaaaatattttaatcctttatcattcacctgaggcaggtctgaccctgtttccccatagtttttttaaggtgttttcagtaaagattgcttatgaattgctttaaacagcttaagggcttccacttagaaaaaattcaaggttaataagattcatcatactcacaaagagtatctggttgtggacatagctacttgctaaattttattcagccctaagtgacaccagcagcaaatcagctcacagcttaatactactggcaactctaaatgggagagaagtaacattactcagatccaggtttttaaaaatatatgttatgattcacttccattagttcatatattgatgctcagacactggatattggattctctttcaaacaacaaaagaagctgagaaacaaagctgaagatatttttaaatgtcatggtaaaaagtcacagggaagtgtattttatcctcatttcagcgaatgtttctaactctcatatgaaagatacaataaattcctatcagaaagattttctcttggcaaagtttaggattctgaaaacagccttttaataaaacagcacccacaccctcctaagctgtagcaccaaaataacagcactatgttatattcttcccttatggtaacagacactgttgaagctgaactgtaatttggcatacaacatttctatactaatgtaatgtgacaatgttattatgttcgctattttgcatacggtcatagccatgttcatcttctccaacctgacattaagttagcttaatatggtaacattctattccggaccactgggtaaaaggagaaaaggattattgtgtagcacactggtgtgatgatggtggacgaatgtgtaagtattaataggtgatatataaaatttacaatgaatgtaaacttttagcacagaactggcacatagtaagtgctcagcaaatggttacatccaagagaaatttcataaacagctacaccatacaatgtagtccagcacactgtttcctacaatttcagaagagggaaaaataatgtcaagctcagaaaacaaaggaagtttccatgggacaaaagagttttagtagagattgaaaaggaaattatatttcttcaagcagacatagtgaaagaatgcattccaggtggaatgaatgcattttccaggtggggaaattagcataagcaatggtgaggaaattggaaagtgtaatgttgttcagaaagctgtaagtaaattggcagtaatatgccatatggacaaggttctgcaacagataagtatgaacatgaaggctggggtcagaccattgaggtccacgaattccacattgactaacttggagagtagtattggacactgaggatatatttgaaattcttctgcaagatgcatgtgtctagcacgctttgattttagtgagttattacaattacatgcagcatgctataaaaacactgggcttataaaccaagaaaacagagaagaatgttattcctagtagaagtatagagtcttatagggaggtaagactaaacataggtaactataaggaaaaagtgatggcaaattaaatagtataaacaaaattctataggaagccagaggagaaaaaaaatattgcctctggttaggagaattaggagagactgatgacatttaaactaggaagaatagaaagaaagaacaaaactggcagagaggcacagaatggatcagaggaaagaggaataagaaatgggagataactaagaaattacatgatataccagaaaaattatacagaggatctaaaatttggtattgatatggaagaaaacttgaagaggtgagtatatgacattaccctgtacacacacctgcatatccacatacacacatgcacaaaacaattgtttttgtcagtgagtaggtcacttagatggcaattttccggggaagaaagggtttaacaaacatttcattaaaaatagcctttggcatcattttgaatagcacttctttttgaaagattcctttcagttcaattaattagtatgatttatccaagattacatttacaagctacaaagtattcccatcttcccattgttaattatatctccaggctaatataaatacattttttctagttaccctaacccactctataaaccttatcagcgagatgacatttagaaattctattttgggggagggaaggtctcatttgtaatgtggcatgttcgtttccccattaaaaagttttgtttctattttcttttttgttttctatgtaattggaggctgcaatcacagaatttatgaaaaaataaactagagatgaaaatttcattaagaagtgaaatgccttaaatggctttattttaaaagaaaaatcagcttctatacagaaaaggagtttgttaaaaccccaggaatcacactaattctatttgtgcatcttagagaaaaacagtgagatgtacagacaagatttattttgatcaatttaaaaagtgaggaaagtgttgcatgctatttctattgcttattaattccacgtcttcaaagtaacaattgctactatatcttctaccaattataattgatacaaaataagatttgcttttgaatattgatttgtacctatgtattctcaccactgaaactccaacgtataagccaaggaaccatttcacattttcagaaaacccactaacaggtaatgatttaatcaaaatgcatgtattctgagagctctctaaagtaattttaatgctgatttgtgcaagaggcatatcaggagacacatttattgaatgacatttacctatttacaagaaaataacgaatagccttatcattgtcatcaccagtactatcacccaagagcagcattaaaatagttttctgtaaaaatcattcgaagacagcatgatacttatggttgtatcttggtgtttctttagggaaagtctaacaaatacatacacaaaattatattctttatatttaactggtatatgaggatacacagtctgccacaaccaaatggcaactgtatgtaaaacatggaaactacattaagcatagtttggcagaaaaagttctttagcaacatgaaaaatattttcacaccaaaaaaatccctctcaactaccacatgtagtcatacatctgtcaggattgtattcaggatgaaaaatttgcgataataaaatcttaacaagtattcagtcttctgattgtccttgaaaataaatttacgccattttctgtgaggcaggaacaaatgcaggaagtaatttacctatacacacatatacatatccttatgaaaagcacatgtaaggctgctatatgtatatatatttattaagactttatgtaaagttgtttatataactcaaaatggcgttattgtgttttaagtgtgatttggcttgcagagtgttcgcaaatgtatgatagtttgaatacatgtttattgcttcaggtttactgtaattctatgggagaggaaactagtaaaatgaagaacaaatatttctccatctacagtggcatggttgttaaaggcctcttccacatatgttttaactctgtattggttgtgcgtttttccaatagtcaatattttggaaaggaaacctaaagacagcaggtaaattgtactttattgctaggctgcaacaactcagttcagaggattactgtagctttaccccatcttctacattgcgatgcacatatctgttgacatgaatacagtctcaaatagacaaaggtcaaaatgaacaagctctactctttctttaaatccacattcaaattcagcctctgctacaaaatctaaaccttcaaccgttgcatcttctattccatcatcctggaggtttagcttaagtgttgtagcactgacaacatatagcacgtattctattttacaaccaggtcaatttgtcaggaatattctcttaatatagcagaatgcaatgttttgtatgaaattcttttatcattttgatgatgtgctgtaaatcaggacctattagaacattaagacacagaacttcatcttatagatcagttaattccatcttcaaaccctcactgctgtgatataaattaggcactagcagatatgccatgatataatgtgaatcatgtgttttattttcatgcttatattgtaatacttagttaaaggattttaaggggaaaaacataagttgctaagatacaagggagaatggctgaagggacaatgtttgaacatatttttttaaaagtaaaaggcagcaatgggcttaaagagatgtacgcagagagaaaaatgagacctgtaaccattcagtaaaattacagccctcgagacataatcatatgaaattaagtattatttaatataaaacaatatgaaggttctttcaaaaaccaagggagaattgtcatatattggaaatgaaaaacattcttttgaacaaggtgatcattagtaattaaaaaataacaataaacccaaaaaccaaagaatcaccatcatcacaggatttagccactttaacaattagtatttcaaaactgtcctttccgtagaaacaactgcttctatgggttatgacagttcgactgactcagagttaatataaggactttcagtgttagactttagatatcaaacagtaactggaagcaacgatgagtatcagtccatactcagagaggtacttacggtcattgcagagtggtccactgaaggaagtcatactacagtcacagctgaagccatcccattgttgcaagcacacaccttgattggaacatgagtcctcttggcaggttgtgctgggccctgcaaaacaatccaaaggaaacttgggttctttaaaagaatccaaaagcattttatacatgagctagatcacatgtagtagttgccaacaccacagatgatatgtccaaactagtttttaaagttctagttcacacacctgaattaggaactgagaggctgtaatatgaaggttttcttaagtttcaagtataggataaaatacattataatcataaactaaaccaacaaatagcaaaaacaagcacatagcttctagtatgattattgtagcaggtaatctcattccaacttcaataattctttatcactattttgattttagaaaatgaatggatctccttaacattctgaccaatgaatagagacataatgagaaatggagattataacttcatgaaattgagataagattggcaaaataactgaagagagttatgcaaaaatgccctagaggtttccaaacgataaagttatgattgctgggtgttttgaataggtatgttggcaagtatcaattcacatgcttttaacaatttcatgcaattaaacataaaattaaaaactccatataaatggcatgccctcaataaacatacaagtaaaaagaatgctagtctatttctaaagaatcataactagaacactgaaaaacaaagaactaaaaaaagcatgatcaaagcactaaaggcaatcactatacaaacatattcaagactgaaagcctttatacaaactatgctacaaagttaggcttcttgcacaacgttcaagaaaggaaaagaatgaaatctgaacccaaataacagttactgcagaaatgtaaaatatgttattttagggtttccactgtgtattatggggtttcagtcttgttatatacacacagggctatctaccttgcaagtcagctttcatcaatgcaactttgtcagcaaaataaaaaaaaaagcaaaatatattaaatgttagtaagcaatactgaaatggggcaaacacagaagaatgttcagattcaaaaggcatgctgctgtaaagagggagaaaaatgctatgtagagcaaacaaattaatactaacagccataaatcttaagagaagccaaaaatgagaaagcagaaatttattagaatttaattgtacatatgtatatatataatggttaattgagccaatgacatgtaatgaaggaaaattaaaagggcctttgtatgtttcctctcttggatagatatgaatgcattaccaaagtgactgtgttgcttatttggaacatgcagcaccattcatcatgtgcagatacagtgtagactatgatcagtagcaaagcaattatccctttctatgtttttccctctagatcctttatctttctgttgcaattaaggcttcaaaccgtaatgccagccattcactgacaacagctggactttagagtgacaccaaccaaatgctgcataaatgatactgtatatcatttagagtggatgaaagaagtaggaaggatggaagaaataaactgcaatataatccatcataaaggaattttctgaataaaatttccatgtgcagcgtttatccttgaacttaccagattgggtatatgccacttatgaatttcagagttacgtctgtattttctacactttcacaagtattttcaactcttataaacttccctgtggaataactgttacagtaaaacctcactaataagaacctatcttagaggagggtgaaaagggaatacagtctacctaaatagctttagagtataaactaaatatattttctagtaaataaacatataggttttataaaaatagaaaaaaagacaacagctaattagatgctattaatgtaaaagagagagcctctgaggtgcctgctttagtgaataaattagaattttctgtaattatattttgtataaatagatgattttgaaaatggcttctaaacatgtaccttacaatcacatttgtattataaatttttagtaaagatactctttattgaatgttattgaatttagcctagcctctgagaattcacaaattcagaaaccatgatattgtaaatcttaattctgtaataataataataataacagcaataattgtaacaataattaaaacaaaaatagtagtttatataagtagtaatataataagaagacctcccaaatccaggaaacctgaagagagtaacagttgtttttttcaacttagttatttgtaataaagaactaagaactaacaaagaactaagaactaacaaagaactaagaaccactaaactcaacttagttctttgtagtaaagaaataagaaccacttaattgcttagttttaatttttgttccaaactgtgagagggaagtggtctactgatccttatcccatggcattagagatcaaaaataattagcatatttttaaaaataaaatctctcaaagcaatattccttagcatatttcttccagtgttaagcaaataaacagggagtaatacaagcccagtttggggagatgccattttatcaaatagctatttgctctctgacctgcacagcagaagaaaaggtcagaagcaagaactaatgaagatccagattttggtttttgttttttcaaaaattatcagaaatgcaattgagaaacaatgctaaactctaaaaatagtaaaactacaatcttagaaaaataatctgcccatattgtagagcagcaactcagagtacctgccaagcttctatgtaagcatacagacgtgctgtattttattttcattatcacaatagtctttatattcaggaattacaagacaatgcatgcctttgcctgacaagacacatttttcaaagtactcaccttctagacaatacttaaacattgacaggtattacacaagagagagccttaaatttatttttctttttagttatgtaatattatctttattttatcactgaataaaattaggaaaaagctacaaggacatttgtattaagttatttaaattaataatatgtctaaaagggaaagaaaaatgaagataaaactacaatttccagaaacaaaagaaatgatacacaaaagaggttaggtgtctctgctttcaagtaaggtaaacttgagtttgaaacttgtgtcatccacttactaggtgtgggactttaggaatgtcaccttacttttctgaggttcaatttactcattaaaaaaaggcaatgatacctattgtatagagtcttgatgatttaatgagatagtataggtaaacatattcccaccagtgtttaatcaatgatagctgtcacgattaaacagaaaattattcctgtagatataatggagcctagagctgaatgttacagttgtacaaaaagagcatctattaaaatttcactctgattttatgtagagatattatcttgactttagtgggcctgcttattggttgaattccagtgcccattttctgctacataaacagaaaaaagccatccaaagtatggtctccagtataacagcatcagcatcacttgggaacttgttagaaatggaaattctagggctctatctcagatctattgaattagaaaccctgggggttgtaatctagtgatttgggttttaatgattctgtaagtgattctgatataggctaacattcaggagacaataatctaagtagacttcgacgggttaaaatccgtactctagctgaggtgaattttataaataaaatgaaccattactccctgaaataaattagaaataaaaggcaacaagtgattatttaggaaagatcaaaagttttttgtatgcaagaggcttagaggtgtgtgggtgtattggataggaacaatggaaactcctcacaagatattattaggttataccaaacatatgctaagtagtcctatcaatatggagcctaagtgattccagtgtggtttggactcaaattccatgacataacaatctttagaaagagaatttattaggtatctacagttaaaacactaatcctaaaaaatgtgtgaatctcatcaactgtacctgtaacaggtaaatctaagattattcctagaaactatacaggtcagaaataatagtaaattaaaagttgttcaccttgatgttggaatgaaagaatcaggacagaaagtaatattctaagagtaaagaaaaaaaggggtgtcagggtgtgaaaattataaaagctcagatatataaagcattctagataaggaaagaaccaatgccataagtgactgggttcaaatgttcaaataatagtttaatgtgtaactaatcatcttaaccaaattccttactagattatgtgggtaaacaacaccaaacatcattactgcaaatgccctttgttagtatatcctgctcctcttaatctacttgcttccgcccactcactcacattacataccagtggtgggggtcctgtgtgtttgcctcttattttctatctcattgggtatatctgcctgctctcaccatttcttgtaggtgagaagtcacataccaaacaacttgtagaaaggcctatttttaacaaatatgttccataagggattgtaatacctttctttaaaaaataaaataaaataaaggtacacattctcactaatgagatcacctccaagaattattatgttgtatcacattcttgtgttcatccactaatgggaattgatccccttaacaattttgtctctcttaattaaaattaactgaaagggaaaaaaacatagtttccttatgttttacagaggcattatgccaaaatatcaaataaagaaatatactaataacattaaaaatgaactcaacaacaccttccattactaaccttatcctctagtattactgaaatacagtttaaatttcacctaacatttcatggaaacacatgctgcacagaggaaaaaaatgtattttcaaatataaaatttccatgtacttaagtaattgctaaatataacgacattattttggctgagaataaatgattcataatcacctgggggacaggaattcaaatttctttcttcttctctcatataaaacatcctcatcctcataaatctaaaattttcaaaatggcccaaactgtgttcagtattacaggagaggcagcaacacatgcagagccacaaaattcatgataatgtgattaaattacatttatggaggaagaatttgctcaaataatctgaggtgttgaagtgaaaattatctaaaatgaaagtggcaatcaaaaagtactcctacagatcttggtctgatagagagcacaaaagaaaagaagatacttcagtgcatttctgatataggaatattagcctggggtgatacaagaaacttgtttttgctaaaacagactgaaaatatacaggatacagtgtttctgccaggtacacaccaactgaatagtgctttgagaatggggtatctgaacttttttcttttgttatatgctattggatatagatttacttatttttattttactttttttttaatttcagtagctttaggtgtacaagtggttttcggttacatggatgaactatatagtcgtgaagtctaacatttcagtgaacctgtcactcaagtcttgtacgttgtacccaataggtgttttttcatcattcaatccccttcccacgattccagcttgtgagcctccaatgtcccttataccatgctgtatgcttttgtgcacccatagtgcagctcccacttataagtgagtaacatgaagcatttggttttccattcctgagtcacttcacttagaatattggcctccagttccatccaagttgctacaaaagacattattttgttctttctatggctaagtagtattctgtggaatatacataccacattttctttatccactcattggcttttgggcacttaggtagattccatatatctgtaattatgcattgcgcagtgataaatatatgtttgcagatgtctttctgacatagtgacttctctcactatccttcacaaactaatgcaggaacagaaaaccaaatactgcctgttctcacctataaatgagagctaaatgaagagaacacatgaacacatagaggggatcaacagacactggggcctactggagggtggagagtgtgaggatggagaggatcaggaaaaataactaatgcgtactaggcttaatacttgagtggcaaaatcatctgtacaaaaaacccctatgacacaagttgacctacataacaaacttgcacatgtaccccctggacttaaaattaaaacaaaaagaatgtagatttttaaaaaatgggcacaagttgattaatactcggtggagcagtatttgtttaatgctataaagcaagcatcgtagaactgattaacaaactaatcaaatgtactacatagctcaaaaacaaaaacaaaaacaaaaacaaaagcaaaaacaggcaaaaaaaccaagatccatagatatacctcccattttacattgggcattaatgtaggcttgcaaacagtacagaaaatttaaggtttatgagataaaaaattaaaaacttgaataaggatgtctaagcccaaattgggtatttgaccagttatcagaattttgctggacagtgagattcactctcagttagacaggtggaattagaattatttagagcatgatgacaaaaatctaataccttcacatcctctctcgatctgtccgttgcagaaaagagcatcggagatgaggtccggaagccgtccatttaaatcaactgatgccaggcagccttgaaagccttctttggcatgtacaagttttggtaaggatttgtatgtttctttagctactcctcctatatataagtcacctgcaagaagatcaaagtctttgttacaaaagtaccatgtcattgactttaaacacacagtaggatggagaaaaaacagggaggtttatttttcattaagttaataaaaaattaatttatgactagctgttttccccaaagtgctaaacaatagagacgtttgaataatatactggcactaggagacatttctaaaagctatttccatagacaactaaagtaattccatattatgtggtcaaattgaaggaatgtgggctagctatagagatgcatacccttgcgtggaaatccaggcctggttatttgcaagccctacagccttgtgtgtgtgtgtgtgtgtgtgtgtgtgtgtgtgtatatatatatataagtttctctgattattagtatcattgtttctaaaatgggaacaataaaaacctatgccagagggtttcatgatgattaaatgagatgaaatatatcaagcatccacaagagcaaaagtataaagtggacacacagtcaacaggcattattattaaattcaccttctgcttagagatctctgtgtcttccatttcatcagaagttcagtaaatttcttcttgtatctaaagtcacttctatactaggctgaagcccactatccttgcttgcacctctcttgttcgataattcacataatagtctgtacataagtggatattgcatccttcttgaggtatttctgtttttaggtaaaattacactactttcaatttttaggctgctctgaaatccgttaacaaattttcaacttatttttctaattttattgcagtttctaatggaagacattgcttagctttgtttaactttttctctctaggtttgagattccccaactttatggactattacttaaaaaaaaaaagagattacaatctatgttggattctgtttctttttctatttcagattatttaccatatctggataatattcaataaacataactaagtgactttagtaaacatttaatcaatgtggaacataaggaaggtgagctcaaaattcagtaatatgctgctatagctccagtctacaagttctgtaacatactctttttatctacttcttcaactttcattttcatttgaactttctttctcatgttaaccattctattcaacttgatgtcacttggcacattttccccagtgtaacacaaaaatcctgcaatcttactgttcacctgggtccttctgtgttgtcttcacgagacttgggaacaaggagaactgatacacagactgttgagctgtgagtaacaaattccttggtctcccatccagaaatattctgtcttctgcaggcacccattaaacagtaataagctaacctattaatttgtatgtagggtaaaatcaaaccacagatataacactcttgaactgtactcatgaataaattgaaatagaggaatcatgtggcatactcaaagtcattcaacgttaaaaactgagaacttaggtccttgacctaactaaaacttaagttttataactatataatttgcattgaaagtactggatgtatttacttccccccttttacataaagcaaagtctactgactattaaccatcattcttaatattaaaagacagcatggttttggtcagagaggggatactattttgaagaattatttgatttttcttccatatttccattctgtcctttgtttttgctctcacttaaatttcaggccattgtgttttagttgcctcagagaaaggatatgaatcagaaatcaaagatacaaaattagctttctgtatttaagtctaaaaatcctagactcttcgaggaatgaaatagaatacattggagtttacataagaaaagtaaagctttcctactcctctttcagtcaagcaggagataaagttggaagaacctagttgtgcaagtacagtcattggcaaatgtcaaagagggtgctgatttctaatttaaggactgagctctggtgaatctcaaaacctcaggtaagtttcaaggagtaatgcaaacctctgtgcatttcctcaggagaactaagagggagcagtgagagctctgaaaagaaatggctgcatggtggacttagataacctgagaccttagacagtctcacacaacgttccgtactcctctgtgccatgggagctatagaacaatttccagactggcacagaaatagcaaaaaaaaaaaaaaaaaaaaaaagtccaacctaaagaggtcatgcacacaagaatgaagatgctgggtagcacctcagtgagcacctgagttgtgactctagaatatttgaaacaagcttccatgccacctctctttacccgcccgcccccctaccaaaaaaaaaaaaatgagtacagtagaactcaccccattgagttatttagatatgacacaagaaaaagaagggaactaaaattgcctgagattgtaccttcactaactcaaagaatcaaagctcaaaatagaaaccaaggtgagttatagaaaaatagaaaagttacatttcttgtacatcagagattgtgggctgagatttataatttgacatgacaaatagcaatgaaaggaaatactacctactcctttcatttgttgaacaaaatttgttagaaaatttcagctctcctccaggactaatgaatgtagtagagtggggaattgaatgaagaattcttggcacagctttaggcttttcagatgtagaactcagtaatagaaattatgtatagaatactatatatttattaatcaatcttcctctgtctgactgtaacctcctgaaggagagagactgtgtttcccagagtgcccggtactgggctctaagcacggttggccctcaataaatattgtcagccaccttatggattgaggccacggtagaaaagaataaaaaaagaggaaacagtaaggcaacacatgaggagagtgctaattctaaaatgcaccaacttacttccttttcccacttcctaccacaatccctatgtttttctattaaaaaacttacttgcctgacaacattgtaaagcttattgaagagaactagtaatctttcccttgagttactaaagagcagaaaatatcagttcaagcagtgtgggatacaaccttcaaacatagcaaggtagacgaggttggctttataaataggggactcattctcattttcattactgaagctgtacttagcaccaccacttagtactgtttataaactctttgatatagcaaatagtgatctaaagtcccttggtgggttgccacatgaagagaacaaagaaactcctttagtggtctgagccctgtgtactattatcactttatcaaagatgcaggttctctttttgatccttgaagtgacgggtttaaaaaaaaaaaatgacccattagcactaatgggtcctgcaggtgagtccctgtgcatgtgaaggaggatatacttaatggctctgtgtatgaacaagagcctgcatgggcaaccagtaaaagccaactttcctgtagatatgaagctagcctgttacctcttcttcaaaatgagtggctgatttttaattcatatgttttaaggaccatgtaggcaattgataaggcaaaggttgaattgggacactttcagcaaaagaagtagagaacatgtacaataccaaaaactcaaaagtctaaggggtgagtttcttaaaataatctcaataatacccttatttttagtactgtatatacacagccactatgttcctctcaagagtgttatctgtgaatgaactggggtgatatcatgagtatccattccgcagtaattgagcagtaatgactagggaatagggcacaggcattttggttttctctgtctacaaaccctggctctgccacctactggctgtctcagtgtaggcaagttaggttacataacttctttaagagtcagattcttcatctatgaaatggggttgataatgcctaccttgcaaggccataaggattacaaagtatgcacataaagcatctagtatacagcatggacttagcccgtcattgatactggtatggctgtcagtatatctgtaaggatgacacatctatgatgtacctcaatctatgctgattccactgagaaatgcagaagaaggagaagtatagtttatctcctgtttctagcacaactggagtgacaacatgtcaattttataaattctccatgatattttttctattggatttagttgacagtcatttgtgtgctgaagtgtgccttacactattctaaaagtagctcacagagctcctttgacttaatttgaaattcggtggcattgaatctggtaatataaataggaaagttgcttgacaaatatcttctaatttgacacaaagcgattaagaggacaaaaaaactctatgaagcccaagggccaggttgtcagttccagactaaacatgccttagaaaatcagagaaataacaggtttttgtggactgtggttgcaaagtgggggagcatacaaaagttgagacaagaagaaagtatgggagacattactattgtaatgatataaatgtggatgccagacacagggaacagcacaattgtaccatggagacaaaatttatatggcatttaggaaagagaataaaaggcttgactggaagagaggagttttcagttatttattaagttatgtaaataatattgtataagtaaagtcaaaggaaaggccaccatagaacttatgactgctggctgaaaaaaataaataattaaagataatgagaaatccaaggatcaaagcaaagcaggctaggaaactagggaatttgaagcagtaataatccggaggagaaataaaattgcatttaacgtcatgtatgtggaatttgagtaggaacatcctagaggaatccagtgatatgaacctgggccttagggaacggaggttggagcttagaggccttccttgggagccaccaaccaaaagcagacaaatgacgcggtagagatttcctcttcacttaaaataggaagcataaggcaattagagtaaagaccaagctctgccttacagtagcagaatgcaagtgtcaaggtataattagttctttgactcagctttcctgtttattcacatgtacttttttgaacctcttaaatatctcactttcattttaatttttttaaaaagcatacagaaaaaggacaattgccttatagatttgaatagctaaaactccaggaaatatgaaggaagctctcacaaacttttataaatggcatttggggaaaaagaaaaagtgaagtcacacaaattagcttactttcctatagctggactagagaaagtgcaattctagacacttcattttaagaagattggaccttggagagaaaatttgggtgcagctttttctcctaattcttattgtgattggatggtaaaagtagtgcaatcaagcttgggtagtttctgagcacattctatgggaagggtgcctttcggggaacaatcaacctctgtccccaaatttgtaccattatctttaattttaatattgtattgcacacacataaaggaatatctgtaggtcagaccttatctagatacactgagagagcttgtctttaggtgacaaatccaaacctctaaaacaggtgttccctgttagataaaagaaaatgacctataatatctgataaacaaacatttgtttgctttcttagtagaaagcctaagtgtgactgcttaaataaataatattaaactactaaaagaaaaagcatgggaagtgaatactgctctaatctatttgagcttacaagtaaacaaatataaacttctataagaaaccacacagaaatgaacaatgaaaactatacaagatcatttctaagttcaaggcttgtaaaatattcaaaatggaaatcaaatgggcaattcaagcagacattttgctctgagacacaagatctgtgtctgtaataaatctccattttttaaaagattaattttagaaactctccgctgaagagatgttaagtggtcaccagcttgatttattgttttttaacttctatacatcttagtctcccttggtacataaaaggtttagccttacaacaatctatttttgcttctgtaggaaataaccataaattattatctttaggcgtgtcctgaatttctaggtccagcctaaaatcaaaccttcatcatctcccttgctgtgaaattactttttctaaactttcatgttgtgtaacagccacatatctagtctacctgctctccagattggaaattcagtatcatttttaactttattttatatctcacaccttacaatcaactactgccaaggggtgaatgactcaactttgccaatatttctgacatttgttgtttcgttttcattcccatttccagttcttatctatttttcttcttgtacacaccttttaagtactaacctgttacctggtgtcactgtctccattcagcctcctcatcaacactgtctcagtcactccactgtgttctgatatcttcaatacctttctgtatcatctaaattaagtctaaggctcagcagtgatcaagattttgaattacttctcttcaaaaacttttgctaaactttgaactatctttcaaaaataacttttgccaggtagaagattgaaataatatctatcttcgccccacagtccgacctttagtcaaactttgttggcagcctttccccaactctgcattttcccactgctccatccttgcttgtggtatacaatacttccagcatgaatgcctttcctcttctgatgttgttcttcaaaatcctactcaacttgggggactcaactcaaactccaccttggaaatgtgtacctgtttccttagccacagataaatatcttggaatcctcataaaaaattgaaccccttttctgaaaatgattttatctttttcagttctttgtatgtgtaagccttatgtaaccattagtttatacattatttgaaggaataatcctaaacacgtttatattctcattttcacttagtaagcatttgataattagttgttgactcactgaatgaatggatgaattagtagttcacattcaataaataatcattgaaacaataaggacacagggaaggttttatgtcagcactcatatttgtccctggctctttttacctgagcaataatgaattaagttaattgtggaaaatttttcatctactaatccatttctttttcttttttttttttttttttttttttgagatggagtcttgctccgttgcccaggctggagtgcagtggcacaatcttggctcactgcaacctccgcctcctgggttcaagcaattctcctgcctcagcctccagagtagctgggattacaggtctatgccattacacccggctaacttctgtatttttagtagagattgggtttcaccgcgttggccaggctagtctcaaactcctgacctcagatatccgcccgccttggcctcccaaagtgctgggattacaggcgtaagccaccatgcccggcctgatccctttcttaaacacaaaggtgaagccatccagctcattaagaaaatttagggaattcaatggcatattttttcccactctgatagtgtaacttgatagagtaatacatgaccagttttaactgacacatactgaatttatttgtagaaagagatacagagatgaagatagaggtgtagaaacagtttggagtatcagtgtgcgtagtaatgagaacccatgcatgaatcgtcttctccaattaaaatatgtacaaaaatctttggaggaaattaaatttgagcctatcctggccttctgtttcattctggctctatgctgctccatatacaaagatgacctgattcatgcatcctccataggcatatggacaccatgagcacttcacactgtctctccagactcatctgctctgttattatcacaaagaaagacatgcatttatttgctgtgtgtgtctgtagaacacagagaagctaactgtgtggacccttagtgctctgctctagtgagtttgttaatcctcatctgcacttccttttggtttgcagatgtttcactccttctagcctttgggccaccactcaaagactcctaaggttagagtccttctagtttgtagcttctatttcttggctccttgtcagccacaggtgttcctgatgctacagcaggcttacacatctaacagtatattgctttagctaaaatgactttgagtttcacaaaaatcaccgagacaactgaactgaaatgtacagagtcctgagtgagagaggtcttccttactgctttgaatctttggtaatcagtgtcaggcattactatggtcaaaaccagaaaaaacagctctgacttcatcattataataataactgacatgagttaagtatccttaacttgaccaagcatttgcacatatattgttatatctggtttttgcctgttgagctacaagaggagtaaaggttatcagggatacatgttacagatgaagaaactatggtttagggctacaataccagaacagggcagggtcttattgcaagcccaggtcttctgaaactatgttaattgtccgttaatccagactgacacgcacatgtacaccctgtacactctaagtggcaagtggccaatatgtacagcttcactactacaacatacaggaaattttggagagttgtggctagttgataaaagtaatggtaataaatggtagcaaaaatccaagcaagctaacaaattcctgagacaactggtacaataagagactcatctgcataataatggagtaatctcataaaggcaaagtcaattttcttccataattataaatattaggtattcaaattctgatacataagtagaattcttatgttcaaaactttttaaatcaaattttatcaaaatgttttttaccaaaagtcaacatttgatttttagatacagcagttacttttcaattgtctcccacaaagagataaatcagacacttgtatgtatccatggcccaatctagtacaaaccagcacttacgtgggacaagttggggaggggcaaccccaagaagataagagtttagaccttaacgttttcctgtagtgagttttggggagttaatattgttattatccatatcaacagaacatataattctttcaatattctgaacttttgtttctttttttttttttttttttttttgagacggagtctcgctctgtcgcccaggctggagtgcagtggcgggatctcggctcactgcaagctccgcctcccgggttcacgctattctcctgcctcagcctcccaagtagctgggactacaggcgcccgccactacgcccggctaatttttttttgtatttttagtagagacggggtttcaccgttttagccgggatggtctcgatctcctgacctcgtgatccgcccgcctcggcctcccaaagtgctgggattacaggcgtgagccaccgcgcccggccgaacttttgtttcttatttaaattttgaaacaaaactgcccccaaaaagatttttttaaagtatgattctgaaacttacaacaggaagacagattttgtttgtatgtttggccaacagactgtgaggaaacctggtgggcatgctaaatgggaaataataaagtgaaattgctatgggagcgtgtagagtaatccatcttcttttaaacccactctatgccagtaacagtgtggcagatggggtgcgagttcagggatataaatccatgccaagctaacttcatctaatggctttaaatttttaaatttacctttaggtaaaaattgggtacaaacagtttcagttttttccttttgtctcatccaaatgacagccagtttaaatacctgtgacattccttacagcagacaattctgtcaccattccatgtttcattttttttacttactgtgtaatgctctctgggactgcatatggatttgcaggggttttcaacctcacatatactgctgtaccttacacatgcataaacagtgcagtttgaaaggtgcttttttcagaagcttttgaaccagagtgactccatcttgaataggggctgggtaaaataagactgagacctactgggctgggctgcattcccgaaaggttagatgttcttagtaacatatgagataggaggtccacataagatacaggtcacaaagaccttgctgataaaacagaatgcaataaagaatctggccaacaggcgcggtggctcaggcctataatcccagcactttgggaggctgtggcgggaagaaaccccaactctactaaaaatacaaaaattagctgtgcgtggtggcatgcgtctgtagtcccagctatttgggaggctgaggcaggagaatcgcttgaacccgggaggcagtggttgcagtgagccaagatcgcgcccatgcactccagcctgggcgacagggagagactccgtgtcaaaaaaaaaaaaaaaaaaaaaaaggaatctggccaccaaaaccaagatggcaatgaaagtcacctctggtcatgctcactgctcactatatgctaattataatttattagcttgctaaaagacactcccaccagtgccatgacagtttacaaatgccatgtcaacgtcaggatcagaaagttaccctatatggcttaaaaaggggaggaaccctcagttctgggaatttcccactcattttctggaaaactcatgaataatccaccccttgtttagcatataataaagaaaaaactataagtatactcagttcagcagtccatgacgctgttctgcctataaagtaggcatttgtttgtttctttacttctctaataaacttgccttcactttactctatggacttgccccaagttctttcttgcacaaggttcaagaaccctctcttgggttccggttcagggcccctttctcgtaacactttcacatctcttactccatttgatccttgttgcaacccttcacaataggtagggtggttattattatccctacctgacagatgaacaaactacccttctgaaaagtttagttacctgcccagggtaatacaagcaatacaagaataataatgccagcacttcagcgtttgactcccaggctaattcttttctgatgcaccacactctctcctatttttactaaaacccttctcaatgacaggagtagaatagatagaggagtttagaaatgactgttctggaaattaaaagagactgataaatagggaacaagtagcagaacttatgtaaagctgttattttttcccgaatagtgtatagaacaattagactttctttcccaaaataacttttcttatttgaaagacaggtttttttcttatttcaaaacaaacgaacatttattttgggtggggaagacccagtggtataaagggcaaatataaaagaacagctctttcctataatacgtctctttaatgtaggtgaaaaattggcaccggctctcaacttagatataaacaggataaaaaaggttatagccaccagtggttttctgtgtagcttgaaaggacaaagtagtataaagcacacacaaaaaaacttacagacattgccaaagagctttcaaaatattatgagcttcctggagtcaaatcacactcttgtttttccttaagtatctgaacatttctgtatttttttttccaaaaaagaattccttctgtgctcgaaagatggaatattattaataccaataaggtcatcacatccagttgctatagtgtaatttcctagtgcatgtctccaaacactttgttcttccaacataagctattcttaaggagaaatggagatacttaaaagcagggatccctcctccaggtcagggaagtgttaggaacttttcctaaaggctaaggaaattaagggctttgagagctgaatgagcctgcaagtagccagtttgcaccagccgatgactgattgataggccaacccccaatcacccaaccaagtactagattttccagagcctattctacatacctataaatgcaaatgttctgcagaatatatataaaggacacacagcaattaaagttgttagctgtattgtttgaggagaacttcaggggctaagaagacagaaccaatatatagatgctatgcaaggcattggggagagaagagcatatagaaagtaaagtggaaatatccagttcctttgcaactaccagaagtggaattttcaatgttatacaatgtagtagaaaagtagaagcttgattaagattttttatggaatagaaagtgttttattttatgatatttccccccaagattaaaataaatgttagcttttcactgtagacattcagaagtaatcctttcaaatattttggcaaatacagatggcagtatttaaatactgccgtagacctgggttcaaattctgtttctattgctttgtgctacgtgacaaatgaataactcacttaagccttccaagtctccattatctcatctgtaaaatgggggcactaataattcactgatctaattgttgtgaggattcagagaccgtatgtgtaaaataaatactaaaattgaatttctgactgaagtgccaacacagtcaatatcagacaatgtgagaatgagacagacatccagattcaaaatttatcaaggaacaggtgaaatactggttctaaggcccttgaacccctcagctacattaaggaaataataaaaataaaatggatcagaaatgggaaggaaaggtgtctgagaatattttttgaagtagctcgtactatgcagtgagtttgtgctcctacattctagctccaagcctagcaaggcagctctcagaggagggtctcctggagtgcttgctttgcgttcccgaccactggaggatgcagaactggcacccgacacgctgagaaaactttaaagaggtcaagatggaatggaacggaaatgagagcattgggaatggggtacacttccaaggttgaggggacaaaggatccatggaaactcctcgtgggccgagataggccccaagtgcatgacagcaagctgggcaggactgcctagagacaggtcagcccatgtggtaagagtctgtgaggagggagcagaagcatccccctacacagggattaaggttggaagttctagcagaaaagccttggatgaacccaagaatgcaccaggagaggaggaattcgagggatctgccagaccaagagtcccaacatcagttgatgtgccttgtcaaaaagctgtcgaaagataattgcaggaaaaggcagtagccgaacttgccctttgccctactgccagtgactgaccaaagcagagggcagcctcaattctgagctttgattagtaactcagattggtggtttgtaattttaatgaatgttatgttttataatataaaattattatataattaccttaacagtgaacccaaacatttactctaaatcagtacgtggtacaaaaccttaacacaatacattttaaagtgatcggttgcggtaaaaccaaaaaatgatattatagcttgaccacattaggacatcatacttatttaatgtaatgctttcacacataagcccttaacatgatgcatgacatataggcatgcataaatgacataattgataataacgaggatgatggtgacaataacgaaggtaatttattatatctttgaacagagaatacagacagacccaagccataagatagtttttctcacgaaaacactcagttttctacaataccactctattgatgtgcatgattcacacatgtcgcagccaaaagacatttaatgtcattttggatatcattttgggaaactgagttcattgggtttcacaaaaaatatcgggaactacacatgttaaatttttaactgtcaaagggctgttgtgttagagaaagaatggtacactagtacaggcccttatagtgtttgaattctttttacagtcccagaactctaaggggaagccagtggtgagaggcctaaggagtctgtgtattgtgggtaggggagtgtgagtggggcatgaggaggggagagggaggagagaacttcccacagacaggttaggaatattgataactaacatcatactagtcaacctctaataaacttgagatggcaaatgggctctgcttgtactagggtagttatgggaaattggcctaaatattgccaacacctgtcagatccaaatgagccttatgagccctcctagtcctttttatgaacccttgagcatcaaagaatacactggcaaaccttgtgtattgttctgggaattaattgagatgagataccatgtgcaaatctttataacagtacatgagatacgacgaacccttagaaatggttacaataatttctatttagtattactatcattattgttctggtgagatgcttaacctccccaagcctcatgttagtttcatcacctgttacatggtgataagaacagcaacttcatcagtttgtcacaaaaattaaagagaaaatatatgtagctgtcttacctaatgcctagtaaaggtagatgaggatgatggtgatgatgatggtgatagtgatataccctgcctaaggaaatacacaaaagaaatggcagagatgctatttcacccaggtctttctgacgtcaaagactgtattattaattataatgctatatgcttcttgtattgtccttacgaacaaccaaaataattaattgcaaaggccaaaaaggggccacttttaagaatggacacagaaaaccacattcatgtgatgtcaatgggggacgctgattgacctaatgtggttcctaaggagcactggaagtaccctctagtgcatgaaaataaagagccacaacagtgctatgtcattaaaaatgcactttcctgtgtggataaagatggcagatttagcttttgagcatttctaccgtgggagcagcaactttgttttaagcccacccaactttcaagtctatttccatgttgacccatggctcaagaggaattgtacagtacccgggatggaagctggctttcttctggcggggactgtgttattactgaaatccaactagatgagacaattgcctgaaaatgatagtgacattcccttttgggaatatagtaaacaactgtaacattgcccagatgtcagcctgggcccctttgtccattacagatctagatgagtctggttaggaccctcgcatctgcacagaaggtaaaaatctaaggtcctccttcttctggcatttcctgtgaattcctgggaacctctgactattgcttggctttgctacctcatgtactccctatgtataaacaaagtctctgtctccacccaaaaacaaatgctgctcactcaagcacttatgagtttcatcatctaaacatttgggtatcacctagcacctagtattctatcaccttgaagaatttaggccctatcctcaccccctactccagagcaaggcaaaccctgtccctgaattcttgcatagcaggttaaaaatcacactttttgagcctttgatatcttcatttataacccaagtagcctatccccatatttctttaaacaaatccagtaaactcatatttgtataatgtgactctgtctcttattccctcaacctggcacagggaggacatctgtcttgatcaaatgtactcttccaagaatttggcactagaactgctaaacttaaacgagtctttcttgggtgtttgagttgatcaggggtgaaaagccaggtctgagaaggccaagtttaccaatgcttgtgaaagcagagaaaactagtgtgcagagcaggagaggaacaagggaatgatccttgggcagcttttgggaggcagctcacagccccagtagagaccaagtgaggctgcaacactggcttattgctaagagctttcctgagtacgccttttatggagcccagcattgatctttctctgttcttgtccgtgggttcctgtaatgctacatcctgtctccctgtccctttccacatcacttgtcagtctgaatggttttatgctactgtactccaaagacttctgtataagtctcccttcagcaaaaggagggaggtctgagagctaggaaaaccctgaagatttaaatcttacttgaatgagagagatattgtcagatatctgccttctcagatggctgacaaagacagctcttgaacaagaagctcgaattctaagaagacaacgcatcaccactcctggcattccctaaagagggacctgcaccaaaggctcatctctggatgacgatgaggtcttgtgagcagtcacctgacctttgagaactcagctctgagcacctgcaggtacttgctgctccaaggcacaaatgtcaccaccttgaagagctcaagccatctaatcaccatcctgctgggacgtggtaaactgtcagcttatcatgaaaggcatctgggcataggattgaactttccagtagcccacacttggcgtggaaaagctgaagaaagctatttctccctgtgcacaacctccttgtggctgttccaagcatggaagccaaggcctgtggctgtcagagttcagctagtgtgctgggtgagaagaaaccagccccagggctttatgcatctgcaaatgggatgggttgggatctttaaagtttcaccaaaagcagagtcaataggtggcactctcgctaccaatctccatcttgggcctgtgactgaacacaccaataatcttcaccaatgaatccacacaaaggtgcagatttcttttcagtgtgttgctgcaggttgtcactagcagtcaattgagattgatatgagcaacgcaacttctatcttctgagctatggtaaagaaatgtgaaactgggatagctgtgcaggtcaacctcccctgagcagatttctctcatctgtaaaaggaattggtcacaccagacaatccccaagatcacttatacttcctaagttcacgtgattctaatggtgggaagagagatttcaaataatatagttggagggagttgataaaactaaatatagacaacccatggttaatgtcagaaaaattcagaaacaagtaaaatgggtgaaggaatttttaaaaaatgcttttagtagagaataaagaatttacactctgctgaaatactgtgagctgggccaagaaccacagggaagcagagggaagaactcccaaaccaaatgttggatagcaggtcccagataactgcatgggaagggaatgttttaatcccactctcaacttcccgcctccttaaggtaggattaaaacacactgacaaaggctttacagtacggagaacagattgagacaaattctgcaaaacccggggattcaatggatgtggcagaagagaaacagtttcacatctctgtctgtctttcaagtaactgctctaaaattcttgtgtaaggaaaggagtaacaatatatcaagtcttatttctacatactcagaaacttattgtctttgttctgtaccatggcaattgcctcaaaagtggtgtcttttccctgaacctcggctcatccatcccattgaagccaaaggaataattctaatgagcattgtgaactctcctctgcttctcaaaaccctttaatttcacctttcccatcttctggcatggcgttcagggcccttcaaaatgagaaaattaccctgctcttttgtcaggggttacagacggccttccaacccatagtctccttctcttccctttcaagttcaaaaagctacctctgtgtaattgtgtaattggactaaagaagtgagcctagccagtagcagcaggggaaaagcttatgaagttatagcctagacccaggtccacacactgtattaaaccctgtactggggggaattggaaagtgagatgaagcagtgaatggacagaagtggaaacatacacaggaataaaagccataggtgtaagccacgagacagaagaagccaagattggaagaagccagcaggcagagaggagccatctcacagcagtgccagcagacagaatagagcgagggtggctgcactgctgtcacggtggggcaatggattagggagcagtgaacatgtgtatccgagggaaaaaccaagaggatggctcttgagatcccagtatgactccaagaacaaagttcttatactctgtgaggcctcattgctcaacagctgaaagggtttcttgtctgtcttacttcctactggatccttaaaataatctacaaatggaaatagtgttaataaatctctttcccttatatagactaaaaaaaaaagtaacctcaaacagcaacaacaagaaactaataaagatggcctaaccacaggacagcaggaccttccctccacttccggtgccatatcctgctctaacgttaagctcaacatcactcttccctgaatattttctatttaaacaaagtatctgggcaagacaagtgggctgtcagatgtcctgtgggctgaatgtacaaagcctgggcatgtttaaatgtgattatgactttgaatagaatctggtttactgaatgacagcagtaaagatttgtcaagtagcaacatgaaaaggtataaaatggaggggatatgtgttatattcaggattggagagggcagggagctgagtaatagcaactggtcagagatcaagaagaaaagagcaagaatactatttatcttcaaactttgcttagaggttgagtatatttgaaaagaaagtccctgttgagttgtttctgattagggacatttaagtggcttcgtagcaggatgaacaatagcaggcagttgccttcagggtgagatttaaggaggaatactaggaaggttgaggaggagataaatgggtgatgatcctggtaagaaggaaaaggggcaagatcagaagacaatgaagacaatgccagagctcaaaatccttgaaggagttttgggtttgagagggagaacagaggaggaagaaaggacaaagtactgcctgggctgacctagatgtggcccataaataaatcactgtactcagttttatgtagttttgctaggtggccacctgagggcactctatgctacacagctaggaatctttaattttccccctatcaagtaaactatatatatcctcaatttgctgaaggataaacttagctaatgctttaaagaagggtactcattgaaggtgggggccaaaagcaattcttcctccctattttttccctcaactagattaataaatgagcaagactgacctcaatttaaatccctgggtaattgcaaggattaaatacagtaacttcagttaaatctatttagcatttagtaggcacttaataaatattagctccctcccatatatatgcacatcctaacatacaaatttgccaaatacaggaacaagagaaggaacacaaggaggaatcgcaccaaccatttatctctctaaagaaggcagggctcagaagtcctaaaatgaatacaaagctaggctaggaaatcattccagagagcaaatttctgctgctcctttcattgcatgttgctgcttgtacataataaccagagggaatagaacacaaacagctgggaaataaagatgaaagcaaaactgtatcagcaggaagagacacacaaccccctgagaatcgagcggtgtcatgagagataagctgaacaaggccagctgcatggaatttatcttctgagagaaagatcattagattcctacccatttctgatcgtttctattggagtcaaggtggagaatgaaatacatgagccccagttttcaaagttctacactaaagtcctgttcctataatgaaacagagccacggacaaaagaatgcatcactataaaagccaactgtggaattttagatgtctgaaaacaaaagaaattctacttccccttgcaaacggagcaggttgaggtttccccaactcccgggtcctatgcagcatgttttgtggccttctgctgccctctagtgtctttttaaggtatggtaaaacataaggaggataaaaaaaattctcctaataatcctaaccagccaacaatgtgacttcagcccagggctggtaaaacaaacaaaaaaacagtaacattctgaaataaaagcaaaaccaggatttatacaaaaatttaaaagtgagttaaatttggcctcaacatagatcttgcattatttcaggactctgaaataatggcatctctatcagtcaatgcactttaaaaagaaagatgcctgttttctgtgcatctctctcaaatgattactgccttggttggtctgagataggatccagaaatatgaacttcgcaaacaccacaacatgattctcaagtagctaaagttggctgaccttcttttgagaagcaccaaagatggctgcaatgactctcagcaggatggagagtaaatctgatgttttctttaattctttaagaatacaatctattgaccaaaacaggtcaactttcatttttcctgcagctcagtgctacatgattagtatgcaaagaaaatactgctgtccatgtctgagcgaagagttcatgtagaagttctcctttatgaataagtccctctaaattccagcaggcatccaggtggaaaaaagaaaaaaatgcctcgttgctcttgctcacccttcaaatatccctcaaacattactgctgcaaaaaagccttccaggtggtcccagcttggtttcaatgccccactacagctccacagcacctaaaagtgctgtccttctctgtcctataagtgctccctcaacgccagtgttctcatagagacggagagctttgcattgcagaaaccctgttgtcctctttccaaagtcaatgctccataaatactcatgctctggccaatgcccacagccacccttacccaaagtggtgatgatgggagacaagacacatcaggccccacagcaggctgttctcaaactccctctagctgatggtgcacatgataagaggcaccgtgggatgactgttgccatcggatcacatacccaatttgttagctcaaacttggactaattttagaaacttgctcttacttttctgcaatgcagaaggtattattctatactaatgattagccccttcacatgggaaattcacaaacaattttaattgtgctttttaaaaaaacacaagtacactgagagttcattactatatatcttaatactatgtaatatgccatttttaagttcatacttacagtgttttttctttattatgggcaaagcctgttttatcttcagagttatccatcacttaatgctttaataaaaataaactctgaagtacttaggtgtgtaagtacccccaccagaaagaatcctagtctacaatctcctattaccttcacttccatttgttaatgaaaaataagcagatatttacttctcaggagacagtgtcctaactatctgaagaaatacaatccattgtctcacacggcttctctggaccctcaatgtgtagggctgtacatgccacatacttcaaccaattataaactgctttttttttagccattttaatttccaacagagtatccctaatttccagtgaagttcacttatacttactgacgtctcacctacacaaacagggcactttttgctttagctttggtgactcgatcagcacactggattttacaatctctccctttcttttgacaattaccacctgagcccactgtgcaaaacagggggccatgaaaaatacagaagaaaaagctcttcaatcagagggaataaagagaaagaggtttggcctgtaagaagcagttctttgaatttcattttattttttgagccaagctattagatttgtgggtacaaataagatctctttgaagttagcaagaagcccactgtgaaagaagggagacggccattaccacacattttatatgttgagcaaataaagtcccaggattcaaaatatattctgcaattacagaaagcaaaacacttttctttctcctttcaccttgtttagaaagagcatttttctctagaaagagttctgttgaggctgggtgcagtggctcacacctgtaatcctagcattttgggaggctgaggcaggcggatcacctgaggtcaggagttcaagagcagcctgaccaacacggcaaaaacctgtctctactaaaacacaaaattagccgggcgtggtggcgggtgcctgtaatcccagctacttgggaggctgaggcaggagaattgcttgaacctaagaggcagagactgaagtgagccgagatcgtgccactgcactccagcctgggtgacggagcaagactctgtctccaaaaaaaaaaaaaaaaagagagttaaattttctctttccagtttcctaactcccctcctccgattttctacattgagaataacaggctaataatactttctggaatgcctgttgtagtgttaaattagatgggatacacacatatattcttagtgaatcacaaaatgtgattcaaatagaaacttcagtcatttctcttctattattgacatgttttctcagcattttgtcacgtgcatttgagaaatgaagtatcaataaggaagagaagcgtatgttaagactttcttagcagctggtgaaagaagcattccgtgtgtgtgtgtgtgtgtgtgtgtgtgtgtgtgtggtgtgtgtgtgtgtgtgtgtgtgtgtgtgtgtgtgtgtgttgggatgggggatagaattcactgttggagacacagggtttctaagccaggctcaaactcctgttggtcagggacttaggatccaggaaaccttaccaaggaaagaaaactaataagctctataataagctcctatatatctggttccctgactccaaatcaattgaaaactgttgggacttaagtaacttacaaatgcctttttaatatcaagaccaatattatatttttctcactttttacattttaatcatgcatgcttccttaggtgctgcattttttgagctgttattaaaaatacataggttcctaccacattaaaggggagcagaggcttgtgtgttgtattgttaattatgtgctgaaaatgaaattctggtcagtctttgcagaaggtacaaacacacccctaagcaaaggattttccatgtgaagggagaccgtgtggtgcaaggctcgttgctctgacttaacatgcacttactcttgaggtctaagttcctggctccggcggtgatttgcgttgtgatttttgtgtcaatctttacagtgtggaggttgctggtgtcccttgatatcatcacgttgtgccactgattgtcattgagaggtttatttgagcttcctttgatgaggttagcaccatttcccaaatcaaacacgtaatgtaagtacctgggaaaaaaatgaaagaggggaaagtgccatcactttttaaattttgatgaacctaaagtagatattacaaatggagattttttttcaggtggttccatccttactagaagtcatgacaataagttacatagaaactcagctatcaagaaggtaacaaacactattctgtttcagcaaagaggattattcagtgttttaactaaaggaaacagtgaaaattatttttaaaatcatggtctacatttaactttatgaatttggaaagcaatatctttcaccacgcgctccctgtttccacaattccctccatccttttctaacacttaaaatggccattcttctcgttcttgcacttgcttttctcctctatctcgattccctgtttgaggatagggaacgtgtactcatccttcaacatccaggtcagatagccactccctgctccacatgtttttctaatttacctgaagagtctcctgagcctttgaatgtgatcacctcaagaaacatgtcacagtgcttttcttttcttttctgtttatgtgttcatctacaaaccctaggattgtatgttggtgtgtgtgggtatgactcacagtggtagaaatctgagatgtgcatacgggtggcagaagtatatatatttatatccgtgcatggcacctgatgtagcatattgtaaatatacaccaatatttgcagaatgagtgaataaatgctgaaatcaattaaaatacattaaattttcctcacagttttaaggcacgtttacacaaatcttcctttctaaattctctaaggcactctgacatagaatgaagtttgagttaaaagggtttttttgaaatttaaacaatctgagtacttgaattagctatttaatttagcatagactatcctacaaacctgtatcaatgcttttgtggaattacattgtgcatagtcaggaaatgcccatttgaattgtaacattcatgaaatgcctaccataaattagagcccaatgtaatttgtatctcatatgtgaaaatgtaggtgcaaaaaactgtcctaaatccatattaatttaagatacctaagagatgatttaaacaaatgccttcttatttgtcctccacctgctccggcccaccaccttatgagccagtatgttcttcttagtgtatatttttggaaattgacgtccatttttccaaagttttatttatttgctattgaacaggcatgtactcaccctttaactaattcaaccacaataaagtcatttccatccccactgttatatagaattaatccatctagggatgttgtcttgaactggaaaaaaagatgcatagaagtgtaggcttgcaaggtagctaaggcaacatagctcgatttggtcttgaaggtgacaggatctgctatgatgttcctgaagccaaatctggcattaagctcacagtaatctatgtcgccatttttacacaggtcaatgtatgccattccattaaatgtcaagctctgcaggtgtccaatgaagttggaggggacagaagaaagataccgtcgttctgtgatgatgccagtctctatgttatggaactccagcctagtatgatcacctgccatttgacctaaaagagaagataatatatgattattttctgtatctgaaaggcactttcaactttaggctttcataacaatatcacattctaaaatacaaggagccaaatccctccttggtactcagttgcatataggaagaacacttaaatgatgccaaaaggtaagcctagattatataataaaacattcttaggccaggttataatccctgtccaaattttagtcttaacaaaaaatatcctcattaacaaaagtaatggtatcttttaaaggcgaaaaataaacaaattagcaagagagtgagcacatagtaaaagaaggagagggaggaaaaaaggaaagaagggagagtgcacagagagacgcattaggagcagtgactattctcagtcacccaactagaaagtgatacatctcagcctcatggataggtgatgttattccttataaatgttcttccaggaaaaaaaaatgtgactatatattttcctatacccagtagaaagagtggagagttgcagccctttcttccagtaatgaaacatgaaagtgtgtttgaagttaaatatacactattcactttccctcttcgtgctcaataatgaccatagtttttgttcatgctagtcttctaaatacattagaaatcctgttgatttcttcacctatgcctttttttgtccttaagttttctataactaaatcaagcaaaatacactaattgaaagcttgcccaattttgataataccagtaaaattggcccaccatgccccataccacaaggcaaaaatcttctttaaacatcctagggtgaagcttggatgcaaatttatttagcaactgactattccactcagtcctcatttctctctatccctgcatatttccctgtcaaacccattaatagcaaacttagtcccatctttatctccagagtgatcattttacctgtttgcaaggttgaaggtaagataaataagcaaagatgtgaacttgttttctaaatattaaaacacaacataaatataaggtacttgtatcagtaccagtgattcacacccaacatcttgctcttgtctaaataaactgtcagtcactctcttctgcaactaaaaatgctcatttattttgtaatcaagttcttccacgtgctagcttccctgcccgatttgccataattggaaaatgtttcaagttacctctttccatcatccacattattaatgaaaatattaattagagctaatcccagaatcagcccctgagaaaatgcattgaaccttttccccaggggtaatgaagactgaacaaccacctatgtgtgtcccctttggccagtttgacaaatttccatttctttagtcaagacagtaaaatattagacagtgtttaaggaaatatctgtaagtaaaatttagacgtcatgctttttgttgtgcaacaaaaactgtttatatgtttgcttaagtgactttgatgattatacatatatttgtacacaaaactcccctgaactgtacttaaccctatttcattttcaaacactcttttttagtcttgatcctggaaacaacattctactcatccttggcatgttctcttttcagccattggtttgttctgattcccttcctgcaaacatttttaaaacaaaaatgtcaccataaataattgtttcgtctctctctaccctcactaccatgcctcctgattgtctatctgatgcaaaagtactattacatccttgtcaattctggtttctcctgtgacatcatttctatcttctcccccagttcttcttgttcaatgacctcaatattgttctgtggggatctacttctttggtaaaaaataaaattaatccttaattatttccaaatataaagctctaaagacaccagcaacattgaattaagaagctaagtacaatgaagaatatgagaagcttaaaaatcgtctagatgcggtggctcacgcctgtaatcccagcattttgggaggcctaggggggcagatcacctgaggtcaggagtttgagaccagcctggccaacatggtgaaactctgtctctactaaaaatacaaaaattaactgggcgtggtggtgggcgcctgtaatcccagctactcgggaggctgaggcaggagaatcgcttgaacctgggaggcggaggttgcagtgagctgagattgcaccattgccctccagcctgggcaacagagcaagactccatctcaaaaaaaaaaaaaaaaaaagtcatatgggctttgatatccctttgggttgatttttattctatgccacattaaaatatgagccttaactcagtgacccctaccctgatcctgaaactgtcatgtttcatcttaaagtctctattgatgaaacaaccaatagtaaaaaaattctgaaaaaaatatttctaacacttgaaattaaatattacctccagttgtcaagttcttaccagctctaaaagaggaaagaccagttaattccagactaaggagttcagtaataaaaataagacagtatatctgttttcctctctcaaaggaatagaatatgcacacagagcataaataataaaaaggtagtacaacagcattgaagcaactatggcccagttacaagataaaaaaaaaatataattacagtgatggtagatatatttgttcactggggagaattagcccccaaaagccattatttgatgactaagaaaatattaactgattgttgccttctttaaaaaattattttttctcagaattttactccaatgtttaatcctcatcagtaatacagccacttctactactgtagatatttgttgattaaataagaaaaaattataagacttcgaaggggaaagatttttaatgttctaatgatttaaaaatgcaccatccaaggaaaatttggaataagcaaaatgcctctgatcacaatatttaaggtataacagattgacaataatctccaacaagacaacaaccaaaacatgtttcctagatgctgtgtttgtatagaaatctcaatatttccaagtcaaatatttttaccaaaatagatagcaaggttaatatgtgctctgcgttaggttacatttctcatgtcgagcaaaataaccctcccttacatccacttgttaattcacttaaaattgctgattgtgtggtatatgtgtccggtgctagccttggtattggagaaatagtgttgagaggggcagaaagggcccattttctccaaactcatggtctacgggagaaaggcagacaaaagaggttaaggttgtaattaaatctataataacaaaactcagagaaatgttatgaatttgatgaacgaggtattgtgttggtaaatgtgaaatggaagaagatgccaggtttgatatttaagctagatttgaagaattaaaaagagaaagccctgttaagaattggagaaagggaatcaagggtggattccaggaaggggagacggatgaaggaaggcttttggataacaaacagctacagagcatggctggagagctgggaacaagtaggttagtgacccacatgggattgaaaggagcgggagcgccagggtccagatttctcatagtgcttcttacattcagagctaaggaggatttgaagcaggggttaaccatgactcgtgtatgtgtgtgtgtgtgagtgtgtgtgtgtgtgtgtgtgtgtgtttattccctttgtgggtgcaagagattggagagtgaactagggcagttatagtagaaatgaaaatcatcaacaaaaagataatttcacagatataatttccaggatttactaatgatgagcagaatgaaggaagggaatgatgatgcctggctttcaggcttgggtaactggatatatggtgaatgttgttccataaaggacatacacacacagattaaaaaaaaaaaacacaattctagatttttacacagactggatgatgaattgaagcccagtgacttcccacttagggattccacaaaatttgtacaaccccttgtcatctatgacctaggaaatctccttccttgggcttctctgctggcaaatactatcctcacgatcctaggtgaggtgcaaacattcccaagaacagcttgagtatgtactgccctgtgttcaacagataactgacttaatagaattacgataaaacttaaagatatgggaaaatgtaggactttgcatgaagagtctctagtaccttccttgcagaaattcttctcattcagtgatttctgacttgctgtaaaatttaataagaaactcccattgcttctctgatttatgggtggcttcaagtggccactaggatatttgaaggaaatctcaatctaaagctttcattgccacatttggaagccttttatgtactacgtaaatcaagactgaattattcttatgaattgttggctttcatgagatctctgacaaaatagaagaagaaggaaggaagaaaggaagaaagaaaggaaagaaggaaggaaggaaggaaggaaggagggaaaaaataaacaatttacccaaggtatttaaaaaataactcagcatttgatgttaagtcttaggaaggaagaaatgagacaaacagtcgtaaagtaatcctgacttatttgttgccttcaactaagaaggcagaactactataactgccctagttcactctacaatctcttgcacccacaaagggaataaatacacacacacacgcatacccacacacactcagacacacaaacacacacacacacgagtcatggttaacccctgcttcaaatcctccttagctctgaatataagaagtggtacgggaaaagcaattttgaaactattttagatgcattattggattaagcaaatcaataaatgacattactgggagccaggattctcatcttggatgaaaacatatgaaagtatggaatgggaaaaataacgaaacaatgttgtaggtatgaaggtagcagtgtaaactcacactttataaaatgtgcattatgtgtatgtttatatgtacatataatgtatatgtctgtgtgtagatacatttacatgtatgtttgggtgtaggtatatatacttgaatacatttcttatctctgtctgctgaaggggtcaagtagcaatgataccccagcagcactgaggtcacctaccacccaaatcttggtctgtatcattcctcactaaatggaaattaaatggctaattctaggggcgaagtgtggtagacaaaagttgtacctggaacatcctgttattccgagaagtaagaaaagggccaggcacggtggctcatgtctgtaatcccggtactttgggaggccaatatgggtggatcacctgaggtcaagaattcaagacaagcctggccaacatggtgaaacctcatctctactaaaactacaaaaattagctgggcatgatagcatgtgcctgtaatcccagctacttgggaagctgagacaggagaatcacttgaatgtaggaggcggaggctgcagtgagctgagatcactccactgcactctaacctgggtgacagaatgagactccatctcaaaaaaacaaaaaaaaaaagaaagaaagaaaaaaataagaaagcgctaaaaaaataattggaatgaaggcatgtcatgagatcatagaggccaagttaatgaaactcacactggcaaaaattgaaaaacatttgcgcaccaaaatcataagatagcgtaattatgaagtattataaaaacatagcaatagtgggtctacaacaataagaaaaaaaggaagggaggaagaaagaaaaaaagagaaatgaaaagaaagaaaaattaaaaaaaaaataggaaagaagggagagagaaggaagagcccttgcttacagcagaatgctaagcattgactgtaaatgtggaaggagtgctggagtttgaaaataatcattttttgtaactctcagagtaaagattgaatcaagcaaaactctgcaatagatactaaatctagggcaaaattttgatgagttacaggatatttacatggtcttaatgtctccccacagacagtttattagttgaaagggagaaaacgtagtaattatacaatggagaaactggacaacatgttgaccaagtggtcaaattaaatcaccaaagacatgggcagcgtatgccccagatgggatactgtatagaggccataacatcaacaacgcggtatttcacccaagaatgtaaaatatacattcagtcatgaggaaatatcagataagcacaaactggtgactttatattaatacaaagcaggaagagattatatacttcaacaatgttaatgtgatgaaaaacaaataaagtttatggaaatgttctagattaaaggaggctaaagaaacatgacaactaaaaaaaaaaaaaaaaaaaaatagctggccctagactgcgcactgtgctggaggggaaaaatgcttattgcgtattgataacattgaatcaactgacaaagctggaatatggattacagattagaaaaataaattgttatctatgcaaactttactgaagtcagtggcttttatttcttaggcaaggggatattcccatttttaaaaaatacatgctgaagtatttcgggttaaagggacactgtgtatgtaacttaccctcaactggctaagagaaaagttagagagagaagagacagtgagagagcacaaatgtcaagacaaactggcttaaatgttcacagtagtaaaggtataagggtattctttgtattatttttggaactttttataaatttgaaattattttgaaataactttctaaaatacatttcttaaaaaaaatgtttttcaccattcttttgttttcatcctgctacatccaccgcagtacaggacttattactttacaccctagaccatccaaaacactgccacagaattaatttcgctcaaaacatattttctccacttactcttcagtttaagtgcagtgacttccaatttcctgaaagtctacgaaatataaactacttcatctagaccatcaagtcattggcctcaaaaggccattctagcaccatgcacttgcaagaagcaaaataaagcttcttagttccctgaaaattattctagccccaccagcatcattctttcttgtctggaattctttcttgcattatcctttctttaaagcctagatcaaacattatcaattgctttaaacaatacccaaaaccaagttccttaacttctcttctgaactccaagactataaagtactcaagtcaaccattcagtagttcatctgttactctatgtaacatatcaccctctataataatctgtgttttatatgtatgtatgtatttgccttataatatcatgcattgtctgataaaatactttctatagagccatacacttactagatattgacaaatataaagcaagggacggtaagtcaaaaaccaacaaaccaaaacacacaaaacaaaaaaataaacgtaggttctctcctcagatctcgtaacacattccaataaaacataattcacttatcctcttcgagtgccacttacctcatctacaaaatgggaatatgtgtgtcctatctacttcataggactctaatattcaagaggcactcagagattttaaaatgttctgttgtagttctggcatgatcttgccgttggcagctgcctcttcccaaactcttacatgtgaccttagatactaactgttcatttccatgccttttgataaaacccagttgtccaaactgtggatgctgatctaagaaacaattcattcctcttcaaagaactgtcctagaccaaaactaattgaactccaatgatactcttctgccctgtaaattttttttaccttcctttcctaagttaaggaacgattgtttcaaaagtttaaaatcctgtaggtaatatatccacattgacacagttgactgttctctgggcatggggacctccttcgaattgaatgaacagacacgtatccactgtacaaggaccattttgtgctttttaccagaataattaacatggctatctctctgaaaaaagaaaaagcagctaatatcccagtgggtcacgtgcttggagttgttttcaaagtaaataaaggcaaaaggatttttcttccatgaggctttcctatgtttctagggtggacctgcatacagctcacctcaggaatctaaaaatgggggttgaacttgacatccttaatattagaatttaaccaactgagctgagtggccaaaaataatctattatagcttaaaatgaaaaagtgtttcatctgaaagccagatagataaacgccagtatatctatcatcttacctagaagttaaaaggtaaaacttgcagttgttcattgccaaaatatatacaaaacaaagaaactcaacagaaattggcatctaaacatgactgcaatatttgatgaggcaccaagatatttatcaggccacaaaagaaaatatattataatttcttcttgcactattaaagggccaagaatatgacataaaatgtgtcatttttgaggaaaaacacctaacagactgcttatttaataaaatagttactagaaaaaaatagaataaaaatggattgtgtgaatacatttcaagttgtgtaccagccttggtgtgcaaaaccacctgcaagaaatgagagtcaaaagcgttagcataggaaaagacaatgggacagaggtgtttacctgtcatggcctgttggtcatccactgttaactttaaactttttccacgccgaactacacgcactgtgtgccactcgttatcattgaggttatagccagcaaaaagagtctcgggacctttgcctgtagaatatgccaaacagtcattatggacactcagaatcagtcaagcaaatgaacctcacagagagtgagagaaagagacaaggggggaaggtgagggagagagaggagagaaagaagaaaggaagaaagagagagaggagggagagaaaggaaacagagaagaggcgggctggaccaattttcaagcccattagagtcatagcaagcaaggaaaatgacaacttttacaaacattcaggtgtgaccatttaagaatctttaatcctacgcattgatccataacaagtgaattaacctgctgtcataaataggcacagtcaatacagcactgggaacccacccaaatttacacacacatttttaaaaataaattctctgatttttagttaccactttcctgctaacaaagtgtctagccatcatgtaacctctgagctctagaagacatctgactgtagcccattagctaatcgttttcagtgagataagtctcccagtagactctgggagaaggtactatcttgtgtgatggcggctattccgctcttatacctggtacctccagtgctcaacacgttcttaggttctttagcctcctaaatttatggaatgttgagtctaaaaaacacatcgaaataaaccttacaactaattgacctgtacgtcacaaatctgtctgtgtgtggcagaggcacttctggcaggtgtaggtataagtattgactcacagtaagtggaccgaagaaaaggaaagaaaaaaaaaaaataggcacagccaataaagggccaactgttgagcatgaaggaaaagtagtgatattaaacaacagtagagagcaagggattaccagtgggcatcgagtgggcaagaagtataactgggaaagtaactgctagtgaatctatataaacctatgcaaatgaaatttaaatggactcagcagagacatattatttcagaaaggtgtttggtagaaattattgaaatgattaagttagactatatccgtcacctcaaaaaaaaaaaaaaaaaaaagcaagggaaaatgcttttaacataaccagatatttttatttaaaaaataagtatttctactaatctgacattatgagtcattgagaaaaaataacattaaagatacattgtttggtaatgaattttttccctggtgtttttttaagtatggaaacatgctggtacattaaaataatgaagggcattatatcattgagtttcatgtctttcaacgaattgagaatcaggattggagttcacaatttgtttaaccaaattctgccagcaaaaccaattaatgcccaaggatcacgggaggatatatgagaaagtaaagatacaggccaaggagaagaagaaaaaaaaagaggagagcaagagagatcgagtaagagacagagaaccaagtaaaataaacctcagttttccatccacatgagatcattgttttctttcagaactacaccctatccaccagcctattgatttctctcttatggtgctactaataattcaagtgttgtatccttggctggtgtatctcaggttagaaatgagccagtgatatgagctaaattttaaaggatgaattgcctcagttatttatatctgtttgtatctttagagaaattaaattacaactccagatacatgaatttaaaactattctagatataacagttttaagagattgatggctaaataactagagaaagcctgctagtccagcaactgcaaaaatactttgagatcaaatgttgaaagcaagttccaggatgaaaaaaaaaaaactctttctaaattcaatagtgaagaaagaagtgtttaataactctgcagcatcttagcatcctgctggcagtaagggtcatctttcattttgatccttgaaaagagaacatatcattttagagctatttttatagggaactttttttttttgttagaaatatgtgcttttgaagcagcttcacttctattcttttcttttttaaatatattttgtcaaggaaaggaagcatacataagggtgatatcatcgttataccccatccttggcttgatcttgcagtaaagtcataatgcttaatctatgcaacaactatttccataacaacaggcataaaatccaattaaaaataaccctttggttcataaaaatctctgtgcgccaacttctagctcctttcatgcattattaaaattgtgaacagattgattttagaagataaggtttttaaaaaggcacttaatagtctcacttcaacacaatgttacccatgcaacatgaagtgtaatggaaagtgcactagactgggagttaagaattgcagttgctagatcatgatttcctactaaaaaagaagttgggggttgctgagtgcttattatgtagcaggcactttgtctgttgtcttgcttcacctttacattattaatctgcagatgtgaaactgaaggcctataaagctacaactacttgtcgccaggtcacacagctaaaaagtggtagaaccaagtttcatccttggcctgacctactcaaagcctgcatgcttttccctgcattattcagcctcgtagttatgagaatctttggctaacaacttaatttctcactttccccatattggaacaaaggagatggaaaagatcctctttgtggtgactcccagcttgccctacagaatgatcacactgctagcaaatcctacacaccctctgcacaagtcctggtggaagcaaatctctaagtaatacaatgtctatctagggatgctgaaatgactgttcctaaagatatgacacagaagaagggacatcattttaggacctgtctccacccacaatcagcaatttgctaacacactcaacttctggtggtctcagcattcccatccataaagtgaggagagtttccagctgatctttacagttcctttagaatttcactttctcacagaatttaacatatacaaacttgttaaagaaagatggtttaactgttgaaattttgaatttgagagtttgtcctcttgctataattttaatggcaaaattatagtaacttcaagctgttaatgacctttcaggatttcctttcctttgggggatatcaaaccatgcatcagttgtgccaacgtctttctccctgcatcaatgtattacagacttaatgtgtgtgtccctcagaattcactatgttgaatttctaacccacaaagtgatggtatgagaaggtggggccttcaagatatgattaggtttagataagggtggagtcccatgatgggatagggccctcacaagaagtggaacaaacaccagagcgtcccctctgccatgtgaggatacaaagagaaggtggctgcctaccagccaggaagaaggccctcaccaagagccaaatctgctgacacttcaatctttgacttcaagccttcaaaaaactgaggtgaaaaaaaaattctgttgtttaagccatccaatctatggtattctgttgtaacagcccaagaagactaacacagtgggcaatattttaaagacttttaagaaagtctatagctggctgggcatggtggctctcgtctgtaatcccagcattttgtgaagttgaggcgggagaatcacgaggtcaggagtttgagaccagcctggccaacagggtgaaaccctctctctactaaaaatacaaaaaatagctgggtgtagtggcaggaacccgtaatcccagctactcaggaggctgaggcaggagaattgcttgaacccaggaggcggaggttgcagtgagccgagatctcgccattgcactccagcctggatgacagagagagactccatctcaaaaaaaaaaaaaaaaaaaaaaaaaaaaccacaaaagaaaagaaagaaagaaaagaaagaccatagccttatgtctattaaaagacatcattccttatgttttgtagggagttttgatttgtttgtaattttacacttgatttttactgtaacatattatttaagccagatatattaatttttcattttatagttaaagaagcagatttaaaagtgttgagcgaattattaagtctcaaaggcagtaagaagtagagagaagactgagattttgaaattttctattttcattaaaatgtgttttccacagaaaatgatctgcaagtagtgtaagaggtacaacgggactgaatgcccccagctaatatttcaccagaccaggtcagaattcagctctacaggctaatgttatattaaagaattttagaactaggagggacatgagaagtgtagaatttcaatcatcatctacaaataagaaacatgaagtgcaaagacattagatgacgtccccattgtcacaactgttaaattaagaagcataggtctctagactctcagtctaacaagcttttttttttttaattattattaagacagaatctcgctctgttgctcaggctagagtgcagtggtgcaatctcggctcactgcaacctctgcctcccaggttcaagtgactctcctgcctcagcctcccagggagctgggattacaggcacccactaccatgcccagctaatttttgtattttaatagacatggagtttcaccatgttcgaggccagtctggtctcgaactcctgatctctgccagccttggcctaccaaagtgctggaattacaggtgcggaccacagtgcgcccagccctaacaaacttttaaaaaattattctgttcattagacaatgctgatttagaatgaatttctcaaggcacaccaaaatctgagtctgagtttaataagtctgtcagtgcttgtcaacagagtttgacctaatctatggtacaacagccaaattttttggctggtgatattcactgggtttgctggtgaccctgtagctaaaacctattgataacagatggaagtagaagcagtaaacatttcagttttccttaattcagtgtaaattgagtgttcttccacaacctacccatccataaattcaaggtgtctctaagattaactcctaagaagggctggagttaaccctaacttgaggcatggtaccgacagaggaaaatgtgtgttagcaagtatatgtgtgtatgtgggtgtgtgtgtgtgagagggatagagagagagacacacactcaaaagatggtagatttttggccattttagtaaccacatttgctaatgacttttacttccattttcacatcaacatgattcttaggtttctttaaatattagtctcagaacaaaggaaatttcatgctataatttgtagttatgggaggtaatggtaaagaaaattggattttgtccccagtctgtcatcaactaattatgttaccttgaagacgacatgtattctctctattcctatttttatctgtaaaatgataatcccatataaaagcatattaaaaaaaaaactttcctacagccaacttcaaactattgtcattcttagaaggaccaaaactacctcgcggctacatgaaagagtgcaatgttatagtgaatatctctaatggtgcaagctttttatttttattattactgttactaatttcatcacttttgttttggcacagtaggcagagagcagaccaagccttaaagaggctcttctacccaagaattactacactcaagtgaagccagaggacaatattaatacgtgctagaaaatgtgtttattattttatatagtcaaattttaatggtgataacttttttcttttgacaacatgtaattatgttacaactatttttgttaatcactataaattttgttaatcactataaattatatttgaaagtactgaagcacagactactaagtgaatgtatttaagaaagaaagaatagcattcaagggatgcatagctatgctacttagtccagctctccttttacagacatctccatgggaggttagttgccttgcctctgtcttccttgttattggcaggatgaaactaatgcctgggtcttgaacttatttaggacctaacatgcattacctaattgtctggccaaagtcagagagggtaaacattctttgacctttgcatatcattcctttccctatttatatttttacatattcaaaaaatattgttctaaatacattttaaacaaacccacctgctttggatagcagaatcagtacaatttacaaagaacctcactgccatacacagtttcggaagcagtgatgaaacgggtgtgttttttcacatacctctttacatttggttcaaatgtagattctcatatatttcaggggagatctgcatgcatcataagaaaagcttgaacttggttgagagttatataaacttggatttgaaagcaggtattgcattttctggttgcttaggcttgggtatgttagcttctttgagctttccttccatcatctataaatgtgagataataatgcctaccttatttcatagatttgttgtaaggactaagggatataacaaatctaatgtgtttggtgctttgcactttgtgtaatctcaatgaatattaatttcctttctctcctttttatggaaaataagttaagtaacagtgcatgagttctgcaaaccaccaaaggatctaccattaaaaaatggttgacagtcaaatacactatacactatataaaaatgtatattgaaagaaacatccacaatttttatttgaacacgcacactgcagtctagttttttgaaattaggcctcccaaagtcaaattttttggaacagttgccattttaacctgagatttcacagtatttgtgtttggttatttaattcctaagcattcaccctgaatataaaaataaatgtaaaatacacttgcaagggaacctgaaatagatcaataacgacatgcttaatcttgctgggttaaaataagatgtacatgatactaaatttggatgctttttgctacaaagccttctgtgcaaatatcttgtgaacaatttatactggtttatgaatgtggagggaaaatatagtgaagagaaatagagaagaataaaacaaagctgagaccctttcaagcaatggaagcaaagacctctaagagacaaaactggcagatgcctctggaactgaaaggtggatgtagctgtacagaaacttgaaaaaaaacaaaaacaaaaacccatagcagttatatttggagttttaaactcttagatgtatgtgccccaagtgtaaactcattgcatctctacacaccctttaggtagctttctccctctagtggtgcatatattttaaagaggttaactacataaatgaactatctttatggtgtaccctgcttctggtatatatatactctggtacagtgcaaaccaattggttctaaagttcactttatttgtctaacatattcattgtaatttctactttaaaattctacctagttatttcagtggttaatctgacttactcaattaaaccatttatcgagcatgaagattttgatgggtatttctgcaaaaccatcacctaacaaattgcacagatgatggacaggcaggaattttttaaaaatactagaatcaccttatatgtataaattggttctatatttatacatgattgttcaatatatttagacctacagcacctggtaattgaattaggaagagaagttacagtaccatagcatctgagaattataaaattttaaaactgaatggtccatattgtgtctgttgtttatcccatttagctactcatttattctgggttccatggcacccatatgctattaattttgtttaaaatttattttgtgccaaataccgatctcagcattgggaatatccgagttacagtcaaaggaacttacattctaataggtcagaagtcaaaacactttttctgtaaagggccagacagtaaatttatttgactttgccgaccatgtgttcaccattgcaactcttcaactttactattgcaatgtaaaagcaagcatagaatgtatgtaaacaaatggagtggctgtgtttcagtaaagcttcattaaaacagggagctagcttgagagctatagtgttcaagaccctgtaagataaacacgtatagataatttaaacgtttcccataaattctgcattgcatattaaagaataacagaaacatactcaagaatttaagtgcgaggaaacctgagttttagattcgatattgccactaactgtaacataaccttaaaaatactaattctcctaacttttttactgctgtttgttttcttaagaaacaactaaaatcaatttttaaaggctttaagcccgggctccccaccccccaggccacagacaggtaccagcctgttaggaagcatgccgcacagcaggaggtgggcagcaggcaagccagagaagcttcatctgtatttacagccgctctccattactcacatcaccatctgagctccacctcatgtcagatcagcagtgacaaccgattctcacaggaatgcaaaccctattgtgaactgcacatgcaagggatctaggtttcatgctccttaggagaatctaatgcctgataatcagtcactgtctcccattaccctcagatgagactctctagttgctggtaaacaacctctagttttactgattctaccttatggtgagatgtataatgatttcattatatattacaatgtaatagtaatagaaataaggtggatgatacatgtagtgaaattcaattatcctgaaatcactcccgtctgtggtaaaattgtcttccatgaaaccagtccctcatgccaaaaagtttggagaccactgctttaaatgacacaaatcaattgcaaagtccttctacttataaaatctaggataaattaggttcctttccttttctgcaaatttagaatagaaacattcattaaatgcttggggtgtgtgtgtgtgtgtgtgtgtgtgtgtgtgtgtgtgtgtgtctgcatgcacctttgttaaaaatttggttattaggtttctacgtatatcaacttttccaggtactaacaagttttatttggcagttgactttggggactgtagtctctggggtgaggcaggaccttgtgagaagctggaagcaagccttgtcattgtgacaatgatgagaagatggaagcaggagctaccactgcttgatgcctgagtcatagttgctggcagcagtacttcctacctacaaatgatgagaggatatgtttcccaggttgtaattatgacaccttcagcctactatttgactttcccattactttctggttttaaagtaatctgtcctccagttaaaaaaattcaaaggagattaactcctcattacaggtttctattttatccttctcaatttttaggtattgagttgtgagtgaaacctgtttgttttaatttttcacaagaatcagctagaacattcaattacaaattaaatttagacatgtaaatggcacttctaaattttcctttttctgcctcttaacattactagaggcaggatgagccacataatttgagagtccattgcaaataaaaatgtggagtccttattcaaaattaagaatttcaagatggtagcagtggagcattaacccaagcacaacacaagctcagcatatggcacggtgtgactgcataagttgtatgctgttgaagccagttctttttaggagtataagttttgtgcttatttatttttgatgcttcctttagtagattctacattcaggaatgagcagacaaggctggaggcaaaattcttcatttatctatgtgagaagcatagttgagtcaccttccccagagtatccacacttaatgacatggtctctggggtatcagagaagctgtctcaggcttgttttgctggccaggcctggtgccaatcatgaactgggcttggtgatacaccaataaccctcagaaccaggaagcaaaactacctgctgacccatgtaactcctttctcttttccttctctattcctcctcaagtgctcctcaatttagccaaggatatacccttgagaactattcagaatgtcccataaagagatgcttgcctccttttttttaataagcaaagagatagagtcctaaggacagacacatttctttatgctaaaaatactagaaatactcatcccagttaaaaagtactttgactaaatgatataaagtcagacattcagcttgatgtttgtttttcaaaaatgaacactaataacagagaaagacattttataaactttaaaaaatccactggagaaattaaatagtcatgtgctgaccaactatattgcatttattttttgacccacacagactgttgagttttatcctggttctacaagttattagctgtgtgaccttgagcaaccttcttactttctgcatgcctcagtatcctcatatatctcataagctaatactagaaacaatgtaaatgggtttcatgcatcttaataactcaaaactacttttaatcaaaggtttaatgcatcttaataacgcaagaagcttaccataatctgatttatggtaagctttcaattatagtagtgataaaagtaactatcatcagtattatgttgtcatttttatcttctcctcaatgagtttaaaatctcagagaaaatatgatatagctcagtgccttgaacataacggcaattcactaagtatttgttgaatgggtttatttgtgtaaactttgtgggacttttttttaaatggtagatgaaataccccttgatattaaattaagccaagtagttgatgaaaagtaactccatcttttaatgcctccattcactaagaaaggtaaatataaagaaaactctgtcctcctgttttcatatttagcaggatggaatttggtaacccctacagttggagaacttgagtaactcagttatctggataactatttggacagctttttcgctcagttacattgaaaataaacttcatgatgcatacagcctagtggaacaaaatgacctaaggttagcagtgaataacttccgagtccaaaggaaatagttggcttagaaattgggggaactcaaaacttactgagtatttaattataaaaaaacacagatcttgtcctcaagtggatgtgaccttggagagttgttggaaacaccctccagagacttttctgccattttcctaaatgatagcaaacttattctattatctacaaaataaatttcagtatttctcgatgcttcacctcctgctctatttcttctggcctataaatatcattgcctatgcaaacgaataaacaaggttaaaatcacctacttcatctactaagaaacattaagcctctgtagttttgtcattgattgtacccatttatgacagacaaggataaatatctcttatgtaaatatatttcaatgcgaaaaacatacattttaagaattataatttactttttaagaagagaattacatttacaacacagtaaaaatgaacacaaattaaataaatatatttctagaaaaaatgttctaaaactagcaatctttaaatctaatctagctcaactggcaagtttaagaagtataataaaataagcctaatacaatgaaagtaacaattcagactgtgattttatttttttcaaaaggtcaattccaagggatgcttatcacataacaggacagctagcagatataaaattgagtactaaatagttcaatttgcttttgagtaagcattaaaaactgaaaatgtattcagtgtttgtgtagtgttaaagaaaagggttatactgatttatagtaatactcatttaatgtattttctgcaatacatacacaatgccaagttgtctgaataaaaaaaaatcaaaaagcatatgggtcctgagcatttggatatttacaaaatgtaaactgatattccataaacgaagccatggattatagtcacaaatgcatttttttaaaattaaatatatcattccatgtctaaatacaccactgtaatagttatagcatttttttaatgaggtcaagaaggatgtacattttttcataattcaagatcaatgaatttaccttttactttccatttcttcttaacataaggatagctgaatattattaagtacatgactgaattcacaaaatttagttcatcctcagtatttttgagatattctagtataaactttttccaaaagtaagaagcatattagagaaaaaaaccctaagtttctgcctttattaagtttatttattttttcttcctttctttttactgggaagtcattataatgcgtagaaatctatttctcagtattgtcaactttatggacctatttgcttaaagaaaacaaattctaagaaatgtgacaattgatgaatggtagcatctcgtgtcttgctttctttttgtttctttacataatgattgttcaaatgaaggctatggacaaactgtacatgattattaatgcattcatcatgtgaacattcgaatgcaatatattttttctaagcaatgatataattattagctaaacccttctttatttgaattttaagattttaatgacagtgctaacttaattgttttctttaatcatcactggattatttattaagctagcttttagtcagtggcttgaattctatgattctctttgaccatttattttagtaattgaaaaatattggaattaattctttgaagttatctttgggcaaatgtcttctgaaatgaatggctcaccttatgctccaggaaatgttctaaaatggcaattgtccaactataacaataacttagcaattaaatcttaggccaaattaacttggtttatctgaagagacagtgtgtgaaggttccttggaactggtcaaaccactgatagaaatgttgagttatgtctctgtgcctgtttctggttgatcttcctaaggtaagattatgttagattttctattagtaggttacagtcaaggacgataacttatactaacacatctagaagcatcttctcatgtgtggctattcaaatctggtttatttctcatgatcttgttcacagatgctcccaaccagttatcatctgagaaaactgagatcactgaagaatcatggtataatttccattggtagacatatttttcctccctattatatgttacttcaactggctcagtgacctggaattgctttatataaccttggcataaaatctaagagaaacaatagattacatttaaaaatattgtatgttttaatcaaagacaggacataatgtttacaagatgttgctaaaattagagaacggggtgcaaaacattcctataccatggctctatatttttaaagaagcacatattataccatgtgttatatattaagtacataatgtgccaagtattatgtgctataagggcatttaagacattaataaaacttttctgtgaaaattgaaatcctaggctacttttatgtattttctgtttcctttagcctccaaatatgaatactatttctgattaggaacaaaatgttgttctgaaagatattcattctattttgagagtcaaaattagtaggaaatttagcctgtaaattaatttaaaatgtacatgatgtattacaaatatatgatctagtgtagctttatcctaaatattggtgggattggtttaaattatattttacttttacccacttttgattttttaatcacaatagcaaagaaaaaacattgtagaaattatagatgatgaatagaaaaaaaaactaaaaattacctcaatctcaccagcagatataaacatttagagggatatacttccagaaacataatagaaaagcaattttgttatgaaggtcccttgcctgttccataattgataactcaaaaaaaataggagatgctgattacttcttcactgcctattggctgaactaattttacttaattgattgcataaagaatttcttgattaccaatatattatttttagcagtataaaatttctcagttgatttattaaacagaatttattttatggggtttctacaatttttatttattgtactcatcataatggtctaactccatatttatctgcctatttcaacactattaggtgaatatgtctgactactaagagaacacctgcattatttgatttaaaaatttcttttttattttctttactagaaacttataattcatgaaaaatctgtaaaaacaactttaagacatgtcattacagtatgtttgttctataatattttggttttaatttttacatgcataaactacttcctttgcgcctactgaaatgtaaaacattttagaattctttaagttgtatagaagttcatacttatttacactggaaacttcctggttccaaagctggttgatttctccatgtatttgaaaatttaatgggtgcacttcactagaaacctacattcttcgtaagcaacatttaaaagggattttgttaactcatatcttaaatcacgcatttcaaaagcaattttaaccataacatttatctgtagaaaaaggcaattgtctttgaaatttaattaatttcaatagtactatgcataaaatatttcgagtctgtatttagactgatatcctgggaagtgcagttggagagtgaagaatttccacaattgtatgaatgatgaactcaaagaacaagtaataataaacaatccaattttaagtacattaaaaataaagtaatttagccttttagtatttcttattcatcttcaggaaaactgttttcataatgcatttcttatccatcttgctttttgctcacattgttaataagtaaaagaagtggataagagttctgagcacacaaaacatttcaatctccaaattctttgaccgtccccatgatttaaagagccttgcccacttgacttatgtaccacatgttagccagtaatctgttgaacagattgtaattctcatgggtattttatagctaaactgaaaacaattttcagtcagacaacatatagaaaagatgcttgtgtagaaagcttgctgctcctacatctgctctgaggagagtgtatcatgtggcctctattctaatgacagctatttggatcaccagtggatccaattggatccagcaactggatcatctgccaccaaaactaagatctggtgagtagcttatggggcgacctgaactgaaagatttgtccaacgggacaaggataagtaatagattcactagattctctttctagaaaagtcgaatatacaacatatagagagtatacagccagtgaaagggatgacagaaagaaagagagagagcagaaaggaagaaaaggagggaggaaggcagagaagaatacagtaaaggaaggaagagaagaaactcaaaacaatggaggaagtggggtatgtttagaagcagctcttcataacgacaacaaataaaaacatctggccaacatgctgtgttctcttagatttggggatatttgtataaaagaaactcccttttcacagaaactaataagagaatatcaagtttagaatgtttcttctaaaactttcttggattttataatactttttacctaggcaattgttataatgccgactctcaacaattgaagagaatttgatcaatttggtcaacactcaagaatgttgcattactttgagagtctctgcagtatcaataatgcttaacgtgaataaattaataactgtgcttggtttcaacatgcattcttaaactgcacaagagtagtttttagaatatcacagcattttatatttgcatataagcaatcagtagattaatcattcactaaaatagaccaaagcaatctacttttcaaccactcacagtatcattctgttgcctaatccatgtagtcatctaaatatgcaatgaaagctgtattcttctttacaattctcataagtttaaacatgtggataatttaaatgggcttccatttattcatttatttttattcattttttttttttttttttttttttttttttgagaggagtcttgctctctcacccaggctggagtgcaatggcgcaaccttggctcagtgcaacctccgcctgccaggttcaagcaattctcctgcctcagcctcccaagtagctgggattataggcacctgccactatgccctgctagtttttttgtatttttagtagagacggggtttcaccatgctggtcaggctggtcctagaactcctgacctcaggtgatccacccgcctcagcctcccaaactgctgggattacaggcgtgagccacagcacccagcctcaatttcgatattattctaaagactcattgccatgtgccaatacactgcctgtttttatttgttttctgtcagaaatctatgttcattctttacattttacatgcaattttttttgatttttgctgaaaataataatttataaactttcttttcattcccttcacatatactttaagtaaaacaacacagaaacaacaacaaaaaacaacgagacttctgttttctttatttatactttgaacttcccttattccttgagcagcttctatcctaggcaggtggatagcaccagtcactgacaggcaatgactggcagaactccacaaatcaagtgactgctgtgtgaaggcagaggcgaaagactcccttttacagttttctgctctcaggcatcaagcagcgactctaaactgaatatttactttatgttaacaagctccagcccctagaaatttcctcatatctttttaagtagcttctcaaatggcagcctgatcaaagcaatctaatatggcttaagtgccagtggttgacattttgcattcttttattgctttccatttttatctacataaaaattggtgataactaatatccatttgatcttttcattctggtaataaaatggtaatacaaagatcttattatctactccagacatccatcaaagtacatttttcaaaaatatactatgtgaagtgtttcttccctatacccaagtcaaaagcgaggtcaagtacttgtccttagatgccccttctctccaatacttgggcactggactgcaaataggaattgaacttcagcccttgatgctttgttcacactaatgttatatgtaattgtgttgtctctgcctcttaaatacactattttctgtgagaagccaaaagtacttggaaggtctgcttaaatattttttttaactccagagtttttattcttctaagaagacaagaaaaaagataacggaagaaacaatactggaaatgaagaagtaagaagagtgaatcttaatagaaagaaaggaagtgcaggtaggtgggagaacagacaaatgtaataaggcataaagaaagccacataatgcaaacaaaacaagccccagagatcatgagtttattaaatctatttttatatggatgcagaagtgtccctgaggacgggtgtggtggctcacgcctgtaatcccagcactttgggaggccaaggcagacagatcacctgaggtcaggagttcgagacgagcccggccaacatggcaaaaccccatctctactaaaaatacaaaaattagccaggcatgctggtgcacgcctgtagttccagctacttggaaggctgaggtaggagaactgcttgaatctgggaggcggaggtttcagagagctgagattgcaccactgcactccagcctggatgagagagcaagagtccatctcataaataaataaataaataaataaataaataaataaataaataaaataaaataaacgaagtgtccctaagccttccagtgaacaagaaggtcattccgtaattatgccattgatttggaaaaacaaaaagaatagaaagcataagaaaaccaagaaacacaaaaggctccctgaatccactgaatccactgcatatttaaagtagttactgatatgacaattaggacttacctatagttgataggagcaagtttagttttcaaaatttcaatgtatttacacctcaaaagattataggtctaacgatttttaaggttaccagaagaagagagaaagaaaaaaatggcactacttaatcatgcagtacatcacaaaaaaggccaaattttcagaaaaaaaatacatagaaacacatagcctaatgagtttggatgtatcgtttggaattattgggcaccaaacttgaaattgagaccatcattataactctgagattgacattaggctatgtgctttggcagatataaagaatgcagaatgagactaatgtcctgtacagaacctactaacaatgcacttgagaaaatttcacaagcaatagaaaattctttttgcattctttatcatttttaaatgacttactaaagtcatttaatactatggaccaggcaagagactgtaaaacagtcatcttctcatgcaaataattcacgtgctagtcacaaaagcaccttgttcaatatgatttaaggtttcaacaatgatttgttaatatttagtttttgttagtacagatttctttgatgagttttaaaatagcctacaatttgtgttccttcgttaattcagatagttttttcctttttatgttaaaagaatgtgactgtacagtcccttcccatctacccttattaaagtatccttcactgtctaagaaagaaagaggaggcaagggtaatctgattgtccttctattcctatcctggacagaggagagtggtgagccatggataattcatttctgtgctcaccttgcagcccatggatttggaaacactgaccttaatctaatcccaaattgtagataaacatattttagcaatggtataagctaatgagcatcaataaactgagactcgtctgggattgtgtgcagtcacactctgtaatctgcaagatcaaaacatacatttggcagtgaaatggccattattcagagagacagctttttaaagaaagtaccctatctatagctgaaaataagcttttttatttttaaatgaaaagaggctctcttcttccatttaaggatgcttgacagcttttcttcccgggggggaaatggtagcaataaggaatttgacagagataatacttggaattcagatctggcctttctcagaggaaattttaacaaagggctgtgccctaacatgtccatggaaaactctgtcactgcatctaaactactgacacaagagtggctgaaaaagaaacattcattcaggtttgaatacatgtagctggaccctctaccctcctcacctcccacccatttttcactggcaaagattagatagtctgacactatgtatattttccatataaagtacaaatgctgtaaacttggcggtggggtagggaaagagaaaatgactataggaaacagcagcacaattttaagtaaaagtagaaaagtgtttctggggaagtttccattcaaacgtaataacttagagtttaatattagtctttaatgtaagataatcttttatgttttactttgtatatttcttgtgataattttcttaaaagatatcaattgaggtatttcatattaatttcacaatacagttgatagcttaggtatggcacaatttttagagataatggtgttatcggctgtgatttaataaacgtacattaattttctcagtctcagacaaacctatggctcacagaggacacatgtaataactcagtctttcattaaactgcaagttatactgagatacagatattgttaatttagtttttattgagtacaaaatgcactccaggtagaaatcactgctcatttaatcactgtgtgttaggtttgcattatctggaatgtaaattcctccctttcctcaaaggtgagtcttttttatggaacttgggtttcttactacacctgctccctattccccaaataaaacagaggcaaaggaaatgaaaatgttacctgttcattgaatgttctttccagtgactgctgtcaagttaaggaatgtgcagtcctgtccgatgtgtacactggaggctcacaatcattaattgaattcaagtatcacatactcattaaaaagggaaaacaattcactaaacagcaaaaacctttgtcctcaaaggtattattctgtggaatatccagaggaaaaataagactgtcctcaataccagagtctcatgatataagccaaatggcaaacgagtctaacaagggtaattatactataaacatacatttaaaaaatcattgatatagccacagaatacagaatcacatgtcatttgaataattttcattaattgctatactttgcatagttatattttgtaaattcaaaaattcatgccttgttgcatgcttcatataaataaaataaaaagagtacataaggtagaggtctagaaaggaatattggtccccacaaggattttctaagatgcaggagggatcaagaaaacctacagccagagtgaggcacagatctggctttggcaaagaatattttgtgagttgccactttgcctgcatctatgcccccagctgaaagcaaactggacctggtattagatgtgcaaaatgtatatccttttaggaatgcatggaggagatagagttggagaggagattacatatatttgaaaaattccgcttacgtgagagctttgacaggttattttcaggaactattttgttcgagatctttttaaatgcctgggatattggttataatttattaacttaatttttaataagtcatcattctgttacttttttattggtctgattgaacaaactcattttaatgttatttttaaaagaatattaaatatatgtggatagaattatgagttgtaagaggcacagtgtttgaaacagtacgtattttattaggaaaatagtcttgttttcgcaagtttaagacctctatttgttcctcagaggatgccttattgccacttgaaaacatggccaatgctgtggggagtagactccatcaactcacattcagcattgttttgagaatagaaaaaaattctttactgtgacagtgagagattagaaatttgttagaaccattttatttaaattgctgatgactttgtgttgtgatcattggagatttcttaatgtgatcagcaaaacctggaaagaaaaaacctgagcatttatgtacagaaataaataagtttacacttaagataatgccacaactcaaaataaaatcacagtccttatatcctttcagattttcatccaaattcaaagaaaactcagtccatgcatcttttcagactcatcagtttgcatgcatgtcacagatttgaagggttttggttatttttgcagagatatgattaggatgtaaaaattcatcatataaacattcttaatgatcaaggaagaacgttttagacgagtaattttctatgtctatgtaaaactttagatgggtttaatagtaactctcgaagtaagaggaattaagtatttttttttgtatttgagttaaaagataaagacaaaagaaaataagacccacaatattttctcctatttggttatgaagagaacaactggagtctaaaaatgccacttgcagtatctaaatgtctataaggtgctggcacattctgttacaaaacacttgtcacctctttttccatatagaggtaggaactgcagtgggaaagtcttcagctgtacaaatttaaaaatgaatttttacaacccagatgatggactggtatactttaaaagtgagctcatgagttttataaacacatttctcttgctctctctctctctttttcttgactagcttacatcataatggaggaataacattttaaaaattttgaataggcacttactggaattacagttaatcctgatacaatctagatggggaagaatagatgaaaaatgaaaattcatccttcaaggtaatagctgcagacatccaataaaattacagtccacccttccggggacagacacatgcaaatatggccactccatatcattattctttacatacttataaagcccagatgttttgttataaaagtttaccattggaaacaacaatagaaggttttaaaaatggccaattcaaacaaagctacatggtgacaaatctaagtgaagtaaagaattgttaaatgtcaaagatgtttggcttagactggctgcaactttctccccatctgtgaaagaacatatcattgttttccgcaaaatgtaaaagtgctccgtcacaatggggtacagtgcaggttcagctaggctcagacatcttggacctccgaaatctaatatcccacaaaggccaacagaatccttcagaattgcagtggtcaaatggaaagcaagttaaaattattcttatcttaccctaagggtttttgttttgtttttaaattttatttgcttgggcataaaaaggtaactgccagatgttggctggattccataccttgcgttaattggaggaggaaagaaacaactgtatgtttcctttagaaactccagtggctaaggagcagtcattattcaaggcacacaagcctatgcctctcttaggagctaacagtgttatctctgtgtaataagtgtcgtggttcccttgattttcctttcttgattttccctttcttatatttgctttatataaaagtagctactataagaacagaacgtcttgtatgggtaacacaaactgtaattatagtggttatttttaaaagactgtaggatgtttcatatttattttatatgtatttgttggtttgggttttattatttaatgcctttggagaacataaaaaaataaacctagattctgtttccatatagctgagtttgtcatgtgtcgtcaaccgcatcagaaaagtggttgcaaacagccaaggaccagcacctacacacctctttctacagaatgctttgctgttcgaaaattctcatgagtgtttccactttgactaacagcagctttactgcatgcaattaggcgatttgttttgattggcttgtaataacctgtcatcgtcactagagggtactctaacagaacagtaaaggagagtgctctgtgttcttaaagtagtatttttttaaccttaatatttaacttaatttcactaatattaattaaatatgattatatgcaataagataccaatgggataattttatattttatgagttatcgttctgcccagcacaatttgaaaatgtaggtggggtttccacaaatgccttgcctcatcacattttattactccttttttggggtaaatctatgtagtttcaaatttcatttttccctctctgtttattcatttctatatacgtgtgtttaacactgtcaaaaatacagtaaaacctcattaattttgactcctcttattttgaaataatgataacactgaaaatttgggcagagtatttattcttcctttgatatgagcaaagatctcttaagaaaaaaaattaaactcataaacaaacaagactttgaaaagccaagcgtgggaagaaaactgatttccaatacttcatgttgatggcatagtttgcatgaaacgatgtgctaattataattaatttttatccaaccattaaaatcagcctagagagccctttccgtgataagactttccaaactattatgtttttgagtataatttataaaaataaaaactgcttaaacaaattttaaaatctgcaattcagactttttcctaattcagcctggtttttccccataattcatctagattggtgaggttttactgtaatgggtctttcttaatgctacaattaagcaggaaagcattatctttctgtagaagagcctgtgtctctagtgttctcatggctgtttgctaagggccgcagactttgggcattgaagggctgtggatcgctgtttgatagcaaaataccaccacacagtactccgaaacagaaaagacagggtaccacaaaggtgattattcaaaggagaagcccatggagtagagtaagaacagctcttgatctagataacaaagcagaaatttgatattttgtgcaaatcctttctaagaagacatgcttttatttatctgcaaggatgtcacctacaaccgatccaaatgtcagtgaatatatcaacagaaaattcagcttgaggcaacctcaggcttaataatttatattttcaattaacctcactgacagacatggcctctcttttaagaaccctcagtggtagaaatcacaaaacagtaagttatgttaaacataaaaaataaaataaaaaataaaaagatgcccccgaaaacctcaaattactttaaatgatggaaataagaccattaagtgttttaattttccatggcaaacaggctacttgatcaatgtttgcaggcaaattgaacaaaaagtaaaaaagtgttagttcaatgggggaaggcaggttgttacctagattgaccgtcagtttcacacgtcctgcgtctagctccaggcggagggtgtcagcagagtctctagaagtggttgccatcagaatgccatatgcacgctgggatcggaaccgtaaggaaacatcctcagcctccgtatgcatgactacggggagctgaattttcataaacatgctcccatcatagctcaaaaccgttgcctctagagatggaaaatgaatatgataagttcttggatggtatagcgcattaatactttaaagaggaaaaggatcatttattatcatttatttaagacttccagaacacaatactacaaaatcaattcatcttcttcagaaataaacaaaactgtgagctggaaagagaagtcacagtagaggacttcccttgtgagatatttgctaaagcccagaaacagagatatcagcagttcctttttttttgttcccagagcactttctacctatagcattaatcatgttgaattttgagtgtttgattatatgccccccttctcaagagcaaagatcacgttcttttgtacagccacagtgtgagcctagtttgaaacaccagcgaagttgtggatttttttgttgttgtttttgtttgggttttgttgttgtttgtttgtttgagacaaggtctgtatcccctaggctggagtgcagtgacaggatctcagctcactgcagccatgacctcctgagctcaagcaatctttccacctcaacctcctgagtagctgggaccacaggcgcatgacaccatgccaggctagcttattattaatacttttttctagagatgggtctccctttgttgccaaggctggtctcaaactcctggactccagtgaccctctcgcccaggttcccaaaaggaacctgtgcccagcctccagcaacttttcaatgcatgtttatgtatggtaagcccactgactagttctgtgaaattagtcaaccttgccttggctctgaattattcatctgcacaatgagagggtactgccagaaggtttctcagggctttgatctgttctgaaaacctgtagttctaggagaagttactgtcatcatttttttttcataatctctgccctgatagaattatttttaaaagaaaaaaaaaagaaatatagcttaactataggaactaggccaatactttaccaaaggtgatgttcaaaaagaaaaaagaaaaactgatattaccaaacaacagataatacttcttttgagccattatgtttagcaaggtaatttttacaaaggcttccttttaaggaactgttacttccttttaagattaatttatagaaggggagtaactttaaatattatctataagcacagccctggtgtcctgaataagttctcatgcaaagcagtaatgatgtgcttttgctacactaaataagcatgggggtgggactggggagcttgtgaggatgtttgttactaaactaaggcagatggcatcagtagggaagttgcttagtactgtcttaaacacacaaagaaatgaataaaaaaaaaactgttgatgacaacctgacggctttaagaaatagtcaggactccttaatgttaagcaccatatggtagtggaatattgcaaaacaagcgtgaatcagtttgctttctcattggttccgataactcaggatgctacttaataaagaaaaactacctggaattaaaatgaaccaggaaattttcattattttgcctacttacacagcatagcaattaagtgtactgatacaactgtgttcaatattaggactatatttagagttgtggttttgtaagtttatttttcagaaagtcaagtactgtttctataagactttaatcactatttgttgtcatgatgggattaagtgagaaccagaacctctctaagcactgagtgttccaggtctccctgcttaggttagctcccttctcttttccatctacctcttgacttaagagatctcagtcaactcatatgctcactcctctaatatttattaagcgttctgacttctctcctgagctgtagcattcattgcctattggaaattttcaattggaatatgaaatttcaattggaatatttcaattggaatattattaaactcttgatttactcccttcaaaaatgaacaaactcaaaacatgctccttcttcagtcttctccatctcagtaaacatgataatctcattgctcagacctaaagctttctgatttctcttactctctctgccatgtccaatccatttgcaagtctgcaagtcctaaaggctctaattccaatccacattctgaattgattgctgttcacctctgccactaatgtccctcagactttgctctcatctctcacctacaccactgtagtagctccctcaaccgtgttcctacttttttaaacctacaaagatcagtgtgaccctggccccagtccatctctctggcctcagctttaagtatgtcccgcttcttgttcagtgagctccagatacaccaatttcatgatctcactgaagtgtttgcacttttagatccctctgtttaaaaatgtttcaccccagatctttaaatagctggttctttcagcatttaggtctctgctcaaatgttactccagagagacctgctacccactccagttattcaatatatattcatcatttcactttgttgaaatgaccatttcttgtttgtagagtattatctgtatatgccctttagaatacaagtaccttgagggcagagatcagtctctcatatgcattgctctatcagcagcaagtgcccccacaatgccaggcccacagcagagcctccataaatattaattgaatcaataattgcacacacacacacacacacacacacacacatacacacacagtgagctaatttcaatttgaataccaagcttacataaaagcttaccaaagaaattaagtatttattctgcttattgcaagtgaaatctaatttcagtactgtgcatgaacgaaatatgtaataaggtccactttgaaggccaaaattgggctgcagaagataggctagggaagtgtctatttatcaaaacaggggcctcatggttaggcaatgccctaagcactgataaaacaaaatatggtctttcaaaaatatagtggttctatataatatcatatttttttccaattagacaaaaagtttcccaaatgggagtaaaatcccagtggtcaaagaccagtgcaaataatcaaattgctgttgctcaaaaaataatgaaaacctgagtgtaaagttatagtgaattctagagagaaaaatgcttgtggtataattttaaaagaaatttgatctttacttttgtttttcctaaactagacaatcatgacccatatctgtaaagcaacaagcacccgaataaaagtgtaaaagtcattatcatgtgttcagttactttggtttcatatagataaaaggatcaaaacagtgtttgttttctcttctttatttaatctctataactaggctctattattcaataatcacatttttgaaataatcatattcttctgggaaaagtagcttgatttgattgaaaactaaatagggggcacctcctttaagaaatacagatgactgacaatggatcataaatatagtgtgaaatacaacccagagaaaaaaataatcagaatcattagcctttaacattctccagaaagctgcaggactgaaataacatagtaaagtaataaaactagagtgcccccgagtgtcatgttaaataattctcaatgtgaaaataacttgttgataaatgacaaatgaaagcctaaacgattcctcacaattagagttaatgtttaattagacaagaaatggaaaatgcacagggttgtagtctagagttgccaaataaatggtaaacaacattctgacatttgaaggttatgctatttggcagcatccttgaacactagtaaaattatttcatcatttagaatatacaataattctttaaaaggctaattccaatacaatacttcccactgggggagaaaaccagtttcaactttgtcttctatatctccttctcccttgtcattaagtttgataaatttccttttctacattattctttgttgcagtctaaagtgtacacctgtgctcagttttgccgaaaggcagtcacatattgtgatcaacgatgaaaatcagacagggagccaaattatattgctctgacatctgtccctccatctgttagaatttaacaaacagtataaagcagatctctgattatatcaatgctcttattcttacatataacagaataatttttatatgatcaagtctccacaaattctcagttttattaaaaataaagcagaagggaaggcgctaaatttaacttttattcattgaacattatttctgtactactccttcttataggatcaatacatgtaaaacaaaatactctcttcttgtctgcctaagttagcaagtatcttattctttcttataaactcctttgcttccttaggcatgataaacatctcctataatgcaattgcaacataatttttccatgttgaactttctaaatccaaggagctgaacatgttttttaattactttgaataattattttcataaattataaattatcaatttttgctcaaagttaataagaaaacaactttaaaagttctcttaaaaaaagaaacttcaagagttgtcaactcttatttgatcaacaacagccttaagtgaccaatgtgtgtctggagaagaaactctgtcaaagccccctgttttaaattggaaattcggaggttcaggcacaatcttgtgttaactgaactagggcataatagccacgaactgggcagaagccaaattttgtggtattgagcatgacaaccatcacacatttcctttgctttcaggaggcaccctaacgtgagcaagaaaattacttctgaaaagcaaaggactcacgcaatacacatgggtagtccagtaacaagaaccacccaaaaatgcatacagccaacctggagacaaagaaatctgcagaaacctgcagcctcctatcagataaagacgtatgctgaatcccaatgatgaagtttgctattaaattctcatttacaaatctacatatgcttgctgcccctttttctaatcattgcaatatataaatatttcttctctcatcctggctctgaaagatctacaatttctattttcatttttgccataggtagtagcggaatattgccacagggtggtacaccacgcatagttaacagaaagcttccgtaattcatgtgacagttgagttatacccttttttcagcttcacttaaccaagaggcatcagaacaactggcagctctctgggtgattaaaattaaaacaaaaccttaaatcgtgcaagtccgctaatctcatattatgcgtaactgtattataccttgcaagctttgttacattgttcatccttttggcaatttccaaaaacaaaactaaacaaacaaactaaaattaggaagcaaaatgcaaagaggaaacttataaagaatatacaccatactaactaaactatatagaaatagctaagttgtattgacaattcacagaaatgccggttaggtactatcataaagagaatgaatatatctgtatctatgtgataacatacccgtctactgacccatctaattgcatgacctacaataataacagcatatggtaagtggtttaatatatgatttctatgttactattaaatatttatattgttaatattaatctcagaactaataagttgatgtacctcctttttaagataaataaccaaaatcaggtttcaattttgggtttcacaaaacaacccctctttttcctaggaggttttcggcaaactgaactgaactatttcaggaataaaaaagggaaacaataaatattcatagcttaaaaatagatgccaggtaattttaggctaaatatgtaataaagcaatgttatttgtagcaggtgaggacaatggaacaactcatcaatattttttcatattgatttttagttccattgttgaaaataagtggcaataggtgtagtgactaaagcatttatctgaaacactgggtcgatggaagaataaacttagaactatttgttctgctatttattcctttagcctgttctgcagatcaactgggatggctattgcccttcagttttctttgaatcctcattccttttattgtatagggtgaaaaaaaagaaaaataaaatgtgggtttgcctcctgttagaaaaagagaggcagcacctgctcagaacttcaataggcacagctaagtcttaacagcaaattggtaaatgaatcctctgcagttggttaggtcctagccaaaggtaagtactttttctattagggtacacttccagaaatgttggtgcaccttagatgattgaaagtcagcttacttttcagagaggatattgcctcttttgtaagttgactgaagtgaaatgagcaggctaacttaagtctcacccagttgtgtcagggaagttgcaactcatagcttagcttgcctcaaatgctatttcttagcatgggtattagcactagaagccataggtatgtataattcatgcctcttttactgtctaatgttctgaagttaaaaactgggcaaaaaagacagcagttactgtctataatacatcttaggctcatactctagaggatactaaagattcaagtttctattcctgcaatatacttaagaactgtgtcctttcagaatcaagctctttgaaaaacattaagagctcattagtaatccatgtcaggtatggctgctcagcttgcaaacagagtttacttcagtagagtatacattacgtttcaatggtcagtgcaggtttgaggtcaacatttaataaacttttcatctcagggagttggctgctggggttttagaatcctacctctctcacaggacctgccaagatagcctgttccggaacaatcacagacatatctgttccacccatccctgcacatgccattgtttttgcaagggttgctaaggcacggttttgctgtttcctttgagcaggaaggcttcactccagcagtactttgaacttcagccatttgccggatatctttgctttggccatcgatgaacaaatccctgatgcagcccacgtagccatagttgagcagagcagtccacacctcggtggggaagacaaggccagctttattttctggcagcccccccaggtacaactcatcatccaggtccagaatctcactctcaccaggagcagtgtagggagtacgcaacgtgttgacagaaatggtacctatttcaaagagaggagaatgcacaggtctttaaaaagcaccaacgtgttataattatctttctctctttcgtctgcttgatggttaactccttggaggcagacaattattattattctttctgtcctcactttttggtatttcctagagaaattaagatatctgtggtattaagaaactttagaaataaaacagactaaatggttccatttgaactcgagaatggaaacctaagtgtacagccaacaaatagtgtttgagagcctcaaacagttcagtcaatgcatgtatacatacattaaaaataaagaaactgtaattctgtatcagtctctagaagaaagtcagattcccctgggttagtgcttgttttcaaagccaatattcaattgcaatccaaagaaagatttcatgttcctattttaactgacttgattactttgattgagcacaatagtttcacagattacctatgtcaaaacctgacttcatcactcctagctgtataaacctattgattaacttacatagttttgtttcccttactcataatatgcgcataataatattacctaccttatagagttgctcttagtgttaaacaaaataatactagtaatgtacatggtttataataatcactgtataaatgtttgtgattatatttcagtgaaagaatcaagtaaaaccaattgcttccttatttgtaaaccaagctagttatttatttaaattaacaaggctttctttttctcactccaaatgttaaggagaaaaatctattggtttataaatacaagggctctaagtcctaagtatggaataaccaggtattcatctacatgggatcatttgagggtcacagaaaaatattagtggaatctatgaaaaaaaaagaaagatataaagcatattcctgatcaaaacgtgcatacacactgtcagattaccaaaattccactgatactttatcttcagaaagacctttgtacaaatgcaaccatgatacctgaacagaacaccacaaggacccacaaccacattatcccagatttatttctcagctccagattataagaaaggataggaagagtctgatgagagagagaggatgagaaaaggtctgatagcatgctggggcatgggtatagaacctcaggtatttagggaagagacacaagagagacctggagatgggaggtgtgatacagaagtaaggacaaaaagaagaagtggagggtaggtcaggtgtgtgtagggagacacattttagttgctacacagaataccaaaagcccgccccaagtgaaaacacatatctaactaaggatgtaaggctgtgggccctgatgtgcccaggagtattccaaatcccagcagaagggcccccttcaatctaggcagtctaatgggatctgtctttgtcagggagaagggcatggaagccactgacaaagactgctcaggtggccgagtcattaagaggatatttggctctctagactttcagagaaagaaaagggaaaagctcctaggggagaaacactcaaaggcattgctattttggccttccaatgaggggagcaaaatagagatttcctagggaagcagctaaaagagaaaaggacaaagtattcatttttactgttcacatttgtacaagtgtctagaagaaaactctcatttaggaacatatgggaaccataaaatcctatttagaaaaatataaagcatggcattttggggaaataaaatttataatattgaaagagaatggtggctcttttctatttcaaatggaacgatcattacacgcattttaaagcatcattttttatatagccctattcaaaatacctaagaagcgaataaacagatggtccctatcctctgcagtagctaatgaaagttagaatatgatgagaaagagtgtcttttaatgacaaaaggaaaggtggacactttaaaaagcacatattatcatggaaagcaaagagttacatgcaatgaacaaagtgccatgttctttttttttttctttctgagacagagtcttactctgtcacacaagctggagtgcagtggcaggatcttggctcactacaacctctgccacctgctttaagcaactctcatgccgcagcctcccaagtagctgggattacaggtgtacgccatcacagccaactaatttttgtattttcagtagagatggagttttgcaatgttggccaggttggtcttgaattcatggcctcaagtgatccacccaccttggcctcccaaagtgctgggattacaggcgtgagccaccacacccagccaaagtgacatgttcttaaataaaagagagaaggattctactctattttccaattagttcaataaggcctcctaaaagccgtagaatttttgaggatttgacgaaatgaatatccactattgagaaattgagaagaaatgttaggagacacggaacttagcaaaggaacaatgacaaattattccaagtgtggtgatatattcaaatatacatatatataaacatatatgtatgtatgtattcccatatgctctttttattcagctcagatggggaaaaaagccctgggaaaggctgtactgtccttgctcagggtatcgtaattctgacactaagaggactcctggaggactcctgagtcgaggaaattcattggcttccacaacccactttctccctctattccatgtagtttccataccttggtgcactgtgtctgcactcactctaaggggcaaaacggctgccaggtggtttagacaatcattcattacagtttgtctgacagtaaggatggagtaactgtgtctcttgatttttatttatggtgtgttagtgcttgctttgagcaaagtattgtaagagagttcaaataagttattttaagaatgtgcttgatgatatggacagggtaagattcttactacaaatttatcattagacttgagttttctgaacacggtcatagagaccacaattttcaaatatcccagtgcacacttaaacacacatccacccacccacccacacccacacacacactctgaaacaaatgtttaaaagaaaaaaaaaatattcaactctacagcctctgaagcactttgatattttctctctcatcatatcattttattaaaacaaatgctggaccatcaatggattttagcaccagctaaaatgttgtaacccatggtacaaaaaaataaataaaaaacaaaaacagatttaagggttactatcataaagagtaagtttctcccatagttccctattgtccctttgagagacaattgtagagttctcatagaaagaacaagcaggccaggcgtggtggctcatgcctgtaatcccagcactttgggagaccaaggcgggtggatcacctgaggtcaggagttcgagaccagcctgaccaacatggagaaaccccatctctactaaaaatacaaaattagccgggcacggtggtgcatgcctgtaatctcagctactcgggaggctgaggcaggagaatcgcttgaacctgggaggcagaggttgcggtgagccgagatcacgccattgcactccagcctgggcaaccagagcaaaactccatcagaaagaaagaaagagagagagagagagatagagaacaagcaacaaaacatgagacagaaagaaaaagggatataatcctacctttaattcaaatttaatccaagaaagactagaacttaaattgagctctggattcaaagttaaggagacacatcaggcaaatggatggatcagatatcagtcattggaatattatgcaaacagacatcataggatgaagaaaatagggctgaaaatcaagtactactttatctatatgctttgctaattcgtatgaacttgtattttagaaaatctttgtaaaagagatggcaaataatcagaaagtaaagaatttagttcaagtgggatggaaacaattatttttatattttgaaaattcatggagtaaaaatggttagaattaataattaaattttattactgagacaaatgcaaatagaagtttatattttagcctaaacatgtgtcctgaaatagacacatttccaataagggatttgaatcccagacctccttaatgacttttactatggatatgaatcaaagaacatattcacctagcaaaagagtcatcacagaatccgaattagtttaaaccaatttaactcatagatatgagcatagtgaaatttaaatattaaggttcccgtgtgcttattttattaaaattgagttataaaatcagtggttacaaagaacacatcaaattaatatttaaacctggttcattgataattgaagacaattgagtagttgccaaactctatatatcaatggaaaaggagaattttcaaaggctgaggtacataaatgttataaatacatttttaagagaaaacaaaaatctaaatatattaatgggtcatccctctatctttttccaggaaccacaaatactgacatgttcttttttaaatagtttgattccttcatacattctaccccttctactgaatttatatttgcagtttctggtaaattaacaaaatattttatgtaaacattgttacattaaggctcctaaaattggggaaaagttcatatttgagaaattatctagatcagggtttcatgcttcactatttaagaatctgaagcaccctgctatgctattttattttttaaaggaatgagatcgcaactaaaaataaattatttgtggacatacaacttttataattttaatgtagaaacgacattacattatattcttacatgtaaagctgttttttcacgacacatgtaagaggtaaaatgaaggtgataagcagacaaggtaatatttaagaatattcataaacaagtaataaatttatgtttcttgtaaaactgtatgcaaaggttcaaaaaactttttaaaacagctcttagttataaaagtggaaatgaaatttacaacgtagtgaggtagtttttcattacctattagtttccattaacttttctatcctatttttattgtctgttctacttccataagattagtttacagggtgagaagaaacacagagtgaaggtgagatttaaaataagttaagttgatgtcaagagttaaattacttcacaagtttaaattactaggaaatgaggagtagaaaatagtgtgctgtaatagggaaccctttttcctggtgagaaaatccgatgttccagctcttcaactaactagctagcaagtttagccaaaggatagatctgttaggcttcaatgtggctcttatgaaaaataaagaaattcagtagatggattattaagattcatttttgaataaacaatctttaaattactgcttaaatgaattgtttaaattaatgtcaattttatctatacttaattctgctccacctgtccctacacaaatgaatcagatttcacaaagttacaaatttacttgtcaaattcctagtctaataacaaattcaaacttgatgaaatatgcacaacataagtaataaaaacagaatacaacattgacaatagggtataatgtaaaatgtaaaatatataattatcataaaataattttaaaaaagaaccaacatattaagagtgggtatttggtgacagtgtaattatgagtgttatttaaaaaatttctgtatcttttttaaaaccaatgttatctatgaggtttttaaagaaataaaattaactgtatttgaaaacaaaacaaaaataccatcttaatattccactctctgcttattaccatctgttttctgcttacttgattcatctgtgagctgggaacttcaggaattaaatcaatatatgaaaacagaactctaatgacaaaaatttaaaagtttaataatgtctggtattggcaagaataagggggaaagggcacttcaataactgtagataagaatgtaaattgaaacagcagttagtaaactaacctgtcattgtctttcaaaattaaaattacaattaatccagcaatcccaattctcacattcaatcctagagatattctgaccaatatacacaaagatttcatgtatgaaggaattatctataaactagtttaaaacagtgaaggtttaaaaaagtaaaaattcaaatgttcttccatagagaaatgcctaaatatcagtatgttcaaactaaggtatgtatggtgtcactacaaagaatggcacagaaaaagctatctttaagtttttttgttacacagtaattggtaaactataatcttgactatagaaaaaaggctgtataagtattttatgtgtgtgaacatatttatagatatattgatgcctagaagaagaactgggaatttttcaacgccaaattattttagtggttatctatggagaacagagtaaattgatgagggaatgtatggtaaggggaaacgcttcacttagctagtttttgaattgcctgaacgtgttcaccaaaagtatgtatttatatattaaatacatcatgcattacaaaaatgcacatatataaacacacatacacattcacagcaatgtatagacacatatacattttaaacatgatcatacacaatggaaggttgtaaatatcaatcaaataacattctgcagcaattgaaatattattttgcagaagttccacagatttccactcagcattccacagtaagggtcactaggtccgcgtgtggtcagtaaactgcctatcttcttagggtgctactgatgccatagtccagagtctgccccttagctaggcaagcccaatgaagagatttggtagattttcagagggcggtttcatttcccaggtttgactgatatttactaactccataacagcaatgtataaaacaagaatgccaagttattgatttcctctgaggaattacctattacaggacatgaaatacttcccatgtagctctgccaatatggatgtcaattataatcaaatattacttattcatttatgatgagaaatttacttgttacaggaatgtgaatactcatatgcattcctcagtatctgtggaaattggttccaggatctcctggagacaccaaaatctgtggatacttgagttcctgatacaaaatggcttagtatttgcatataacctatgcacatcctcccatgtactttaaatcatctctaaactacttatatctaatacaatgtaaatgctacatagttattatactgcattgtttaagaaacaatgacaagaaaaaatgtctgtatatattcagagcagactcaatttttttccaattattttcaatccatagttgattgaatccacagatgcaaaacccacaaaaaatggggggccgggccgactgtatacataactggtctattttctccctccactctaatcagacttacaatgggaactaaatcttaatcaaaagagtgcatggggaacatggattctgaacaagaagaatgcatgagataaggaaatgtatagtaatattggcctgggaaggcttgacacccttatctcagttaaatgacctgcctccatctttacagtggggatgaagttgtcaagttcgctaagcagtgttcagaagattactgctaatatttgcccctgtgagtttcttttctttagatatgttaatacatttaagttctacaagcccaggggcctagctcaggtacttctgaaaagctctgctctgaatctttgcttatgattccataattcccagaaaataaattttgctacttagatgatcttgagcaaaagagtacataacaccatattaaacagatagcctgaaaaattatgtttatactctaactgcaactatataaaatatatataatgttaacaaaaactgaaggaaaatgtacaaatataaaaaatactttgagtgtggagaaacaataaatgatttttttctataaacttcttcagaataaataaatataaacattttaataaaacttaacattacaattttaagcaaaattgaccccatctggtcatatgatcaaagaactagtaaattattggtaaggtatttcggtgtttcctctgatgaatagtggtttatgggtgtggatatgaaacaaaatataaatgcacttaaaattacttcaatgtatataacaggctactaggcagaggcatgggaggaacatttacagtcagagggcaagttcaaacaagacctaagcagagaaattgtctaatggttgctcaagtagaaatgtttaagtgtggtgattcatgaatggtgtacacagaaatcagtgctggtaatagatagctagaaagtgctgttcacatcaaacagtgattactataaacctctaattatgtgctcttgagagagccttgtacctttcccactgtaatatctagttcttaaactggaactctacgacttcaattcaaatctcaatggcttcttagctgttaaatgtaggcttacccatgaataaccgctgacacaatcagctgtaccctgctgtatacaagccaactttgacaagaataatgagttttctctttgatttcaatgtgtaatgatggtttacaaaataaataaataaataaataaaataagactggcagtttgctataaaaatacttgagagggtactttgactgagccagagtttaacacaaatttaaacaatatttgtgccccaagaaaacaatcattaacctcatcctaattgtagctccattcacagtttagctaaatacctgggcagctgttttgtgttgagggtgggaccagagaagaggcaaaggggaagtctggaaagagagagactggtttaaaaacaacaacaacaacaaaaacgctcagctgtaagtcctgcaaaaattgcaaagtaatgggcctcttcaatcatatttattaagtccactgacttaggggttttgccctgttagtagctaagttatccacagaggttatttacattttgcagcactgaagtcatccactctgattcactaaatcatgcctgcacttggtatggtttctcctttgctagcttactgcaggatctggaagtgccatttacggctcagcccacttggctttccatgtccctgaccctttagtgagcaggcagtggaagaaagctgcactgcacataaagaacagctatagccaagcagaattagtcaaactgtggaaattagagtgaattttccccatgtctcagattggaagaaggaacatatgttagaaataaccagttacaatcagttttgccaaaatgagaaagttttagaaaattacacataaaggtgttatttctcattgaataaggggttcatatacccctttcagtgaactaaagaccaaagaaccaaagggaaggccaccaaaaagatggacatcctaggttcttgtcaagagcacacttactgtggttgcatatcccagtcctcagaaaggagttaccaccttccttcttgatggattttcctgctccctaaatgtctgcaaaatgatatagggacctcaagaccaagaagggacagaagtcctgttctcataaaaacttgtcatttttgtaccaggtttacacattcgctaacaattatttaactttctcagtggcttatttcaaacatctgggcttggaggatggtgttgcattcacaagagaacaccagtttttatcctatatcatataaactgctttcagaaagtaatgtaatttaaataaatgcttacagttaaaaaagttgcatttacaattaaaagagtgccattattctccaaatgtaaaaaatgatgctgctaatttattttattttatttttttttagagtatcaggggttgtttggcactgtactacttacatgtttttaatctttagtttttcttataccaaatatatactgaacaactgctatacccaggaatgtactagaaactgtggataaaaaaataaatacaattttctctatctgggatggaaattatgaaccttataaagtgggtaatattaaaattaaatcatttgtgtccaccaaatatgattttaaccctctctctatccaaaaataaccactacttagattggcagcaaattaatgaccataatggtctcattatatttctatttactttagtatggccaacagcagaaagaattgctcttaggcgtgggttccctctactttaataacagagataataaggcttttaaaatactgagctaaggaatattccaggcaaatcaacagatatggcctcattatctgtatgtcagaaaggagcccatgttaccctcttgtcatagcagtacactttctccacattatatgaaaaataatattcatatagcccctgaatataactgatataaaaaatgggtaaaataaattatttcatgaaatttccatgtttcttagttgtaagtgacctctgaatcttactgtttcaccagccaaatcagaaatatcctttaagtaaaataaaagcaagtatagccattcattcaatttttaaaaggctactccataccaaaccaatgcagtgtgcaaatatggaacttaattaaaatactatatataaaatattaacagctgctattaaaattacattaaacacccttgagctaggctaacctaatatgagctctattttttttcaatttaataaaggacagaacttggcttagtgaatgaactttggtttttatattgtttgtaccaattcactaatctgaaattttaatcacataaaagtactttaccatcacaacagcaccaagcatagtaatctgatctttccactggattcaaagaaaaatctcatgcttcgtttattttctttcttagatgcaaacaacacttccttagaacgtgtttctgttcttcccatacagaattgagctttgtaaattaaagtagatatcatctaattttgaccttctccaatgagggtacaaatagagtaattaataaactcttggtaatttggatgaattaaagagcttaaacagaaaaagtagattttattctgcttgaagattaaagtatttatctgataattaattagattgcatcaatactttctccttataataagaaacctcataaaatattcaaaataattttgttctctgtgagtatgtgtatatgtgcatgtgtggcatgtatgtacatatgcatatatatacatacatatacacatatacatgtagagagagacatgcacacatatatagacacacacacaatttacatagaagaaagactggaaagaaatacccaaaaatataaatcattattttcaaatgaataatgaatactttcctttttcttttatattattttgtatttactagtattttgaattaatcgtgtattacattcatatagttagaaaattcctcatttctaagtgaatgaaaagcaattgatttgatgtttggtgttttttttctcctctgaactttcagaagataaccgtctaatctgatatgggttgttttgtgttgttttgttgttttgagacaaggtcttgctctgttgcccaggctggagtgcaatggtatgatcacggctcactgcagcctggaactcttgggctcaagtgatcctaagtgtggggattacaggtgtgaaccactatttttggcatgttttgttttaaagtgctataaaatctgacttaaaatatctcttcttgaaagtaattttcaaaattttattctagatctatcttaagtcaaattataacatccacaagctaatatttcaaagcactacataagcccatgcccacgccacttcaaaattcttctgcttgaaagttcatatgtaccaaattaactgctatctctggcagagataggctggaggaagtcagaggggaacactctattattattgttatatttttgcattcccatcaatgaactcttctcagcttatttttatttttattttttatttttttttatttttgagacagtctcactctatctcccaggctggagtgccgcggcccgatctcggctcactgcaaaatccgcctcccagcttcatgccattctcctgcctcagcctcccgagtggctgggactacaggcaccgccaccacgcccgactaatttttttgtatttttagtagagacggggtttcaccatgttagccaggatggtctggatctcctgacctcgtgatctgcctgccttggcctcccaaagtgctgggattacgggcgtgagccaccgcgcccagcctcttctcagcttaaatcagaaagaagaggaggaggaagaggaagaggaagaggaagaggaagaggaagaggaagaagaagaagaagaagaagaagaggaggaggaggaggaggaggaggaggagggagggggagggggagggggagggggaggaagaaaaaatggtaattcaattccttgtagacttctttaggaaagtgagaatatttagggagacaaagtttccagagaggaatgaatcagaaacacagtctccaatatatctgggaatcagagtaatgggttctgaccttccttctctccacactcactcccaactccttctcaatttccatatattctatttctttattttgttaggtaaaaaacatatttccaaacaggcaaacacaatcttcttgatctataaacagcagaataaaaaaggaaggataagagggaagtagaaaatagttcagctgggagttaacaagtactgagggagcccatgcaaggagggtatgagcaagagagttcagccccaggtcttcaacagggcccttctgaaagaccatggttatcacagattactgagtctaaaagaagcactcagcttagttggttgggggtgggtgaagtaaagaaggagagtagataggtctaaatttagttatcttctattataagatcatttgatttatgtatgagtaggacaatcagagcatgggagcccggggtgaagggaattaaataaatgtagttgtatacttaaaacagatttctctctccttatctctccctgtctgtctgcctctttctccctctcttctctctctctctcttcctccctccttccctctctttctcaggattcctacaaatgtcatctctgcttcctggatgattatttcccctcaaagctcatattagtcaacatcctaagccccctaaaacactcccaaatttcagtgtaaatgtgatttcttcggagaaactttacctgccacctttacccctcctctcttagagaaataaaatgcagcaacaggaagcagaatgtttgctggtggaattccaaatacctttcatcagaaagggaagcagtttggaagggcagcagagctttgccactgtccttgaaatgctactgtattgattaaagtgtttttaatgccatagactcatcctaaagtgtgacgtgccaaactaaggattttatgtttggatcattctaatttttttttcatattttatatttgccacttcgggtacctccaaacatccaataacataagagaaaactgggaatagaaaaactttgaattttttcacttgcaaattcaagacaaaattttctgcaagatttggcacttgattacccaataaaagttcatttaagaagctattttagaagacatttgagcatttggggtttgatgcccaactatgataattaattagctctttctttcatggtgtgaaacagaagcaatatcaggcaatttcttttaggctaaagaaacaaatgcaggaagtctttaatatgtcttggttttcacttttaggaatggcatgggtgggtggggtgctccagcagataaacagcatagaaaaatgataagattacctgaccgtccgtctctctggaagtccacatgataccattctccatcattcactttcttcaacagggcttttatttttatagtacctgaccccatgtccaggaggaggtagaggtggccatctagcatctcaatagcaaagaagtccacctttatcatctgtgggtgcttggcatctttctgatgtcttggcttgccatggctaaataagatgaggccatttggctctgttgtacggaaatcaaatgatatggagccagttttctttgcattccatttaggcaaagagatgaaagactctggggtttcaaaggtgattgggtctaaagttgcaacattctcacatttaaatgccaccactccatggatcttcatcttaggatctccttgcttggcaagtcgagataattccagcctcacatcattatttttatatacaacctgtgggcagaggatagcagtgagaaactagcctccatattttaatatctgaaacttgtgaacagctcatgtaactttcaacgacatcataaaaaggcacacgatatttagttaattttgttgtataaaggcaacatttctcaggcaaataaaattcaagtgtcaattcatagaacaataaccataacaacttaacttgattcaaataatgtgtgtgcagatgcacccgcgcatgtgcatatacacacaaactgcttgtatttaactcaaataatttaaaaatctgcatatatctttaatttcatgtctacattaccatgctaagacttgaacttataaaagctacttgtttcatagttgtctatgatatttttaaaattaaatataagcactgaggttattcagttttcccatcattaaagcatttgaaattggataccattatataccagtcccctaaaatattggatctcttctattatctatatatctgctgtggatattgactttgcaagacagtcacaacaagttaaagcacaaaacagcctgacatttctcagaaaaaaaatatataactaagatacagaagatccctgacctgcatcaatacctttgaatactgttaagtaatgtggcactgccacatgtagaatatggtgcttcccctcaatttattcaacctgtgttactggtgatccatttcacttttaatttacacaaatgctgcgcaagggttgtcttgtactctcattttccaaggcacttcagtgaaagaggctaggcacttctgagtgcttactgatggtcctaaggctttttggattccaattaacacatttgataattcactgacagggttcacggtatcatacatttgctatcccttcacgctaataaattcaaaggtattttgacataaggataaagagagaaggacaccttttctctacaaaatgcatacagtggataatcacatttctaaaatacatagaccatacttacttgagggtgaattagttatctaggtccacatagctgtctaggctctttcaagaagggactctatagatttcaaagctcccaacattgctagactctagatttatttatccacatgtaaaaatgtacatatatatatatgtatatgtatacacacatgtatgttttgtttttcatttttcaggaatggcatgggtgttttatataatatatgtaacaggaaaaataagacagcctgtatctgattagcgctatgaagtcaaccaagacaacgcagcagttattccaaacccatggccaactgaaccaagagatggctgatgagtttcctgataggatttgttaatgaatactttatttttcagagtaattaagagtacatgctctggtattggacttcctgagttcaaattctggctccagcattaccgaactgggaaatctctgtaagcctgtttcactccctgaaaggaaaataatacttcacataatggttataacaattaaataagaaaatacacataagtgggaaaatctacataaaggcattcattccaatgccaatcacattgtaagatttcaataaatattaactacgtaaaatacatgataataaaaatcaatgctttatcatctaatagacacagattttaattctaaatttatccataggaaaacatttagaaataaagcccacacatataattggtttttatacatgatttgtgccaactaaataagtcacatctttccaatgctgggcctggtgtttcagtttacctttatcttggagaaggattataataaagaacatgatatcccttattctttgaacaaatatgtacaatggtttaacaagcatctattgacaacaaaagaagagaaaatgaacttgagcaataacaaaaaggaattacattaattcttaagaatacttttttgaaaagagaaagatctattaagtcttagaaaaatttatttaggattgcctttctttggagatctttagaggcagggaaaatgcttttcaaggatgattttccaagttttatcgcttctctctatgactttcatgctacttaaacctatattatttttcctttttcctattgatttatattccagcatgtggacattcttttgacatagatattgatcaagaataagtattttcagacccaaatgatgcttctcttgatcaatgctaacactcattcttataatagaaccactgtaaaagaattgagtgtttctgacatgaacaagtgggttttagccctggtatattgtctcttgaatctgacatcagccaccacaaagttgaagaatgaggggcagtctaagtctgggcaaggatttcaatgagacataatcttataactgaatcaggtgacttggtgatgaaaaggttcaggaagatgtaaaaaaaatagaagtagggataattccctgggcaaaatttcttaaggttagccatgcatctctcataaaaaaaagtatctccaccagaatcaatgctttatatgctttacactggcaagaaccttgctcaccacagcgcagcaccaagatcagtggctggcacagagtagatgctcaataaatatttgtttatagttgaacaaaattcttccttcacctttttaaacctagtttctagattataggcttttgtaaataacaatatttagacctataattaaaatacagcagaatatggtattgcggaccaatctcataaactaattactattttgccctatttctctagaaaaaagcataaacttatgtgcatatccagttcataattgacaagttggcccatgcattgggaaatttcatcttcacacacattttgtggggtataaattccttttagaacgaagaatgcctgagttaaaactctccagaggtttatacacaaaaatatacactgtgcttctcctcaacatagttcttgtaggtaagaactatctccagatacaagaactctttcctacaagaactatcttgagaagaagcacactatgtatttttttcttcccattttgtactctttgaaaggctactccagaaaacagaaaagcaattttgcattggtaggcttacggctctcagatttacactactatttcatctgacccagattttataattaccctatttttctaaagttagacctactcttaaaatgaactgaatctagttcaattagaataatgagtagctagtaagtattctaactcctctaaaaattcatgtgtaagctatttttgcttctttctgaaacaatgtggcactcaatcatgggaacaccttataattattcatatatttttaattcttatgtcaaaagttgcaatttacatgtttcacttttgaacaagtttctatatgctttatcatcataacaattgatgatatttgtgcacactcatttggatctgtttatagaaccaaggtttctttggggacattgattttttttttttttttaaagagtgattcaaaatgttgaattttacttcctcgcttcatgggcttctttcccatttcttcaaatatttgttagaatttttagtgtccctctcatgttaatatgcaagaatagggcgtaatatgtttgtgttttcacattcctagggtttacctttgaggaaaacaatcactgagtattatctttgatcttaatgataatcctgaaaacatgacagcaatgcagagaaaataaataacttaaagaataggagcttagtagtctgcatattaacttggttcaatctcaaagctattactaagccaagtccctaacctctctctgtctcagtttcttaattttggaaactgacatctataaaggaaaggcgtgccataactataaattcttgagctttttttacccttaatatgtgtgatttgggacagacataaaagatggtcgattgttcctgacccctttctggctttctcctgttgcaatttttgatgccaggatattgttctctactttcagatacactgaaacactaatccattagtaaagagagtgttcactgcatcttctcgtacacagacatgcctcgaggattatatctacctaagttttgtacagatggtgctaaagcactggtagctgatagataaggctctttcaacagagcgggagtatgtgaaattcagtgtgaaaatatttgccactcagataatgactttttaaaataaatatgtgcttcagcttggaaattacaatgggggtcttaacttcactaacatgcatgattaagacttttcattacttaactatggtagtatgcaggatggtgaaataagcgaccaaagttagtgttgtttagatatttagactttgttatgaccctccctgagagaacatgaatgactcatattttaatctatcttggttttatctttcatacttgtggctaataaggagtgaggcctaagaatttggttctcaagtcagatttcagagagaattccagctcactcattttcaaacctgtgaccttgtgcaagttcctcaaccttgccaagtctcaagagttttattcgtaaaggacaatggtatctaccacattaaggttactgtaaataataaattgtattttagttaaagtgctaataatgggtcctagcatggagtaagtgatcaagtaaatactcattgtttttattaacattattataaataacatttcttattcttacattgaattgatggagctacacaatttaattgtcataacaaaggtaacagctaagaaggtagatagcaattgattggtcacatatttaagggaattaaatagtgctgagaccagcaggatcaaaggtattcagcagactggggcttcctttttcatgctgatatttacgttgcagttggatgtacacatcaggctttctctgtaaaattccttaactagaaaatatacacagcaggctagctaacctaggagttgtattttcacccatgaaagggtttctgtggtatctaacaacagcggctaccactatcaccaaagccaccacaacaatcagttaagatttaccagttcactttctggcaggccctcttataagagttttatatatagtaatgtgtttaattcccatatgcatcctagaaaataggtataattatttcctattaccataagttacctagaaaataggtaacattattctactttatcaataaatatctggaggcacagagtgactgcatgtctttcttcatgatcatgtctaatcctgtttgaatacctaatgaccttaacctcaaactttatctttgtttcagtaggaaatttgtcttcgtttttgatagcagttgctaagtagattcacaatcaaacagctgtttgtcattaggcaaaatgataacctttcaatgagttacatgtgcgttctaaataccagtatttttccttcatttgttgtcattaaaatatctctaagtgaatcaaatgtcacaagtaagtagaggaatttattgtgtatctactgattaaaatgtcccttcaagtccagttatagcagagggcctatttctgtttccaagatgatattgtagtttttcaacaggtatgtcatttagaatgtaacaaacgttatcttaaaaatctgtgcggtttaaaaattatttaaagggactgttgctttaatgctgatttttgtttgtttatttgtttaaaatgcagttaatgcttttactctattaagaccaagtgaaggccgagcgcagtggctcaggcctgtaatcccagcactttgggaggccgaggagggcggatcatggaggagggcggatcacgaggtcaggagatcgagatagagaccatcctggctaacacggtgaaaccctatctctactaaaaatacagaaaattagccgggtgtggtggcgggcacctgtagtcccagctacttgggaggctgaggcaggagaagggtgtgaacctgggaggcagaccttgcagtgagccgagatcgcaccactgcactccagcctgggtgacagagtgagactccgtctcaaaaaataaataaataaataaataaatatcaagtgaaaatatttatttcaagtaccagaatttaattatcattttcacctagctgttatctttctacgcaccatctccttatatcagtgcactgtgtcaaaatacaaccaggaactagccagcaagtgaaaagtacaagcgtcatccagtaagtagcagataaattgcatttgctttgccatgatctgggtaagaaagagctcagaaaaggaaatgcagcatattacaactttcatccccaacattaacttatttattattttgaaattatgtttcaattctgacacttccaattcaatcagacacgcactttttagacacgtgctatggtaggatcaatcaaatgcaattttagtcacttccctgtgcatatgcctagttccacagaacatgttacactgaaaataaactaatttaatacgctagtttaatttatcttaaacatttgctagtggtaactatataataggtaaactatatgtgatcaacacatatacacatagacacacacctacacacaaccagagtttaaacattacccagatacactatatgtcaaatttaatgtcattgatatccatataaatatgcacttatgttagaatatatggtatatctctcaacagatatatagataagtagataatacatacctatgtatgtcagagacataacaaaatataaatacattaacaatatttgataatttcaaaaaattagaaatttgaaaatttcaaaaattagaaatttggtttaagcacaaagatggtcctactcattttgtatcaaaaatgttttggcccaaaagcaaattttagcacatataaagttggtgctttccacaaaaaacaactgtagcctccaaaaattagtattttatgattaaatgaaaggagaaaattagacatttcccttcatgttcctgccaccatgaggagacaatctgaaaagcagaataaaggcaaggtggtcactttttaaaatctttgcacccattattgttttatctcccacccaaaatcaagtttcttatgctattcactttcttacactgaaggtctagcataggacatgattctagcaaaaatgtcaaacactgttgagcttaactgaccaagagagactaataggattttagcttttctgggaatgtcactccatagaaattttcatgtgtagtgtgatatgtccacaggagacaggtgggcatccagtacagtacctacaactgtggagtggctgcgggagggctagtggatagggaagacagtgtagaaaatgaacaagccctgtacaaagtagtctgatgtatgtttatttatttatttatttatttatttatttacttagaagccgtctcactccgtcgcccaggctggagtgcaataatgcaactatgcaacctctgctgcccaggtacaagcaattctcctgcctcagcctctggagtagctgggactacaggcatgtgctaccacgcccggttaattttggatttttagtagagacggggtttcaccattttggccaggctagtctcgaactcctgacctcaagtgatccgcctgctttggcctcccaaactaatgcatctttaaaaacaattcttaccagtaaggaaatttaattttaaagagacatacgtaaataattttgaaaaataagagtgttttgggaaggcagcaagttgatctttttttcccctgatctaatctgattcagagaccatgtacagataatattttcaataaaatatgttatcttctccaaacccaaataccaaaacctgttataaaatggaaatcaaactacagtaatataatttatccacaaaggcatatgacattttatttaaaacaaaaaaatagttaaaaattggagagggaaaaaacaatattttgtttacacaacaaagagaaaaatatttttacctagtctcaattaaatacaaccaaatatatcccattaatcaggggaagaaaaaggaaaagaaaacccctcctgctttgtccttccttcattccagcattcagtgaactgcttaaagttactgagacaacattaggtgcaatctgtagaagttattcatgggagttgaaagactgagttgtccttgggttagcagctctatttatgaagctttcagtgcatatgagtatgtagcagaataacctgagtttcattaaatagttatgtctatttttctcacattagtgattcagtaatgccttttggaaataaatggaaaaatgaaccacaaatgtcagtaatgtgaagtttcagctgaagatctttttgaaatacaaactgcaaacttgatcaattgtcttattttcagatgaggaaactgaggcttaaaaggctagaaggctatccaagttggcatcaatctctgatcaaaataatgtattggggacttcagtgttcagtgttctttcaattttgtgttaaaaaagaaaaaagaacaaggaacaaactctgccataggtccagggttatgaaatgctcttaagcaattacaaacgaagagcagcccactttttagcaacgtgacagaaaaggaactggagcttatttaaaggtgactccaactttaaaactatgttagcttcataataagttgattttcacagacagatataaaagtcctgagggggtaaaaattgcagtaatttcccccaatgatagcatttagaaagacactgaacaagttaactagaatcaataaacttgcaatgttcactactattttaaaaggaagtgatgaagatactttccgcatcagtctttcatgatcttgccgaaagttatctcaccataacttggggttaagagtttctacttcaagccagcagatgctgctaagaaaggcaatgcatgtctgctttatccaaaaaacttttcaatctcctgctagtttcaatgggggaaaagtagcactattattattattttattaggggaacctatcttcccatataccaagaaaatatctttgaactgataataacaaaatagtgacactaaatgatgtgtctagattaatcaatgcatcttcttttgtgtctccagcctcataagctcagtgaagtttcctccaccacttaattttacatttttctaaggaggcagacattagtataagtatataatataccatttagtatatgtatatgcatgtattatagatagattagacaaatatatgatagatatacgatagatagatagatagatagatagatagatagatgatttcctacagtctgtcctttcctcattgatctgcattgacatactatctattgttttggatataccaatgttcactattttaatatattattactttttgatcatgctcatcaattttaagctttgaaaaaaatttctccaagagagatgggataaccaaacaatttcatgtaaaatatttattacttgattatatttatgtgtgtgtgtatgatatatgtattatttttaatccactgaaaatatgttgtcttctgtttaaggtgaaaatccaaattgacttgctccacaaagagttagttatttgaaccagcacatttttttgtccttctttttcttacttcaacactcaggggaacacaatttttaaataattatttttccgacttgtaaggcctaccacatattaaattattacatatatgagattctatggctgagcacgctgttctgttttattgatgtttattttttcttgatctagttccatgtcacctaactgtcacagctttataatatattctaatgtgtgttaggctccttccaatcaaccaacccattaacattaattagcttacaatgtttatacgttataaacattataaacatctcatgtaatttcgcacgttttttccttatgaagatccgttaataaattaccaaaagatataatcagtttattcacttcaataaaaaaaagcaatcactgaatatttttaaatgaccataacttataaatttttttgtcttctgtattgacaaaataaatatacatcacaagttgctttgatctagctttctaaaacatagcaagttatacattcaaatttacttaaggggactttagaatagcccaaggaaattatatcttgctttgaattacattcctattattacaattatttgcaaagttataacgcataaatgagtttgacaattttatcatatcagagaatctggcctcatgccacaacaataatttattagttggaggatagatatacaactatagagatagattaaatcaggaagaaaacaacaacagtgaatgtagttgtaagtgcgctaattctattccaataaacacaggccctggtagagttccttgtaataaaataccaggagtaggtggccagtatataggagttatctggtaaatgagatgaattattctcagtgaagaagaaagtggagtgacctcagactccactttaatggtggctcttttctagaggtgagggtacttgcctgaggtcacactgctattgttcagagggagtcaacagtggacaagatggaatctgaatgtttgcctccagagcctgaaatggactgtttaatttattggttttctttgtatggacagtttttatgatggttaattttcctaaagcaataaaaaaccataggacttctatgcttcctcaacctgatgtttcaagagctggttatccagttggtggattatccaaactgcatgaatcccctttctttccctggctgcctgcctttactgctcaactgcacatccacctaagagcctgcaaacgaaacaggaaaaggtggcatttaagacagccaatgctgatgatgtttttagcaactgcaatgagaacatttttccaagtagacttgttcctgagaagttgtataagtttgttctgtaattttaatataatttgataaaaacaatgtgttataagatttatatttacatatattcaaacagtctcaggtttacattcctgcattgctacttaactacttttactgccttggccaagttgcttattcttactgaaataatttccctctttatcaaatgagattatgaaaacttattttgcaatgttatttaagcacataagtacttgatcctgggtacctaaataaagggtagtcattactgttgctattatgatcttaactgtgtaaggtcttaagggttaagatcttaaatgggtaagaggggagtgttcattatttaaattagtaagtgactactattgaaagcaaagatgcattctgtaaagtaatcacactcaaatcttgatgttgacaaaaatacttctcaaatttcgtaattttatctcatctctctggaactctacattttgactttatctgctaaacaaatagtatttttaaagtaatattttttattttaaatttattaaaggcatataaatgacagaatgagacagtctgtataatgatattaaattgatggaattatagctggatgcaaatacttgttttatttagcttatactgggtggactaaatatatggccttttctaggtttgctaaaatattgaacacatgtaactgttgttcatttctaactaaaagggccctaaaaagtatagagaccccaggttgagaactgttatttttcaattataactgctaagcagtagggtatttctttttaatctattctttaattatttctttggaaagtcccacatgattcagatgtcagatgggttgtgccttttgccaggggttgcttagttaactgtttatttaatgaatggggttttatgtgctactgaatttctcatggcacacgttagaaaatttttggcagcatttaaattggagaactgagaaacatattggctctacggaagctcaatcagctcccaggcaggtgcagagtttttgccaacaaaaattcagtaaaataaaaaatgcaaagcccaaattctcacacaacccaaagaaaactgactttggtgtccaagattaaatgaatgctagatccaggcagctcaggtagctcaagaatggaaggggaaaatgcgtcataactttaggagagaagcaggaatgggaccttcttgttttggtggatgacagtatgcatacatttttggattgctgagaaaattcaactaactcctaaaaaaaaaagaaaagaaagaaaatagtctcatgtaatttcgcacgtcttttccttatgaagatgtgttaataaattaccaaaagatataatcggtttattcacttcaataaaaaaaaaatcattgaatatttttaaatgaccatagcagtcactgagcatcctagaccaagtatccagatggctatgttttttaaatgatttggccagatatatagacattgtataagcattggttaccagatttatttactctgactgggaaccaaaaaatatcctgacatgtcttctgagttctgaaaagtcctaaatgcacatatatataaaattttactcagtagtacaataggatgagaaaaaacaatggaaaatatttttttttaattaaacactagtttgagaaaataaagatgagaatgtatctttcagcaattaaagtgaatagtaccagcctacttatcattactacatgactctccaaactgtgtggaataaaagccatttgcagtcatctcctcccaagtataactgtcatcaactcctcccgtcaatactctgcccttggccagaccatgtcccagcccttctccctgtctggaagggcaatgtcccgagtcaggcttgttcttgatttctcctctcctagatgtagtttctggcaatactggcttattgaagactcctgcattcttgggacaccagtggatattctttagtatcattttcctgctgtattcagaaatggggagggctgtgctcattagcacagcgatgctgacccgacactaggttggccacctcttggtggctacataaacacacgttcctcacttcaggcctagccaacttggctgtcttctatttcggttgtatgttgaacaagtccccagtagacagttcattagagttggccagctacatccactttgcccctaattgcctttgattagcttctacgttgcctggtataattatttttttttaattgagatggagtctcactctgcacccaggctggagtacagtggcatgatctcagctcactgcaacctccgctgcctgggttcaagagattctcatgcctcagcctcccaagtagctgcaactacaggcacgtgccaccacgcccagctatttttttttttttttttgtatttttaatagatacagggtttcgctatgttggccaggctggtctgaaatgcatgacctctggtgatccgcctgcctcagcctcccaaagtgttgggattacaggcgtgagccaccgtgcccagccatcatgttaatatgaatcattacagcacccaacagcaactgtcaagcaccttctctgtgtcccatgcttgttgaacaacaaacttctacgtctcatgacagtcttatgaagtagacatttttatctccatactaaagctcagagaatttaagtattttgtccaaattacacagtaactaggtgactgagcagggatccaactcagcttttatctagcttgattccaaaatcacagatgcgattctagtgcatgctccccaccccatgggatagtagctgagttcctatttacttattcagccctggttctgggcacactttctcaatctcatcatcatgcctttcgtgtatagaagtaaagggactccttatcccttttctctttttcgaccaagtgcctcattaactagctgtggttctcttaacactgctggtaaaaaataatattaataataataatcccccttaggtttcatcctactctctttctctcttgatgtcaggataattgtttttctcctttctgtcctatgcactctgatttagtgtcacacttgttttgtgctcacttcactcttaggaccaaattaccagactacattttaagaaggtacaaacgttgttttgaatgttaagaattctttaagattttctaagttgccttgtaactggagaataaagaatgaggtttaacactaggatgaataacattcaacacatcagttttcaggggtctagagttagatttgatgattacagcctcctgtagtcaataagagaagagagatgtactaaccacacgtagactgggaccatttttttcattgtaactgatgaagcccaaaacagcagggccagaacttgggtgaggggtcaggtaagtgagatactcactttggaacaaaatataaaggaggatgttaaatctcatatcacgacaaatatttcaatgaaatatttttaaaacttaataagaaaaagtccacaatgaacaaggtattcaaattttaaataaagatatagaatctgatttttccttttgcctcaagctccacaatgctttggtagagccctgcaatacaatattattctaagattaatgaactccatttaatacgttggaaacatatttattaaaacaagtgcaagtaactagaatagtgtgggggtaaatttcatcattagatatcattaaaattagaactagaatgcactactaatttttaaggtgtaattagtcattaaaatcacttttattcaaaaataatgacgaacacagagtgtttagtcagacattcttttaaccactttactcatataatcctcatgacaacctgctgatatagtagaaaaggcccactgctacagaattcccaatgtaatattcattaaaatacaatgtctgtggagctgtgcagcacagtgcctctcataaaattagggtccccatttttcagaagaaactgagctcacatagtaagtaccagaatgaaatttagacccagacagtccagatacagagtgcttgttcctaaccatattatagaaacaaaccaagcctctcaaagatcaagtaatgtagcctatttctacctcaacctctgtgtcactagacctcaaattgcaattaacttttaataataatgatcctaagaaactctccaggacactggactagacaaagatttcttgaataataccccataaacgtaggcaaccaaagcaaaaatggacaaatgggatcacattaagttacaaagcttctgcacagcaaaggaaacaataaacaaagtgaagagacaacccacagaatgggagacgatatctgcaaactatccatctgacaagggattaataccagaacatgcagaagtccaaacaactaaataggaaaaagtctaataatctgattttaaaatgggcaaaagatctgaaaagacatttctcaaaaaaggcatacaaatgtcaaagaggtatatgacaagctgctcaacatcactgatcatcagagcaatgcaaatcaaaactgcaatgagatatcaactcattccagttaaaatgccttttatccaaacacaagcaataacaagtgatggtgagaatgtggtgaaaagggaaacccttgtacactgtttgtgggaatgtaaattagtacaaccactacagagaacagtttggagtttcctcaaaaaaactaaaaatagaactaccatatgatccagcaacccactagtatatatatacctcaaagaaaggaaatcaatatatcaagaatatatctgcattcccatgtttattgaaacactagtcacaatagccaagatttggaagcaacctaagtgtccaccaacagacaaatcaataaggaaaatgtagtatatatacacaatgaataattatttatccataaaaaagaatgggattctgtcatttgtaacaacatggctgaaactggaggtcatattgttaagtgaaataagccaggcatagaaaggcaaacgttgcatgttttcacctatttctgggagctaaaagttaaaacaattgaattcatagagactaaaaggatggataccggggcctgggaagggtagtgggggttgggagaagtggggatggttaatgggaacaaaaatataattagacagaatgaataagttctagtatttgatatcacaacagtgtgactgtagtcaacaataatatattgtacattttaaaataactaaaagagtgtaattggattatctgtaacacaggaaaggataaatgcttgaggtgatgtataccccagttaccttcatgtgatcattaggcattgcatacctgtatcaaaatatcttatgtactccataaacacttagtatgtactcagaaaaattaaaaataaaagaaaataatgaccccaagagtagattctgccataaattttacagaaaccagtcaaaatttgttatatatattatatgtaatataaacacatatgtatgtgtgtataatacatatataatacatatgatgactcgccattgaaataaccttgagagtcactcatactaacttaagaactgcaatccatctctgatattcacccgtctacaggccaaatacagaaactagactaaatacctaaggtatttttataaaattgtgatggatactaattctgcagctcacaggcattgaaaggccaattgaattcagacccctggccctgtcattaacttctgcaggtgtataactggtattcttgtatcagacagccaatgtcatcaaaatggaatacaacaaattgttatataaaacattttagctctccacattaagtagcattataattatatgatgaaaccagagcactgtgaaggattataaaaaagattaaagaattcagaataaacacttgagaccttgtctaatacggatgctctcaagtaactactgttgccaattaacgctgctcatatacatgtggatttctgattatctggtttactactaaattaaagagcaaaaaataaaaaataaaatctctaatgcctctactgtagaatatttctattgatattttggagggatctataagaagccaatatcaaagcaggaatgtcttttagaaacaagatagatcaagcttgtctcttgagaacatgttattctagagaggaagaaggagtaagacatgggctggcagcagagtactgggggcggggggaagaatcaaagacagagaaatccagtggaagtaaagtatacgaggcctttatgctacacaaaatggtgggcatttccatagcactggtacacaggttggtgctgttaatcataccttattaattgctattagtaatctcatttagaattaatttcttataagtatcgtaaatccaataatctgctccttcctccttatgctaacatatcacaagagaaaaattttaccctttgtgaatttagaggtgttttcatgactagatgacttattcaagttagcactttgtgtgaatctttgctttgctgtgtggttgagtggcagaaagcaactgtaagcccaggagctatgttgacatgtgtctcactggtcaaataaggaattagatatgaatgtgtataaattatattaaacccatccagactggaggaaaacaacctatttgataacaaatttataacatggcagtcatgttatatatatataacatagcaatgctcatataatcctgagtcttgttaaaataaagactcaaagtgctgctacagactgtaggatatgatttattttgatatcaaagtgttttccgcagcttggttacctttgtgatttggatcagggaaaggtgtgtaccctatcaccttaccctatgctagatagatgtaaattttccacagaaagaagtggtttgggtagtcactcagttactagattcagctgtttttgaccaagccacaagaaataactcagtaaacaaaaactctttgagaagcaggtctaagtttaaatcccaaatcagaatgcctacactggaggaaaaaatcagtttttactggccatggctttagctataggcccaaggatctgtttcttggagagtctagttgataccaggaaggagatagtagttaaaattaatgcaatataaaatgtttcccacagtgatgcttaagtgaacacaagaacaaccctaatagctgattgcttcagaaaagtaaaatataaatggtcattcagaacaacaggtttgcacaggagaagaaactcagtaagtcacgagtttgaagaattgtattaagtttcctgggtcttaagaagaagtggcttctacattcttagacacaatgaggatgaaaagtttgaggttaaacctgtgtattttcattctctgtcaccttaattactcaaggtctcagtgtatttttgtctagtgtactatctctgtccttgttgtttcttgattctcctacccactgaatctatggctgagcacatttgataagtgtgtagttctgttcagtttcggatctgctaagatatttttaaagtacatagtgagatcataaaatgagatttttttttttggtttgaaaaattttgggggacaaataatatttaaaaactgtcaatgtttccacatttcaacattagatgggaggtgcctaggaaccatagagtatattgcagaaaagcaaataactaaaatgcctcaagggaagttcctgcaacacagagaaaagaaaaccattcagatgcttgggggaaaagcttagaaaaagggaaaaacaaaaagaggcagctggggtggccttcctccccaacagagctgaacctaagaacatccagataaaaccagagtcagaaaatactggtgttggttccacattcatggggaactctgaaagcctctcagagtaatctcgatttttggcagggtactctatcagtcaaggcctaggagtagatgtggtaattgcagaagggagttatattagagaagccccaaagactctggcgggttgcagagaagtcctttgtattttcaggtggacccagagaaaacaggaggactaaggggtcagcagaggtctggagctcacgcaaggagtcttccagaatcttgagcctgaaggcaaccacaaaaccccatgtcctgaagggcatgcacatactgtgcccaaacaaccagccaggtcattttctaatgcttaaaacatgaggtcaataccagacaggtgataaatatgatgctataccaaattctgctgccagaaatcctctccaatgcgctctggataaaaagatatattaataattatactgttttgttttttaatgtctgatctagctccttctgtttttgcaagcatacttcttagtggtttctttcataagaatagacttatttagcccatctaatatatgaatgatttcaaagttaatgttaacaataatagccatcactgattatttccaatatgtaccagtcagtatgcattgcagccattatcattaattgttatatcaattctctgatgtaggctttttctatccccattttcagatatcaaaagttaggtaactttcctgaagctgcacagctagtaataactcattccactgtatcacaccaaattacaacaaatgatttctaacaagtgataaaccctgacaacctctgagaacgaaaaggccagagaattagaagttaataaaacttactttatttttccctattcaacatttgtattcaagattatttattttcttagtggtcaaaacctactaggtactagaatgagggtcaaggtattgagacattttgtttctagtttcagctctttcattaattgtgtgaatttgagcaagtatctttattgctttttcatctgttcagtcaggataacaactgcctcattttactctcagtattatatgtatttctagccttgtcttaattgaaatacaattggataatatgcaatgtacttttacggtgagttaaaaatgcattattatattcacatataaaattatatcagtccaggcatggtggctcatacctgtaatcctagtactttgggaggttggggcaggaggattgcttgagctcaggagttcgagaccagcctaggcaacatagcaaaacctcatctctattaaaaaaatagttggacatggtgatgtgcatctgcagtcccagctactcaggaggctgaggcagaaggatcgcttgagcttgtggggttaaggctgcaatgaaccgtaactgcaccactgcactccagcctgggtgacagagagacactctgtctttaaaaaaaaaaaacggaatctaaagtcaaacacatggatctctgcctaggtctcagatgaaggacctggatgggaaaacatctcatttctaagtctatgtgggagtggtaacttttaaattaatttataagaaatataaatgtattagaaggtataaggttaactattagatagttaattattagaacatttcagatgctaacaatcaaatatgatatttttatccatattacaaccaagttaaggtaagaaatgaaacagcatctcattggggtggaatcccaaagagatgtaaacctgagtagtttcaaaatatgtgatggagaatttgaaaatctgcgcttatagattctgccaacagcggatggaagatatttgaaaataataataataataataataaatacaataataaaatgatacaaataaacaatgcactgtaacaactatttacatggtatttacattgtattaggtattataagtaatctagagatgatttaaagtatacaagagaatgtgcctaggttatatgaaaatactacacctatttaacataagggacctgagtaactacaaattttgccatgtggatgaggaggggtcatggaaccaatccccctcagatggttatatcatataacaaacatatgtcttgttatttgtgttgttgcatatttaagaagtctccaacagtttttcccaggactgggttttaaaaggccttaatctactgataaaagctttgtgcttaccctaaaaagtagtcctcctttacttcttttctagcatgtcaagaaagaaacacccaggaagacattagacaccctatgcatataaaaatggcaataaaagaaagccccaaatgccatctaaccaatagaagtagaataaattggtgggcattttacattcacttaaatatccaaatgatttaagaggatgtcgctaaaaattggctgatatattggcttttgtaaaaaaaaaaaatctgaattgaaatttggatatgaaccaaaagcttccgtcttcaaggacttttcaatttcctccagtttgcacgtttggaaactgaacggttcagcatatctctaataaaaaaatcatctcccaaggctcctttcctatgcaggcaaaatcaaattaacttcaaacagaagaggtgagatgcatacatagaggaagtatcaaactctaacatcactttgctccagctctctaaggtctcctaacgtctacctaggagagaaatccaaatgttaacttcacccaagatcactctgaaaaatctaaagagaagtgtggcttccaaaagagaatcatactaaattaattattcccctatgctgtcaggatttgcattgacaacaccatacggtagtattctggacttttacttaagaagtgatgacagccaacaagattccaggctccattcaaaggctacaaattgtgcggcacccttgccttgctagctgggcagccatttgaatcaggggattcttgtgctttggctgcagaagttgaaatgatgctctgtatcgtttgagacatgaactgctgcgtgcacaccacacaacgtcccccagcaatgatgcattgcactaatatgctctcagagcatactcactgggatgtattagagcaatgtatcaccaaaacacttaacttacaggatgtattgccacgtgaggtggaaatggttgccaatgaggtgttttaaagataatttctaaagttgtgtattaaatgatgtttatgtcacctttctggtgatttggaagataacattttgagattctgttatgcttgatctttggtattcagtgccttttccccctcacaaaagcactcttattgcagatcatttttaatcggaaaactcagtaattgagcttcacctaagtgtgacacaaaatgaatgaagtttgtgtgcattgctgtgcaatcagccctgaaattcagttgtgggcataagccctggtgctgggctgcatcttccccagggtgggcgacatatgggctagcagtaggccctgggcagaaaacatgagagccaggtagggatgctccctagaggcagaaagctctctctgcaggcacctacttcctctgttccaatcccgcataccgtttaatgacaggctctgtattgctatagttatgtgtgccaaagaattctgatctctctttttattgcctaattttattagataaaaggatggagtaacattagaaaactagcaatttacaaattctaaaaatagatattagagtttctcttattatatatatttttcagattggctaaaatatgttgctggatacccatttcataaggacagagtccacatctgttttgcttaccatttttccccagtacaccatgtctgacttgtagaaagtgttcaataaatgtttattcaatgcattaatagtcatgcttcccttttacagtagagctatttcatcacaactttttctttggaggcaaagcatgacttctttcaagcagaattgccctctctcgtaaccagaaatcaaattgcatctaataatgttacatcatggcagttacttttgaaagagttgttctaacctctagaccttgcttaaagccaacctaggatctttataaatatttatttataaaaacatgtgaaaaagacagcagggagggggagaaagaaagaaacaatgtgattattactagtatttaccagtgcatttaaacttcactagattcatttgaaaatatgtttccatacacatattttcagaaaagtctttattttgtaaagagatatccacacatatgcacatagttaaagctgcagcagtgactacaaatagatcagaaaaaatcatatatggcttatacaattagtgttctcatgtcataatcatattttgtatactgcagttttttagttatggtagtgacaaatttcctggtatatttcctcctcagtaatagattttttttggcatttttgacagtgtcatatattctagtgtccaatataaaacaaaacaaaaccctataattcctttttatagttgcatttcaaactaataccagtgcattcctgattctcttcctattaaatcatgtttttactcttttttccccctcatttcattgtacatcataggtctccaaaatagctttgattttaagctacctaaagaaaaacatttttttacttgtaaattcaatagcctctctttcattaattaccagacacacacaaacacatacatacccctcttgaaaatgcttccagttctcttttatacattctatataaaatagatgtaagacttgcattgccaaggctgaatttgttcgtatccagctgggtcagggtataatatgatggcagctccttttttaaagcattgtcaatttatatttctcctaaaagatggctttcctgacctcccttttaactttctcattctcatccctctggctttttccctctttacctattctcttcccccaacctcctctgtggttaagtagctcttctttggggctttaattagtaaatactgcacctctatgatgtaatttattatattcttgctaatcttttctgacattttaatgataagctcctggtcatcagcagccatattctcatccaaaacttgtatctatattcccactatggcaagtgatagactgctactatttggttgtgaattttctgaaccattattacgttttcaaatctcagcattttttcacctaaagatgattcttggtgagacgcttcacatgcagaaatcaatgaataagtaatgtaagctgagagacaactctgaaactattatggggacgtaaaagattaaattagaacattcattttttgtcctgttactggcacaaataaaatatttgaaatccaaaagaaaatgttgttaatctgtaaatataaaataagtctcatcaactgtaatagataaatgttagctgcatatacactagttgtctaaaaaaaaaaaacaaagattactggcaaaagtatctaattctatgtctcattagacctttatgattgatttcccgcagtatcactgcacggcagcattccatattttagttcctaagatcacattatatatggaattccagtttttctttgtttcacttatgtgtttagctgaagaacattactaagtactttttcaacctgcggccaaggttaacaccgtgtaaaaatgccaataaaggagaatatactccattatatctattgttatgatcaacaacttgggacatatataaagaaaattctgccataatacatttagtcacggtaatagtacctgactgaaacacacacacacacacacacacacacacacactaaatggtatgtcttttgaaaggaaataactaaattaaagtcatagcaatccagaatagtgatatatgtgttgggaagcccaagtttttaggagatggaataaattgttaaaacagttactaaccaataattttagctataatatgcaataatgtcatctaattatctttttgttggagcacttgtgcatagatagatactataaagtctgacgtgagttccttaaattatatttaaatgtagattaaaagctaggaaaattgacattcagatttagcaaagaaagaatagtattttcctactataatgttacaaaaccattaaagactacaatttggtactgctcattccacaacaagttgttgcagaatattatgaggacacaacggccctgaaaatcttcatttccaatattaaatccaatgctctagactttcttgtgctttttgtttttagagcccttgaacaaaactaaacaaactttcaatttctcttaaatcactctttttgatttgttcatagcaagagcatagtgtcttggactccggaaaggctcagttccagaaagtccacataggaagggttaataaaacaacgtttgataggggtacttaggaggattcttttgaagctgcatttgtacagcaagcccataactttttaaaaaatttgttttgaggtcatgggagattcatatagaattgtaataaatagtgcagagagatcctgtgtgatcattactcactttccctgaatggtaacgtctttcaaaactatagtacaatatcacaaccagggtatttacataaacacagtctacctatcttaattcagatcctttacttttatactcatgtgaatgtgtgtagctgtgcatgtgtgtatttaatttcatatcattttatcacatgtataggcttgtatatccaccatcaccatccctcatttttaacagtgtatgttataataaattaaaaaaaatgctaaagctttttaatttatattctagatctagatagataaaaagctaaagctttttaatttatattctagatctagatctagacaggcatgagatataaatcattcatattattattattttgattggggtcactggaaaggcattgatgagaatattacatgaacgaaatccacgcctccccctacaacttgctctcaacactgagggcatctggggttagacttcaattagataccatgtaaccatcacttcttacctgcagcacacatttcattttcagatttattttcccttaagctgcatttcctattttgacatgcttctctacagaaatcatccaagatattaatattttcttaagtcatatgatcctaatcttaatgtcataaaccccatccacaaactgtgggtagagcgaaatgaggcgtcttgttttgcaccagtttttaaagcagagcaagtgctttttgggctacaggaccaggaggaaaactgattattagctattgttttctgatactaagtctaggatgggattgattacattttgtacttttattctagaggtgatgtgactaaataggaaagcctgtattagactcctaaggagacaaaaaagccacaaagaaccctaatctaatttagagtgtgatgcagggcatggtggctgatgcccgttatcctggtacttcggaaggccgaggcaggaggattgcttgaacccagtttgagatcagcctgggcaacacagtctctaccaaaaacaagcaaaattagtcaggtgtggtggcatgtgcctatagtcctagctatttgggaacctgaggtgggaggatcgcttaactctgggagattgaggctatagtgagccaagatcacaccactgcacttaagcctaggaagaccctgtcttaaaacaaatacaaaaataaaaaaatatatatattttggagtgtgagtgtagaggaagtgagttgggagttcactgtataatgaatacagcaagattcacaaggttgcattattgtcatccagctttttcataaatatgcatgtaatatgaaggtgaatctagtaggagaatatgacaatcctaccactggaaaaagcaattgaacatcaggtgcatccttgtccgagatctacataagaaagatggcaatgtcactaaagttatcatgaaagggttatattttctgatgggggattcttcagaagaatgttttcaagcagcaaggagatttttctgattgaaattatttatttgctttatttcccttcttgcacaatcttttcccatgaggtttgagaacaggtcttattcttctttatatttccctcagattttagactggctagttacatgaaataactattcaataaatatttacagaattatatcatgcctaaatttcatatttcctgaagaaaatgcacacccatattttaaaagaaaacagaagttggaaaacagacctgcaaattataaactcagaaatcgatgtcatccaatgtatgatgctgggtctattttttaattttagctccgttgtttattgcaagcatccatccttcctataaatccccacacctacatccataaacaaagctagctgaaacccacagcgatctgggtttcaacgtgtttcaaaataaaatcatttaaaaatgatcagacattaattcaacacattggtgttaattaactaaggtctgaaaatgtctataattatttttagttgttacttgattaacatagagaagtatatcactattattttctctagaaataaaactgagtgggacagattatgagacacttctgactcacctagttctccaaaagatgctggaacagagagctacgtatgaacaagaaatgtgtcaagtgaaggaaggttggaagaaagtagaggggtatatgctggacaaaagactactcaacccagtagtcaacacattctagatatctgaaaactgagttttccctctcctttgtggcagtctggttcaagagggtattgttctctctccactgcttgtctcctcataaatcatctgagcagaagggcttatttccatgctatgttcacagctactataccgtctagaacactactgggtctaaatacatactaatgaaaataatggagagaaattaaatataagttgctatagtcccaaaagaactcttagaatatggccatacacatgagtaaattaccttaatcgaaggtaatataaccttgaaaatgtaacaattcctttaaaagtattaaaaaatacttttttggaggacaatatactatgctgagacaaatcaacagaattatgagttttggatttgacattcagcattctcatttacatttgacacctataaaacagaaatatataaatttatgaatacacagaagttccctaaggacagtgatttttgtctatctgctgtatttcttgaattctattgtctggcactcaaacatatatgctgaatggatttataattaaaaataaaaatgtttggctagtgaaaatatcctttcttggcctacagttttcaggttaatgtggcagcacctcgtatctatgcatgccaaaaccctaataatgataatccaaataataacactcatattgctattcccactttattggatagcttatgtttctctcttcaaataattaaaactcaaataaattaaactggccatatttcaccatccctcagattcataggtaatataaaggataaatcagtagcccagtaagagacaactaaaaggttgaatttattattctttgcaaccaataagtatgggctgagttcttaaacaagagttttctgtgataatttttattaggtgcaaagggaactaatgaggagaaataggtttaaattgaaggtgagaatttggagggatcatgagaaagaatgtcatgatgatgacagaatggtactagcaagagtctttggagtcttttgagagtgtcaaggacagagtgggcagctacctgttctggacaataagacatctagctagaaatgatggagccaaaccaggttatctttaagagctcaaataaagtaactgatttatccaagagcatacagttacttagaggcagatccaagactatatgccatgtatataaactaggtgcgcttggaaccatgggctaggtcatggtggagagtgacatcttaaaaatgttaaaaaagctatgccgtatacatagtaatatttcactctagtacatcatcacagagagaatatggcttttctgacataaatagtcataaattagtgaaatctgtttgagaacatacaagccccctgttcgcaccaatttagttttgttaataaccgggaagatttggttgatcttcagaaagttttcttagctgcaggattagcaaaaggattcctcgctataaattgcagctttgatttgaaatattagtttaatagatggctaacatctttcagatcctaaaaataagtaataaaaaattactttgcagggcacaagggctcacgcttataatcccagcactttgagaggtggaggactgctagagctcaggagttcaaaaccagcctgggcagcatgccaaatcctctcacctgtggtcccagctacttggcaggctgatgtgggaggttcgcttgagccagggaggcagaggttgcagtgagccgcgactgtgccactgcacaccagcctgggtaagagtgagactcgtctccaaaaaaaaaaaaaaaaaaaaaaaaaattatttaccaggtgaaagaaagaaaacagaagagaataaaacaaaaatagcaaagaggaaacaactacgaacagagacaggggaagccactagcaaaactagcacataaacataggctacgtagcatctctgttctttattaaccacactttgggatctgccagaaaaaaaaaaaaaatcaaagtaccttatatatttaggtttgtgtttatttctaaaatacttatatgacaaaagtactacctcatatcaaaatattaaaacagctttgatggcttccagttcccccgctgaaccatatggtttcagttgggtttcagttgcccatcaacccccgcaatagctatcagaaccagtcccacgtaccttacttcacagctgtcactcacttgcaaaaattctaatgtctaatcacagtacacttgggttatttccctaaggaacccacactttgtatatattgtctctctccctctctttcttctctcttttctctctgatcccattattcattctattcattcaatactttcacctcccacctagttttttttttttcttttagagacaagttctgccgctgttacccaggctgcaattcagcggcatgatctcagctcactgcagcctcaaactcctaggttcaagcaagcctcccatttcagcctcccaagtagctgggactacagacacctggctaattttgtttttaattttagtagagacaagttctcactatgttgcctaggctggtctcaaacttgtgagctcaagagatcctcttgcctcagcctcccaaactgctggaattacaggtgtgagccaccacacctagcgcctctaccttttaacctgattaacctactcacctttcagaactcaggtacatcaaagctaaaaaccgttccctaaaatcctcctctgggattcttacagcaccaagggtgtactcctatcatagaatgacaatgaactgttgcatttgtctccatacctgccagtttccacaaggaatgttacatttactgaggttagagactacatcatgttaatttttgtatcttactgcctagcacaacactcgatatataggggtactcatctaatgtttgaagactgagtaaatagccaagatttattgagcaccttctgtacccgaagtggtacaggcattgtactaaggatattatattcaaggttcacagaatctatcaattccttctcccaatctagaattttctttgaagaccccgaccagatgtcctagccctcaccatcttccaactatcaataattagttagccatgcctctggcacatgcaaaaagtaagatgatgatacacaaaatattaacataaaattattacaagtatctcttccactgtatcatgtgcttaaaatccctgatttctattcctcaccttgaccccaagtgactagtgatgagctggacatttggttggagcccaataaatgtttgttgaatcacaaccatggaattgacaagagtctagtgatctttttcctcttctaaccatacagaaagaaaaagtctacccagtatactgcattaatacgtccttgaaaaattctgatttctagtttgggcctcaggatacttttgaaggagagtgaagaggttatgtctttgaattaggagagaaataatttcaccataaatccccaaagataatgggttcaaaggtatgttgccctaagaaagttattttatttttgtttgaggcaagccgaaaactatcccttcaactcaatatgctaaaaagatatccttcaactcaatatgctaagttgtttgtgtggccatatgttcctatatttctaggtcagtcttgatcaaatacttttcttccatgcaccccataaatacacttgtactcatcagcccatctgtcctgctttccttggcttggaaactgtggtcattgaaaaagttctatttattccctaccaaccatctatctttttttatgtttaacaattttaaaattatttacactccctttctgaacaaaaggaataaatgggcagctattggcaaagaagataaatatgatgagctattctatgttgacatcaaatgacttagcaaagtgcaagtggtggagcaaagaagagcaggttttctcctcatagtttaagggttctgttaccttaggttggtaaaccaaaatgaactggtcttggaatgttcaaggtcagtattgatgctgccactatagtttggtatgctggtttaaaatgctgcaaccacagtatatctacatgaatgtgatggaaatatgagagttcacagtatatctatatgaatgtgatggaaatatgagaatctcagccccatgtagaaatgagaaggtaaatgtatcccatacacaaaataaaatagatgaataattctgggatgttctcgagtgtggcatatagtcactgacatggtcactgcagtttgatgctgtttctcaaacttgagtcgtgcacacaaagttttttttcataaaaataaaagttttaggtccctaagaataaatttacatacctcaccctcttcccacagatcctgagcattctgatttgaaaaataatgtagtagtagtttagcccatgaattctagtatcagatctggattcggtgttcggtgtgcttagtaaccgcaaaacgttaggcaagttaacctttctaaacctcagtttcttcacatgtaagaccgggacaaaaaaaccactacccttaagtaaaataagccagacacaaaaatacaaatattgtatgattccacctatatgcagtatctaaagtagtcaactccagagaaacagaaagtagaatgatggttaccaggggcttgtgggagaagaatatgtggtgttgtttaatgggtgtagattatcagttttgcaagatgaaaaagttttggatatctgttgctcaacaatgtgaatatacttaacgctaatgaattatatactaaaaaatggtcaagatagtaaattttatgtaatttgttttttatgattaaaaataatacatgcccaacaggattacaagaaaactaaattttaaaatatgaatataaagtactttacctaatacttggcaaagtcaatgcactttataaatagaggctattgaaaataaagcaatcaaaattttcaaaagtaataagcacacagaaatttctactgattccagtaaacaattttcattccctagtcactatttttaattggtttttgatggggcctcagtcaagaagagcagtgtactcattcagatgattcattcatattgccaacttcagtgattgccatgaaccctgttctttcagtgaagcagtaagtggtaacttgagaagtgccagcctcctaagaggggtcactgagttacatttggtcacatctactcaggcattctggtaggcaacaaccatttcaaaaaacctactgagcagagccacacagattttctttcttctggagaaaatgggctggtgacatgtctgttatttgaagcaagaagccaaagtccttctcaaattgactcccactcttacctcgctgatacatcctttctcacttaatttgctccatctacattagcctttttcagtatgtctgaaatgccccaaacctacttaccctccagggtgtttgcacttgctgttctttctacccagaacgttcttcctcaatatagccaaagggatcaccctcataccttcttcaagtttttgctcacatgccactttttcagtgtagctctctgtgaacatcttataaaaataattgccaccatcttcttcttctggcccagggacatgtacttaattatttccacagtaataacagccacagataaattatatattttaaaaatttatctagtgtctgtctccttccagtatagtacaagctctataaaggtaggagtcattttcccttttgttccctattgtataccgacctataatagtgtctggtataaagtatgcacatattaaattttttaatgagtgaatgtattggtgcaagccttattcaatatattaaaaaaaaaagtagactaatcaaaagtattctccccacaaaagaaacatctaagaaaaattagtggcttcacaagcatacccttattaagttattttccattaaactcaagcccttttccagttcagtgagaggtcttctgtttctctaccattaccctaagtggaaggggttggaaaacatagaagctaacacctcaacagttgttgaaaccaatttgggaatgtagaggtacaggtagataaatgtagttaataatgtattcatttacaataatacaaatttcctgttatagtaattagctttatgaaaatattccttagattcctggtttatgctagaaaataaaatgtctataaatattattatatttgccattggtgtcaatacatggcttctgttttgtattaggaaagataatttccaaagaaagaaaatactagaaagaattcacaacagtgagacacaaatcctgagttccaatgcaatcttgtctctacccagctccctgaccttgggcgagacacaatcttttggtgtgtctggctgtaacagttgggttttgctgcaaacctacttaactccagtgagcctcgatttcctcattggtgaagcgagcataagaatccctgttttggccaggcatggtggctcacacctgtaatcccaactctttgggaggctgatgtgggcagatcacttgagaacaggagtttgagaccaacctgggcaacatggtgaaacaccgtctccactaaaaatacaaaaattagccaggcatggtggtgtacacctgtggtcctagctactcaggaggctgaggagggaggctcacttgagcccaggatggggaggttgcagtgagccatgttcaggtcactgcactatagcctgggtgacaaagcaagaccctgtcttaaaaaaagaatccctgttttccctattgcagaaagttgccttgtaactgaaaaccaagactcataccatcggtgatatgctaggtgaagttaagtggttcaaaaactgtatttaatttctgaattatagttatttggatgtgtacttggagggaaaaaagtataactagcatattaaaattgtaaatatatgaataatatttaggatgagattaatttcaaaagtaaattgtttaaatgtaaaatattaattaaatgataagatagagaatacatatatatgtctcaattatgaaagtgatatacatataaatggggtttgtgaaaaaaagcttgaagaatcaatgttgatggtttgtgaattttctttccaaagttaacagtacaagccagggtaagatggtatttatatattaagacaaatgcaaacaaaataagatgaaaataaatgtaaataatatgaagtattatgattattttagtaagaaatgatcttctttgtgagtgcctattatattctaggcactcaataagactaggcattttatctgttagctaaatgcttgctagcaaactgactgcaattgagttagagcaagttgattgtttcctacatcatacatccaggccataaatccagttttgctgattctagcctatgttctaggagagttaaaattttagaaacagcatccagaattcaataaatatatgtttttaaaaaaccaaaaggcaaattccgcaaatgaataagctgctttttttaacatgctcctgatggctccctatggcaatactgtggaaaaatagaatctgagccttatgaacaggaaataataaaaaataacattaaactaaatagtaactgtgacactgggtctttgacagagctcaaagattctgcacctcatgaaatcatatattttaatgggaagtgtgtagaacatatacagtgtgtataaacattgtgacagtataggaagtaactaacaggaactctagagtgctgaatgtctgactcctccgacttcatccattactgaaaaatttgtaatggtaaaaacgtgccttcagtaagttatagtatttctgttctagtctgttcttgtctatttattggctttttggagtttacctagttacctattttctctgagtcttaattttctcagattaattagaaattagttatatttcatcattagatatctaatgatgagtttgctagtacaatgccggttagactacccacagtgaagaggaagatgaaccctacggctcagagtaccgcggcagatcatttgatgttacttctgtgaagcgtagcaagtcaactaaatactttgacgccagtggaaatggcgataattatagtagcggaggtgaagtaggctcgtgtatccacgtctatccctactgtgaatatatgatgagctcatacaataaatcctaggaaaccaattgatttcatagctcagactatgcccatatacccgaatggttctttttttccagaatagtatgttacgatatgggaaattatcccgaagcccggtaggatgagaatatagactttggggtgaccgaagaatcaaaataggtgttggtacaggatagggtctccccctccgactggatcaaagaaggtggtatcaaggttgtggtctgttaataatatagtaatgccagcggccaggactggaagggagaggaggagtaggactgctgtgattaggacggatcagacaaagaggggtgtttggtattgagatatggcagggggtttatgttaataattgtcacaatgaagttaatagcccctagaatggaggagatacctgctagatgcagggagaaaatggtcaggtctacagaggctcctgggtgggagtagtttcctgctaaggaaggatcaactgtccagcccgttccaggtggacatggctcactgcaacctccccatcctgggctcaagtgagcctctctcctcagcctcctgagtagctaggaccacaggtgtgaaccaccatgcctggctaatttttgtattcttagtggagacgtttcaccatgttgcccaggttggtctcaaactcctgttctcaagtgatctgcccacatcagactcccaaagagttgggattacaggtgtgagccaccatgcctggccaaaacagggattcttatgctcactttaccaatgaggaaatcaaggctcactggagttaagtaggtttgcagcaaaacccaactgttatagccagacacaccaaaagactgtgtcttgcccaaggtcagggagctgggtagagacaagattggcactggaactgcaaatgcctatgatttgcctgaaaatagaagggagggatctaactattgtctgtttcctaggcacgtgcaccctcattagactgtaagcaccacatgaagtcagaaaccattaggttttattcactattatatccttaatacctggaatacagcagatttttcataagtatctgaatgaatgtatacacaaatgaatagaatgtatttatggaacacctgtcatgtgacaataactgtgtaaggttcattgctcaagtatgaagcatagtaaaataaatgaagacaatatgtaagttttaaaacaccttgtaaatgtaaaatgctacaaaagcatttttagagttttaaaaaatcatttacttacatgcagttttaaatcacagccctcaaataagttccaagtcagagattttatcaagattgtatttacttttttaaaaaatggagttttatgctgctgtggttatggaatgtgcttgtacaatatatatatacatatacatactgtttgatgtagctctatacaatgctgcttctttataatattgcttatgaactattttgtttaatgccactgcgtctatgaaacattatagactattctgttagtatgcacagcttttcccatgaccttaatacctttatatacctaagcaatgagagtgtgggagaatgtattgcattcccctggacaactaacattaactcactgttacagacctaatatgtgtgccccctctccacccatattcagatattgaaatcctaactcccagtgtgatggggcctttaggaagtgatgagctcatgagggtgaagactcatgaatgtgattagttacttccctcataaaagagagcccagagagctcccttacttctgctatgtgaggatacagcaagaagatggacgatcatgaatcagaaaatgggccctcaccagacactgaatcttccagagccttcatcttggagttcccagactctagaactgtgagaaaccaatatttgttgtttgagctgcccagtctatggtatttttgttatagcagtcagaatggactaagatctcaacatactctaaatactctcagcaattggctcaccatactctaaataatataactccctgccctgattgaaaatgttatgttccaaacacagtctcccccactgaggtctctgtcttttattaagtgttttaacgtagtggttgacaaaatatatacaaataatattgatcaacatgctgcaaagaaaaaagaaagtgcccacagcactccaggggttcaactaacaaaccagtggggagatgaaatagaatagagctggttctttgaggtcagggactgaggcttattcaacattttatctgagcttgttgtttattcaacattttatccgaacttggtttctagcatgtagtaaaatgtctgatgactcgacaaaggaaaaaaaaaaatagatacctaacataagaagagctattagtataaagactctgaagctgactgcctcttcataattaggacagtcaaggaaaattctaccatacactatatatcagatagatagatagatagatagatagatagatagatagatagatagatagatagatagatgtatactagtcaggcctttaaaaaaggacagataatgacctacagaaaggaaaaagtaagccaaacaatgatagtgatgtaaaaaaatgtgggtcccaggaagttctgagttatctatttttatttatcataatgcctatgatttccttcttctttgaagtttcctcacatcttattccagttctcttctctgctattgtgattctgtccggtttcagtggctcttcccaagggggctgacgacagcgaggcctctgtgctgtgctggggaggagggtgacccctatctgggacagcacatggttctcttccctcagtggatgctgccaaagccgagcagggaaatgcgccccagtgtgcatgctaaatacaagttaggcgcccttcagcgaagatttcggcttggcttccttcccttggctattaagctacattcccacaaaattactacatgtctgaggtttctaaaaccttttgtgtggatctcaaacagttactgtgttggatccaaatttcgaccttggttaagcaagcctcaaatccgttccaagctgctccaggcagtgatgctccaaggacacccgatgcaaggaggagataagaataacctctacagcttggtgatcacctactgtgtgtcagtcatcgtgcttcactctttgcatgcggcatctcatttaatcctcactataaactgtgcttgctagctactacgactactctaattaccactaatttacagatggcgaaatgacagtttaaggaaattaagaaacttgttcaagttttacaaccaataattattaaaggattaaaagtattgaaaccctagcagtagacttccacagttggcaagggccagggcaaatgacaccagagtgatctaaacagcctgagtaataataaaagccatcaatccagcacataaactgcctgcactctgtgcatcccaaaagacaaagagaaaagtagtaggccatgtttctttatgcatctaggtggcaagtctatgagctgagagacagtccctctgtgaggagaaacagaagttcacaaaacagagggcagggaggttctcttagcttgtggcaggcaatgagtcaggagaggtaacttttggaacagagcttgctcttggcttagggagtaaaaagtgaaaagacttccaaggactaacaggttctctccttacacagggtaatgaaggctatcacactcagggcttagactttgttgatttatagactttgtaatctattgcagtgagcttgactgttttgattctttttttgatacaggtatctagttcaggggaaaagatgctcagagttagaacccttgtgtatagtttgagtatgtggttagcgaaagcctagagaaaaaaattttgggaaaacaattttgtccaagtgcagagaacaaaacttgcattacagcaccagcagcagaaagcttgtcataaagatggggaagtggagcagtttcccagagcactttatttaggaaggcctcgtagccaaatggaccataatcaaggtggtgatcaataattactactctaaaaagcccctggcataggccaaatgaacctctctttcctctcccttcaccttgatgctctgctctcaatcactacaaaatgaaattctcccagatcagagtctgtagtttttgtgaacaaagtcattgatctctgatcgtgtgttattttttgtgaaacttataaacttaagcatgattaggtgaatgaatactgtggcgggataaataaggttacccaatcttatgtaaatgcacaagaatatgtttggagcatattttcttcattccagtcagcccagctccacctcagtacttctgcattgacaaatgaattgaaaatgaacacatggagtctgtcatctagtcccagcagggaactagtatgatatacttaaagggcactgaatttacaagcatgtatatttctctcatatttttctatctttagaataatataaactgtgaggtataaaaatatggtaattcaacttgtctctttgatactatcaattttaaaagccatcaaataagaagatttagatgaagaaaaggaaaacactttatgaatcaaatagactgaaatgcaatattatatttggggttctatctgatccctgcagttagtgttcttacagagtagattttgtggattaattgtgtgatgctattttatttgttgcttgcaaaggggaaggtgatcaaaattcttttgacttatttaaaaacatctatatattttggccacgttttaaagattaaacaagtgttttaaatggcacatgatagttgttattacatccaacatatctaggctgttaaaaacatcttattgtatgacatatattgtaaatgttaaagaaaagtaactatcaccatatgcttacagttgcatgaggatgatacccttgataccttagcctctgaaaaggtataaaaaaaggtaaaaattgtaaaaaagaaatatattaataaacattgatacattattttgaaattgacaatctgaaacaatgatataaacaaatttgattttgcttggcacttctccttcctgctgccatgcaaatgaagaaagacttatttgcttcgccttccaccatgattgtaagtttcctgaagtctctccagccatgctgaactgtgagtcaattaaacctctttccttcataaattacccagcctcgggcagttctttagagcagtgtaagaacagactattacagatataatttactacatatcacaactatagatattcccatacggaaaatgtatatttgcatttttaaatgtatgctcgcatttccttggttttgtggttcatatttggtagtgaggtatatcagtcatatggtcatatttatgtaaactgaaacctaattcatatgtttctaagttcctgtgccctaaaaaaatcaacatgcacatcagcactgtcggggaacctttaacacctgtaggcgtaagtatgggtgagtcatagaggaagtcatttgctccagattattaaacatggaagaaagacctcctgataactttattacacatgataacgtgtgctaggctaagagagagtcattaaaccaaaaagcaaagccttctaataaagagctgaagctgaagggaaggactaagaaatgtctctttctaaggcccatagaaatagtataaatgtgttgtgtgctacctaatcattgaagaaataagatacatttaaattttagttattgattctattcacgctaacagcattttgaatcctataaagagaggacaatcctggggacttccttgttttccctttttgccatctttcaccacagcgtgtttttacctcttgtcttactccatcctatctcaacaccaggggtgactctcatactgctcagggctaatcactccacgatgctttaaatccaactcatttattcattattcatattgtgtcttttgtccacggtaccctctgagcactgagaggaattctaaaatgaataagagttgacctctcttcttaaaaaaaaaaaaaaacaagcaaaacaatagtgaaacaccagagcggagatcttatctgcacatccagattgggaaagctggtatgttggggtgcacaaacatggggtgtgtattgttatgaggacatgtggccacctggaataaaatagtaaggagggcttttgaaatgatggtgagacctcagtgtgctgagtataagacactcgcccaagaaagaggagtttttcttaggctgtgacctgatttgacagaaaacatattctgggttttggaagaaagaaagaatttgttctctggttattattattatttagatatgagatgccttgatgttatgcaatttttctctgtactacttttttgcaagaagtggggcatgctccaaatcccttgattatgatttatgggccagggtaaaaaaaggaaaaaaaaaaaaaatacccacctctcctcctactccagtttgacccttcccctctacctttgctccaggtgagagaagcactaaatcacagataagagccagagtaacatttatagcattgcaaagatgccacggtcagcatttgaggctatgagtgtggcaagtcctcccggacagatagacctgagattaatagaaacggatcaaagacaagtacccaggaagaatgattccaggaagattggaagggctgcctcagaaaatgcatatcacttgtaattctgccatagaaagggagaatttgaaggcataagtctctcaggtgttttttgactaaagtcaattatgactttagtttctactgccattattatctatgttccttaataattctccaccagttctgctgtagcaaggagaagtgagaaccaaaatgctaaaacaatgcaaaaaataagcaaaagctttaatgtaagaataaacactgtgttatagaggctcttatctttccatcagtttcaacttctctctcctaatggcttcccaacaatgtcttggttatttcctctaagaacactaactttgcataagcatatatattcctagctagagtagactggtttcatgtttgttttgatggcactgttatgatcaggcatcagaagcttctcctcagccttttacttcttccagcaacagtccttctctctctttttgctcatggccaactttctaagaaaaacaaccaaataaaaatacattgcttctttctcttcttcacccactcttcataacctcttacaatctgagttctttggataaatatttttttcaaagatgcttccactaccttccactaccttttctcagatcgttgtcctttctcagatcttctcttttataatagttgtctacatcattcacgatctatcccatgttattaaaaattgctgtgttttggagcatcttctatgtggttctttgttgatgtacaccatttcaaaatgccaaaataaccctttgttatcctactcccctttcacagataaatcacattaaaagaaattatgcaatttgccaaaactgctggacttacgtttggaatagaaatgtctaattccagatctctgactctctccactattccactgtgtctagacagtgatactgtgtagttcacagtaattttattacaactactagaagaaagggctcagccaggtcaaaactacgaaaagctttgtatatagcagaacagatggtgaggtttgcccgttctcccttggagaagggacccatctgtctatctggcttgacagccttcaggagccccacctgacatggacattcagtagggatttccctagtctgcctggaaaataaaatctatttggattgctcctcaggtgcctatgaggaacgtgggaaaattcctaggactttttttttttttttttttttttgacccagtctcgctctgttacccaggctggattactgtggcacgatcacagtgcggtataacctctgctcctggactcaagcaatcctcctgagtagctgggacaacaggcacacgccaccatccagttaatatttttgtattttttgtagggatggggtttcaccaggctgatctctaactcctgggctcaagctatctgcctgcctcagcactcccaaagtgctaggatttcaggaacgagtcaccgtgcccggtgggacatgcttcttaatgaacaaagtcatatggagggtcttgtcttgaggagggacatggctctgtcttaggctttagttgggtctctgttatagctagctcagaagagactgaccctctagccatatcacaataccccaaacctttgaatgatgtgtcagcagggatacagtctctcttatctactactacagcagcctgaggatctactttcaaggttctatctcaccctctccagccataaggccccctctcaagctgtttcctcttgtgttaactgtcattcagctagtgccctaccctgggatacattcctttcctctgatctcttctcttccctgtcttatcttcataccttcattctctaaagtgggtgcatctcaatgtcctgatggttctggttttctcccacgtctcctcattaaacttcccagaatgagcatggcatatccaaatgttcaacacctcctccatgtgaatggctcctcatctctcttctgagaacctgttctgcattcctctttaactgcatgtttctgaagcactgcaaaaataggttttcttgtttgctgctcggcagccaacacacattcagaatgctgctcagtgttcaataaatgtttgttaagcaaataaatgagtgagtctaaaaaaatgatttgagtctccccctgtctgtcttcattaccttttctgataaaatgcccattcccagcggggcacagtggctcacggctgtaatcccagcactttgggaagctgaggcaggccaattacctgaggtcaggagttcaagactggcctggccaatatggtgaaacgtcatctttaccaaaaatacaaaaattacccgggcatggtggcaggcacctgtaatcccagctactcgggaggctgaggcaggagaattgcttgaacccgggaggaggaggttgcagtgagccaagatgtgccattgcactccagcctgggcaacagggcaaaactgcgtctcaaagaaaaaaaaaaaaatcccaaaagcctcaatacctctacccggtgaatttacagaacaaataaatgaatgagtccaaatcaaaactaaattttgcctgcccttatccagtactcttcctgccactgcactgacatcacagcacagaggagggaaacagcccttagaatcacattgatttagtttgcatctttgttcagtctcttaacaggatgcagccttggaaaagttacttagcttccttgagcctcctctataaaaaattaaaaaaataaaaaataaaataaaataaacttttttaaatcagaaataattactcttcaagtttaaagactaaatagcatgtgtaaaatgccccaaagccatttatacacatacttataagctgtaatcctaactctcctatatatgtgtgtatatatatatgtgtgtgtgtgtgtgtatatatatgtatatatgcgcgtgtatatatacatatatatacatgtatatatgtatatatgtgtgtgtatctatatacatatatattcatatatatgtgtatgtatatacatatctatatatatatacatatatatgtatatatacacatatatatgtatatatatatattttatttttgttttgtttcgttttttgagacagagtctctctgtgttgcccaggctggagtgcagtgctgtgatcttggctcactgcaacctccgcctcccaggttcaagtgattctcctgcctcagctgcccaagtagctgggattacaagtgcccgccaccacacttggctaattttgttttgttttgttttgtacttttagcagagacagggtttcaccatgttggccaggctgctctcgaactcctgacctaaagtgatccactcgcctcagcctcccaaagtgctaggattacaggtgtgagccaccatgtctggccaactctcctatttcttttaaagatacatcaactacctcatttaacactcacaaaaaccgtatctgtagatacttttatgtctccaccttacagatgaggaatcagagggactgagaaaatgacttatttgcccaaggtcacaccaaaataaaatcctaggcagtattactacagagttcatgtaagaaatattcttagattgcaagctcactaagaaagccttataaaaattcagcccttacaaaaatgggcaagccacaccgctccaaataaattgtgcctttagaaggtggtcactacttactgaagtaataaagaaatatgtttacctgttgaaatctgacttctcggttcaatgctcaactattttagaagaaaatttgtatctctaacaatgccaaatgcagaataaatattcttgccttgaaaattatgatataataaagaaaacatacttgggaatgtttttccaaagacataatgagtattgcatgaaagaggacttttaagttaaagtgagaaacagaaataattcaagggaaacatgctttactgaaaattatataagtcaatatcccagaaaccaagtaacaatttattcgtcagaataaggaatacatgatcaggaaatttgtctggctaattgaagttgaagaggttgcacttgatgaaaaggaaatcatcagaaacgcctggatgtttcctataagaagctaaaatatgcattataattccagctgtggatagaaatttaatgcatttttacaaggtacaaagggtgaataattgttttgtcagttgatggggtggattttagttattttaataactataacctaattgaaggaaagcagaatggcatatcagaaaatgggggatacaaaaccaaatggtggaaagcaaattgattgcttatattagaaattaattatatattaaactacccagagttctagataaaattaggaacaaaaataatattttagaagagatgtgtctgactagccaaaagcaaggagaaatgcagaatgtcactgaaaatctaaaaataaaagcctgaggtaaagtgattatttcctcaaagaataaggatgcacataatgtatcataatttcttaattagagttctatgacaattgtagttacatccttccagggatagatatattatgacttgcaaagtttgctaatggctgaaaataaacaaaaaaaaatagaaaaatttctaggtaaaagtagttaagactagctttttttttttttttttttttgagacagagtctcactctgttacccaggctggagtgcagtggtgccatcttggctcactgcaacctccacctcccgggttcaagtaattctcctgcctcagcttcccgagtagctgggattacaggcgtgtgccaccatgtccggctaatttttgtgtttttaatagagacggggtttcaccatgttgaccaggctggtctcaaattcctgacctcaagtgatccacctgcctcagcctcccaaagtgctgggattacaggcataagccatcacgcccagccaagtcttgctttttgggggcaaggaatagtaataaatgtaaaagacctgttttatggaccctggaacagctcatgactttacttagaagtttctacagaaataactaaagaatgacatttctccaaaaccagttgaagaactttttagttagatgatgacagacaagaaagtcaaggttaatttgagatatgctggtagaatcctaagatcattaaagctctggtatgaataagaaaagagaaaatgacatgaaggattctgacatttagaaaactagcaatgggaaaatgcctttcacattctaagtttatttgtgaattaaaaaaaaatgaaaaaagaagtattgggttatgttgtagatgcttctaccaatatggttattattttattaagttgaagatcttagtgaattcatcaaggatacctgactgatgagacatcttggcaaaaaaaaaataataataatttggaagaagtcacttaatctcactgtgccttaatttattcacctatttaactacagggtttatttccctaaacagtatgatatatactctttatattttttctagtgttaacattttaagcttatggaaaaacatgactacctacgagaaaaataaaagtaaattaaatcagtgtgttgtgaagatcccatgtgtttcagcattcatcagactgaaggcagtctccaaaacatccaaacagggtttttgagaatttaactcttggatctgttcttcaagtagtataatacgtggtttgacatgcatgctagacacctgtttttcaggatggtaccaaaacaacagaaattctgatgaattatgtcattcgagttatcacaattgattattcaaataactctccgtaattatgatcttgacttctacaatgtaattataagaaagtcagttgttcaaagatatccaaaatgttcacccttggcaagcgatggatgggaagagtggtgacaagaatctgaaatttgaaattaacctgatgtatttgtaagtttttcctaacaatgttgccgtccattaaggactgtttttagtggactttcttaagcttgtatagagttgacctgaaggatttaaaaaccatttcagtttattcagtgtttgccatgtatgccatacacatcatacactggagtacatttaaatatcattaaaatgtaccactgcataagacaggtctgctccttccttgttctaaggtaattctgtttcatgggttagtcagacacaaaccggtgttatcacacagaactgtcacgtatttgatctgcaatgttcaccggttacatggagctaagaaatatacagaagctaatagagttataaagagtctggaccaagaatcataagacccagttatgagttgttaaaagtgagggtgaaacatgtcccttcagttttctcattttaaataagactaaatgatctcatcttttttattttctttaaaattttaaggccttatgcaaaaggctgaaaatctaaatggctaagatttaatggaatccataggatttcaatgagatttggaaaattcatcaactatgtggcacagaaaatacagacagcacacatgtactatattctgtatgggatatcaggaccaaaacaaaacaaaaaaaatcaccatccaggttgataaatggaaaaaagagggtagagatctcttcctgatacatcctcagagaagattttggcctccctaaaaattccactgaaagttaggtgtctctaatgttcatttttcttttttttttctctcaagcttcatagagatcctctatatttaagtttcagttttgtttatctttaaagatctcttcactgttcagaatttcttttccagaatcaacaatcactttccaaaaattgctcttatttttaaattttgtacattattttttccatcaagaaagatgattatcaaaaggaagtttccttccttccttccttcctttttctctccctttctgccccctttgctcccttcttcccttcctttcttttaaaattactgatggctcagatacactttctattcttcatagaataaaagggaacatgtattctggcaaaaaaggaaacagactttactgacccagaaaagaaagcatgttttgaatctcatccatctcttccactggcattttaatgtcctcccataattacacactgcttgcttagcatgtgtgatcataggaccaactacagggatggcttctcactctttgatttatattctttaatggactccagccctggggccagcagagctagaacagaagacgcagtctgcccctgatatttcctggtctttgccaagagtttgcagtcaaaaactctcctagaaatcatttcctagagataatcattcttaacatctatcctctggaagagatctctcacctgttcacaagcaccatacctctcagagaatcaaacaattatttaaaaatggactatgaggcaactgcacacagagcttatccatctacctttgctagaatacagagaggcatggagcagtggaagcatatccagtattttgaatttttaaaaacatcatgtgttttgatcatataccctatgactggactatgggaccagcttcaggtttaaagcagtgaagctgtttgatggaaacctgtaaaacttaatgagaatgctgagctctagcatcaaagccgttggctggctcagaaaggctgtggggacgtgggcagaggcagacttttacatcttgtgctgcttcttgataatctgattcttggatgctttgcccaactttacttaaaaggggaaaaagaaagaaagaaaaactaagcaggcagataggaatctctttcaacacacttttttcttaaatttgaagaggatttggtttgttagtttgcttttgatcaaggagatggtagtggtagaaaattcttgtctctcttacctttttggaataactaaggtcacttagtgtgatatgctgggacccctttggctagatgacttttcagtaagaactttaagaaatttatataaaaatgttttctgtgtttgcaaccacagaacttaaatattattgtagagagggaccttaaggtacacagagattaatgctttcacttgaaagatgaaaaccctagtgctcatagaagttgaataaaatgcattgcgttgcactccacatagactggtcaaccttgatcactgggtagtctaaacgattaaagactgcatctcatgaagccagttttgttagttccttcatgcttccgaccactcaagctccccactccttttcactttaatctgaagcatatctggtttgattgctttgtttgggcagaaatatgtaaattttgcttgtgtttgtattttgtattcttctttctccaaaactgtaaaaagtcaccttaattctacctttgaagaatctctacactgtatctcccactggatctgtttcagtatatttacatggaggcttaggctcttttgatcatttattcctataaaatgctgattctatgcagagttttctagaaatatccatggcagtgaataataaacagcagccttgattagggtgaagttgtttcccttgcatcatttgcttctgtatcaccttatatttctgttaaaaatgcgggtctactgttgaatcagaagcaagggggacatgaagctgcagtttaataagctctcagatgatgcttatgcacaaaactctgaaccactgacctacagggtaaaacccaattcctttcctgcagcagtcacatcctgtcattactttatccatttcaacatcatttatccaaacttttatccagcacaattattgacctcttttccccatgcatcttttctccagacacactaattccagatataccctaaacacatcatttattattttacacctgcaccttttctccaacttttcctgtctcgactcttatctctatttttgtttacttggtgacatactacttttcgttcagtgccatactacttttctcaaatgttacctccttgggaaagccttttcctaaatatttctcagtcaccatccctatactgcgttgcaatagaatgtagcataaatctctcttatagaacctgtttcatttgaatgtaattacaatgaatctacacaaaggttatagaatacctactatgccccaaattataccattaaagaaataaaagtcacaatctctaccatcacaaaaattactatccagcttttttcaacccaaatcctcatctgaaacagagaaaacagaaaggtatttgagtatttcctcaattctcccaaggaggatacataactagcaccattacatacaacagatgtcttagggctttagggtttcatctacttgggaaaccccagttgatcaaatactggtaaaattacattacagtagcaataaatgctatgatagagataattcaaaggtgagatgaaaaagcagaaatatctaattgagtatgtgtttatctctcctcaaccatgtcttaatcctgtttctatgcttatttagcatctagatcagtgccaattatgttgtggtcattgaatacattttattattgaattaaaggcattgtaattcatttttattagtgtgactctttggaatctggccgaggcaatgtgaattatccatatttgtaaatccagcatctagtcagtgcttaagatactgttggcactcagtgagggcttgtagaataaatgaacacatttggaggagttgccctattctccagtagaaactcaatagcaatgacaacaataacccaattaaaaatgggctacggacttgaataaacatttcttcaaagaagaaatacaaatggccaacaggtatgtaaaaagatacccaacgtcagtaatcaccagagaaatgcaaattaaaactacagtgagatatcacctcatgcctgttaggctggctattattaaaaaagacaaaaaagaaaaaaacaacaactgttggagaggatgtggataaactggaagctgtgtacactgttagtgaacatgcaaaatggtgcagctgctctagaaaacagtatggaagttcctcaagaaaataaaaatagaattattatatcatgcagcaatcccacttctgaatattcagccaaaaaaaaaatgaagtcagaatttttaagagatatttgtactcctatgatcactgtagtagtcttcacaatagccaggatgagcacacaacctaaatatccattgatggatgactggattttttaaaatgtggtatatacatacaagggaaaattattccgccttaaaaaagagaatcagccaggagcctgtaatcctagcactttgggaggccaaggcaggcagatcgcttgaagtcaggagttcaagaccagcctggtcaacatggtgaaaccccatctctaccaaaaaatacaaaaattagccaggcatggtggcataggcctataatcccagctacctggcaggctgaggcagaagaatggttgaacccgggaggtggagggtgcagtgagctaagattacgccactgcactcctgcctggccaacagagtgagactctgtttcagaaaaaaaaaaaaaaaaaaaaagaaggaaatcctgcaatatatgtcaacaagaatgagcctgaggacattatgccaagtgaataagccagtcacagaaagataaatactgcatgattccacttacaagaaatatctaaaacagtctatgtcatagaagcaaagaatagaattgtggttgccagggcctggggcaagggagaaatggggagttgccaatcaataattataaaatttcattatgcaagaagaataaattctagagatctgctgtataacattgtgcctctacataacaatactatattgcacatttacatatttgctaagtgggtagatcctatgtgagctgctcatacaataataataataataataataataaaataaaacttctttcatatattagaatatattcatttggctagatgacatagttatcttttcccaagccacccatcaattttacagtcagttcttccctctcagtaagattgaaaattaaagaataataaagttttagaattgaaaaaagtgatagttttaatttgaggatcagaagtaatacttaaagaaaaactactaggaatgcaaaattcttcctttgtggttaatctacatttataactattccacttgacatttaattgcttcgcgtgttatgtgtatttcaaagacaaaaagaaagagtttattaagactgcaaatgaagtgaaaaaatgctgcatttttctgggtggacagtaggggtggtggtggtattttcagtgttattgtcatctaacgaagcctaatttagtttgaatatatattttggaacaaatagcctccaaacacaaattcagtttaggggaagatagtgtgaaaagggataaaatgccataaaattctgatgtcctaaagaaaatgtgagagtctgggacacctccttgttctctgcaaagcctgccgccagctcacttcagacaaagttgtctttttataaacatgatgtaagcatacactcacaagctctctggaaataatgatgtttctacttgtgtcagttaaaggcatccctttgttcatctaatcaccaagaaaatttcaaggcaggtgtgcttcagtttagagaggtgccgtacttcatgggtgcctctaagggactctttacaaaattcatgctgcagaagcagcattcccctaaatggttgcttaagactgcaaatccccaactgtccaatttatatccaaggaagagtttactttctttagggcataagccattatattacaaagtcattaaaatggaaataaatacataagttagcaaattgtggtaaggtaaaataatcttatataaaccatggcctaaaaataaagaatatatacagaattcagcatgaggatattaccatacagaaatgataattaaccaaagtaaacctgcacacagtgattttctgcattttggcaagtgaaaaatttttgctatgaaagcaggactctaaaaatcaaaaaaaaaaaaaaagtaaaggagacctagttttgaattgatattaaaacacacaggcattttactttaatggtcatgggcttaggtccaactatttcagaatccaaagcttattacttagatagtcaacgcacatcattccaagactgcagctgctcctaatttggattgttaggggattatccctataagagtcctcatggctcatctgccctcagtgtaatcagatgagaagatcctgacttccatctccagaaagaaggccaagcccacctggggcctgggggtaaatgagaagcccacatgggtaaatgagagcttctgtgggatcttgacaccgagatgctgagactccaactgtaagcctcagagtcactactgagctacaaatcagcagttttacatttattatttctaaaatctggatttgagttgcaatcaaggtatatcctgatttagattaattggcagtgtttcgtgatccataaaataattgtgcaccaatactgccaatgatgacaatataatatggtggttgacgtactctagctcagtgattttcaaactttaatatgtatattaaatcacttggggatcttactaaaatgtagactctttcagtagatcatgggaaggggcatgagtcttttcatctttaacaagctcttaggtgatgcacatgctgctggttcacatccacagcttgtttagtaaatctctaggtatgctatgagttgttcatgggctttatttccttttaaactacctaaaaactacagcttttagttacatgtccttgtttaaaaattgttcctatatcttctatgtagctttatatgcacatattgttaaacagataataaaccaaataattattaaataataactaaaggtaatgttaatgaaagattggtttcaatccttgatgatcacaccttatagcctggataccttggggaagaaaatgttactgaataaggtcaatttactctttcaaacaaacatttcagacgctcatatgagactctgcttggtttacaggtagtgaacacaggcagggaagactaattgcttctgaaaaataatgcgaaatgaaatctgatgatgacaatgataacattcttaagaactaaaataattacttgtatttgaactataaaaattaactgactattcccaattcagttcctttacaaggtacccatatttaaaaaaaaatccagtttcttatttatctctaccaatttttgatacattagatagtggatgtcatcatttaggatagcaaaatggaaagcacactgggcttggagtcaataaacagaggtttccttctgacttttttcacatattagggatatggctctgataatattatgtatgatttgtggtctccaagttaattcaattttctcacaaagctcttagaacaattaaatgaaacaacttttaatatgagacaatgtgtgcaaaatctcataaattcatctgcaaccaggacaattcacatatttgtaggggtcagtgtaaaatgaaaatgagaagccctctgttcaaaagttattaagaatttcaagatgacaagaagaagatattaaatgaagagcagggcccttctatgtgtggagccccatgtgactgcataggttataagtccatgagaaggccctgtctgcaagataattgtagctaatcctcactatattaatagagtattaataaagtttatacttgattgagatattacaatataccaggcactactctcagagcctcaattacatagtctcacttaatcctttacaggggaaagaaactgaagcacagaaacatcaactatcttacctcaggtgatacaactaccaagtttaagggagccaagattggaatctgggagtgtctgattctaaagccattcatcttaactaatttaatgcaatgagttatctataaaaagttattgttattcctgtttaattcaaatttagaaacctaggctcacaaaaatacgtccatatttcaagggcaattcacttactatgaccttgattaaatgacctatgtcaacctaattgtcttatatccctagtactccacagagagcctggtacatagtccattgtcatgtactatatataaaactaaacactcagtcaccaatttttctgtgcacagaatatttactccacaaagataaaaatctcattttcctattattcaaaatcacatgcttcggaataagagtattattttcatttaaaagcaattaatttgttttaaatgtgtttcaagagtgatgattttcctggggaaaaaaagacaccaattaacatgcacagaaataatttccttccaaacataaggactttgatccaaagatctaaagacaagagtatatcatctcataatagaaattaagaggaactccaaaatactcattttgttttggatgaacttcagatttttaaaaaatatggctcaaacttagttaagtaacaaacttaaatttatatgaaggtgtttttctttttcttagcaatgtgttttctgatccttcatctcattttatctttcctattcttttccaattgtgatagtggaactaattcactgagcttcagtcccatacaatatcatgcccagtatacaactgagcagagagacaaactcagattacttgattaccttgtctttgaaattattactaatgtcctctgcaaagctaattacagcttccattgtattattagagaaatttttcatacctcacttaggaagcttgtattgtaaatctatacttatttgcccaactctctctccagattcctgagtgcattatcttactcatctatgtgccccagtgtctagcacagagcctggcacatactataaatagatacatatatatatatatatatatatatatatatatatatctgtacaaaacagaatagccagatcacttagcccatatactatagtcattactagaacatagcttgtaattatatttatatatatatatatatgtatatatatacacacacacatacatttatatatattttttgagacagtctcgctttgtcatccacgctggagtgtaattgcacgatttcggctcactgcaacctctgcctcctaggtttaagcaagcacgtttcactaattttttgtatttttaatagagatgggatttcaccatgttggccaggctggtcttgaactcctgatttcaagtcatctacctgacttggcctcctgcagtgctgggactacaggcatgagccactccacacctggcccatactagatagttttaatgttgattaacataatgcacacatgcaagtgttaatgcataagcaaatggagcaatttaaacaagatgctctggtaggtgctgaaattaagagaaaatgttcagtctcagacattgttcattgctgctttctactgggctgaaaaatgtcatattctataaaatgtatcaagtcctcagaattaaaatgtcactgaaccccctgacagaccatgctatgctagcttgatatttgaaagcactacaattcattatgccaactgctgatactgttccaggctatggggcatctgctgaaaatgatgggaaataaaaatctgtgggtcccctggaaaggaaagattctatgtttgaaaagctgaattccagacaagaactcaccagatgctttgtggactgaagagctgggttccatttccttggggacctgagcagatgggactccctgaatccactttcaaagaggagtgtctatggcaaggtgcctggtttctgccccaattgtttatttcccttgcctccaaggctacaatgcacagaagtgaacttatccttagcaatgtatagagccaatactttagaaaatctaaaaatctagaaagtacttccaaatgtgttttctgtgcattcctgtttgtatggctggctacacagtatggaaaataaagcaagcattatcttagtttgccttaagaggaggaaaagtgtgcaggctgccagagtagggaagaggttcacagaggtaacagctccagaccaattcaacccggggagtgggaaagattccactgaaagctcatatataactaactgggcatctgagaaatatttcctgctgcttcttctccccaatcagatcttcccttctctgacatcccagcaatctaggctgcatttttctgttttcttttccctaaaggttcctacgaagctcatttcgtctaattttatctttataaaaatactgagaatgagagaagtgaagtgagattgtaatatgatacggggagcaacacagagtggcagttacgggcaaggatttcgctctcagattatttgggtgggagcttagttttgttacttactaattattttcccctaggtcagttacttcacttttcctatctccatgtcttcatttgccaaatagggatagtatttatgtgtacctcttttcatgcttagagtattacctttgcaattatgaagctctgagaaactggtggtgcatccctctctgcaatataataatcataatgtattcaaaaaagggctagtaaagacaaaataccagaaatccaccaaaaacttgttttttttcttcttcttccattactccctttctgataggtttgaaataccaagtatcaaattatttcacacagtttcatggatttgtttttgcaaagttgttgttttactgtgttcctgatgcccccaggcacatgcctcttgggtaactcactggatgttgttgaaattttatgagaaataaaaaatgcttaatatgttattattatgctttctctggaatatgctgactcccttaccccttcagcaaaagctcctacttttcatgtacatttgtatagagcctagtacaatcataggcacattgaggcactacagtgtttatgccatgggggtttgtttgaatgatctgatgcaggtaaagtgctctactaacaggactatcaactcagggatggcactcacagccatgtgttctgttgaggtctcatgagttctcatttgcataagggaatgattattattaacctgcgtgcgttattgtgaagacttttaaaaggaaaggaggatttttgcagtctactattctacacatgaaaggaggcaagggtaatcgacctctgcatttaagtactgacactattacagtagaaggactgaaatacatttcaatatttccgagatctagaagaaactaggctgggcctataacaaactgggttaatgacacataagaatttgtcaaagcctttgacatttccacaaaccccatctagctttcttgttaaagttttcaaagcaaaactatcatcttccatgttttaaatcaggtagaaaaaaaatttctttctatacctgaacttctgccaaaaacattaagcccatttgcctattctagatgggctaaaccagcctctctctgagtcactaaaccaagaccttgcctctaggaatacagcacagagaagctagaaaattgtcattcagccccaagccatcatctctagtgctcactaggctgtacagaatagaacagtcagagcacttagctcaaatatatactattgttattattagaacatggctactttgtgagtcagcccattccagctgacacaacaaaatgacatactgtatagtgcatactgatcctacatgaaacacttttaatataaaagttagcctgtagccacagtcagtccactggtcaaaaattgagcatctgctgcgtatcagcctggccaatgcatgagtacttgagtgaagggacttctttgcattttctcataggctattaatcttgcgggcattagcaaaatctatcttaaaatgattcatacaggccaggtgtggtggctcacgcctgtaatcccagcactttgggaggcccaggtgggtggatcacaaggtcaggacatccagaccatactggctaacatggtgaaaccctgtctctactaaaaatacaaaaaattacccgggcatggtgacgggcacttgtagtcccagctactcgggaggctgaggcaggagaatggcgtgaacccaggtggcggagcttgcagtaagccaagatcatgccactgcactccagcctgggttcatataagtgaagatgtatcaccacataaaatcaaggtagtattatccatagttctataatgatatggtaagtaaaaatatgtggatctgtatggaaaatgtttaggaaaaagtgaagtgggaaagcaaaaagcaactgtcttcccgaaagagtgagggatgaggcatatgggaaggtcaatgtaagtaaattgtaaaatggtaccaaccagtatatggaccatgacaaaataataagagaagagaggcaataagtcagggacctcaacaaggaaaagtctagaggaaatgaaaacctggggataaattgtttaatcatgactttggaatccatgtgagttctctgccaactaaagtagccctccctcctctcatctggcatgatttccagacatcactgaagatctctttttcctccaagttcctgctaggttaatttatccatcaggtccaaagccttttatcccaaaattggaataaattggaatgcaaattctgccatgagattttgttcttacgtgtaaatgacagatactctattcctctctgagcaaacaggaaaataagcaaaaaaggggaggagcggggagggatagcattaggagatatacctaatgtaaatgacgagttaatgggtgcagcacaccaacatgacacatgtatacatatgtaacaaacctgcacgttgtacacacgtaccctagaacttaaagtataataaaaatatatatatatatatataaaataaaaaaaaaacagaatatccccttttggaagtagaagtagattaacctattaaactaatatcagccattcaaaaaaaaaaaaaaaaaaaaaacttgaggaaccaaatttgatgaggatggtcaaccacagaagtgcataaattgagaagccttcaaaactttctaaaactttctctgttgtccaaaagaagaaagatagggattaaggggcatttgcaggaaggaaatatttcatctctttcccagtgttgatgctggtacactgtgatgtgggcacttcatatggcagaggagatcacacagatttcattaaggaatcaatcattttttcctcaaggaaaggaatcaagcattttcaccaataaggtgagggaaaatgcttacaaaagataggatattttccaaacctcatctacctcagtagcatcttccagatttgtggcaataaatgtttctaagtgtaattaaaggctgagccgatctaattaggttgatgaaattttcagtgggacttcattccccttagcatttcactcattttttttctctctctctagaatacttccttaggcttaatctgagcaatttttagtggcagcattctaagttacctcacacaggcagtgtctccactctgattgtaaaacctccagcaggtacatatgactaaaaacaaacttcaaataaaggattctaggttgttttatttaacacacagtcctttcctacctcttcagtttcatttccttactaacaaactacgttaaataatgttcactctgcaggagggaaataagcatttcagagcatttcgggggcacaaagagaccaggaaatgcataataattgcaggaacaggttctgagggggagattaatgagggagcgccatgacccttcctgataggtcagtgactacagaaacacttatacgatgaaaatattgggatagaaacacatactagtgagattttcatctatctttaaagattcttaaaatatatctagtgagcacctgaagaattaactgtaagacttttctacaggaaaatgctttccaagtggtctaaggtaaatgggcaagatgtcctcatagagtctgagcatctcagacaccatgatttctctttctgcaagattttctaacctcctctccttttgtagcagtcactcaaaaactgcttgttagaaaatttaattaaatataaaatgatcgaaaattcttaagcaacatatatttcagctcttactcagtgttatcaaaatgcaaataatataaacaagtatttctgtcaaaacagtgttgcctttgcaaaaatcagatttagaaagcatatttttttaaagacctattatcttctaagaatttcataggtatgggctgcatataatggcaatttattatttataatttttctttaactcttttttttcaaatttaaacctgtgagtcatttttcaatgagtacagatattttcccagactttgatttacttgtgatgaaaatatgaattatttaaaaaaaactactttgatctctatttgaattcccggccattcaaagttccttgtcattttaaacaaagcaccatatgaagttcaggttaggttttaccaaattattttgagctaatcttattttattttgaaatttgataatcacatacacaaaagtaactttccaattgagggttagttgttctacgtgcaagcaaagtctcatttcaaatagacattattaaatgccatatagggaaagacctaagttgcttctaaggaatatgagattataggttgtttcaatatgttgagtgatttccttttttttctttaatctgtaaagaataaatgtgtaaattcgtgagagtgatatttttatgccttgaatgccattgtttacaatgaaatagaatcggccatttaaatattatattttccttgatagggttctgtattctaatcctgctggacccccttattactcttggtcaagtaacttctctaggtctgtttccccaaaggaagaaagttgaacttagaaaatgatttccaggatcctttccattctaacactccaaaatttcttccatgacttcagacaaggtgttattagaatctccttcaagactggttatgctaagaggcactacatactagactgaaaataaaaatgccatcagccaataaatgaagtcataattaagggtttacacatgcagtgtgctatcgaccaggaagtccaagctagagttcaggaaaatttacatagattttactgttaagagagattctgtgagaatgaacatgggtatatccctctcttttcagtaacttcacaaagctgacctatttgaagtagggtgatttaactcacaatccatgatactttgtcactatttcatttcagaagtaacaagagcagggccttctaaatagataatggttcagacaggatggaaactatcaacaactaaaaagccctccaaagtgctgggattacaggcatgaaccacgacacccagcacgttgggaggccaaggcgggcagatcacttgaggtcagtagttcaagaccaccctggccaacatagagtgaaacccgtcactactataaatacaaaaattagctgggtgtggtggtgcatgcctgtagtcccagctaacttgggaagctaaggcaggagaattgcttgaacccaggaggtggaggttgcagagagctgagatcatgccactacactcccctggggaacagagcaagactccatctcttaaaaaaaaaaaaagccctccaagtgaggtatgttttgatttatagattaattgtgctgatatccttccaaactccagtgcatcagaagaagtaaaatgaaaaagattacacaagtcaagaaaaaagtgaccgtgcttcctcagacacacaccccagatggggaagacagagttggaaagtgtccaatcaataaagaagagtgaattgtatccaaaccctatagtgacaacagcacaagtgaatcctccttttatgagtttagccactgtgaactaacatgtcacttggaagaccacctaacttattttttggtattgtggtttttctggttaaaaggccaatataaaaaaaaatgaatactaaggtaaggaatctttatttatcaattcataaattagaggtgttaatctgaagcacggtttaatttgaaactgttattttagattaaggcaattaactacagttttatacacacacagaaaaaaactgcctcacttatgcagaattatcagaagattatgtgtctcagctgaactcaaggattccctgcaggaattactattattattatttggatgcccaagagttctttagttagattcccatttctgctagagttccctcgattccccttcctttttccaatctaagcaggattactcttctctgtataaagcaggatgtagggactgattatacctggcctggctcacagtgaaaatgaggaagttggtacaggtgattggggatgcggctctgccctccactttccatccctagaatggagtttcagaaatcttctaaaaatatctaattattcttttaccatacctgatatgctttctccatccctgcctgtctaaattagtcactgtttgagatgctcatattctgactcttctgtgtttctctccttgtcttctagaactctcactcatctcaccctctttttaaatcaaataactgtgttaaataatttaataattcattcctcacagtctattattcatttgtaaacattgttttagtttgtaacaaatttgagagtttgtacaatcttttaggaactctaacaaacatttctcttgcaaaagggctcttaactatggtagttaagagcacaaggacactgaaatcagacttcctcgattaagatttagactttcatacttgttagttgtgtgaccttcctcaagaaacttacctgcctcaaacctcagtttctttgtctgaaacatgcagataataaaatgtctacctattttgtgaggattcctgtaaagctcttataatagcacaaaataacagctctggaaatattagtactataataataataataataaataataataataataattagattatcatcctctacagagcttaacacaaacctggatcatactacatatttgtaaccagtaaaagttactttctgaaaggcaatctatcactcctactacaaagcatgggtaggtttggcctttcagaactgcacctcttcatgtttgttaaaactattgcacctttaaatctcccttaggattattctatatacatccacatactgggcaacaaatcaaccagtatgttcacataaagagaagacagggaaggataattcagtagtaattgtttttccctaatgcttaactgaatcaagtttatatgattaaattatttacttcagaataaaccaagtacatcactgcttaccaacagcacctatggctaacagtgaattcaaagttatttaactttgatgtttagaaatctacaccattaaattgtaggcatacaatgtaagaggaacctctggttccagtagcccaaagaaattggattgtgtctgaatgaatttttttaaagacagcttttatggaaaatattcattaaaaaatgaaattcagggacttcttcatctttctctccccaaaacccaacaaattccaatcttatacaaagttacaatacacaactacagctgataatgagggatgaaattattgatgtcatttagtttgatgatcttgctcagataaatatcaagtaaattcaccagataacatttacttcctccagaatgtgttgaaaataagggaagaaaattatgtcattatatagacttattttgttttagttttgttttgaattacatagtcgttgcttctcctataggctaattgctttttcttcttttttcttttaatactcaaaaaagtcatcactgtatgcataacacctatggcatttaagtagaaataagcaagtaaaccatttagctcaactttagacccagtatctctttttgtttgactttcttttatagctaatatcaactgtccacacaaatctcaaatgtaaattacttacagactaataaagaagaggaacctaattccttcataatgatctatgagctgtttccctcccccaatcctacataaacaatagtagaatattgaatttaaagttgtgccgtttgactctggaacatcgggtcttcagcaaaggtgctttcatgctggatctgaaatgatgagaccatgaattaggaatgattctgatggcaacgatatttacctctttgagacagcccataaagttgttactgactggtgaccctggaaggtcggctgtgctgggactgcctccaacatagaaaaagtcatcagaccccagcatggtataatcttcttgcgtgtagcccgttgtggtaagaatcccatccactgatattgtcacctagataacaaagcacagggaaaggacacgctatactcagacctagatactgtaatcctgggatatgcctgttttgtgttttgcttttgtttttttgttttgttttgttttgcttttttctttttttctgtttgtttggtttttgtttttagacctatgacggaacccattttcatgtctgtttgaggtttattcttagattctattcaactagccctaagagatctaaactagttagagagttaactgattattgaactagtgtcagcatcatccctactgcaactcaaaagttattgagcagacacaaaaatggtgttagtaaaatgcttcctaggttagttttgctggtgtacatattagtaaggtttagttgtctgttattaactaatcacaacgtgcaccttgttaacataaaaggcgcaagctatttccagcaacatcactatttgcactattgagcagcaattgttcagcatgcaagtgcctaagtccatgccaaagggagagaaaaggcaaaacaaccagtagaagcggcacacgctgatgtgcacatgcaggaggtacagtacagttcagaaaaggaaagaaagaaaacagggagaaccaaaggaaaaacataaaaataaaaacaactgctttgtgatgacgtaaagatgagtgggtgtggcatctccagcattcccaaatcaagtttccatgccatgcatcatgaatggttagagactggctgagctgcggtcactcgggccagccaccattttgtcttatcccgtgttaaccacagctggatgcaaaacgttcgaaacgttaacgatgcccctacaggtgagttggaaaacagaagttgacaggaacaggtaaaaaataagaaggtcaacaacagatgaaaagaaggaggtcaaagtaagcagaagagtaccaaccgcagttcctcttttgttaatgatgtctacagttaaaagaaagaaagaaaacacacggcaaacccaaaataagaaacaattagaatgatatctaccgaacaatgtagtttgtttaccatagcgtgtccaatgcctgagtgctttgtggagaaggggggagaaaggaaattaaaaactgtgaacagaataacgatcgttacttaaaaaatatgatggtctctaccatgttagtacattttttgattcaggtaacggttagtagaatgaaacattccatgaatgacatgttagttattaagcatgttagtaacatagaaaaagggcaaaaaaattttacaagaaaaaagcagactaacaagtaggcctcccacagaggtaatatttttcctgctattattgttcataatttgctactagacagaaacagacacatgacaatgttccctttgtcttcctgagtacatctgagagacattggaaaagtctaaaagggattcaaaggcctaaagcgtttcagctgaccactgcagccctatgcccatacttgacccctcctccaccctggcccaccccagccccaggaaattagtaggaatcagttggcattgccctactactcaattttacagcatacaaggactcctcctcaacttcaaaacttccttcggtcatattgatggactttagggtcacagtttactgcaatgaaacaaagcaaagatcctgacacatagaatgagtagaatggatttgtgtttaatctgtcctgctacacatgcaccccggctgtataactacagtttcctttgagctaccaattcgcagtttggtttgtaacctgagcaaaggcaaatctagaaagtggactccttgagcccccacccttccttctgtgcttctctcaaatgagcctctggtttctttgtgcatatctgagagaaaaaattaaaaaaggaaaaccaaagagacagacttataggaaatccatggtctacagttatactgatggtggccaatcctctccaaaggcaggtggaagcatgcagggcccctcccatgtcaatgagggatctggaaggtctggggttctcaagaatctttcagttttatttgtttgccttagctagactaaatctacactcctaaagctcctttttctttctctagctcagatagtataaacctttcagaacaggaaagaaaaggttagacagttaacagctctgaaagagagggctgttttggtaaaggaaaaccagagacaatccggtcattctgcaactgttcagagaaacaacaaatatgttaaggatattagtttaagatcagcatgtacggcaataaaattagtcactgtcaacacttaacaaaatgatacactgtaatataaagtttcacataatacccaaaacttataatgttcaatataaaaggacaatctattcattttcattcgtatatatactgtaatcacgtattcattaaaaacatacagtatatgtagacccacagatttagtaaatagttgatattttcctagtatatagcatcttgaaaaagtttttttaaaaaaatacaattaaatagaaatgggcacctagaagattaactggcctttccagagtcatttggggtttaacttaaagcatctatgctaaaaataaaagtatcttcaaaaacagacccttcaggagatatgtaagcccctaaagaaatttttcccctcagggacttctcttgtccccattttggggttgggaggaggagggagtagggactgatacaatcccaaatcacaaacactattttttcgactacaaaaaaggaactgtgacttaatgaccccaatgtgcatgcttccaaatgatcaccatgaaaactacaatttaaaattaaacaaacaaaaaaaccaaaaacacaacaaaatcacacacatcacaggaagggcaggtcgcagggatatccttgcagcccttttggaaattttcatatggccctgtatcaaaatagcctttgggctcccagaactttctagatatgcccctgctcaagtatggcaggaagattcatctcagaagaagaaaaagctaatttgcaagtgactctgaggagccctgtatcatgttgttagagtatttaagtaccacacacacagctatagcgagaaacaaagccagttactctcttatccactgcgctgttacctgacgcagattcctggtgactttcacatcatgccaggcattatcattaaactttccattcacaggctccactagtgcttcaaaggcccctgatcccaaattaatgaccagagagacagctccatttttcagggcaagattgacataatcagccgatttcccagtgtgaagcatcagtccattcctctgaagggttttaaatgacagagttatttcatcactgctgctttgaatggggttttgagacaagtcgtagcagaagtattcagatcctttgaacgtggcaatatattcttcttttcctagaggaaaacagatgatacatacataagtaaacaaatacactatgcaaatcagcaggtcttaacagaaacaatagctaatcactccccaaattaacctgcttaattagatttcatgacatgaactctgtctcagtcaaacagtactgtacagggcagtattttttaaaaaattttattattattatactttaagttttagggtacatgtgcacaatgtgcaggtttgttacatatgtatacatgtgccatgttggtgtgctgcacccattaactcgtcatttagcataactcatcctaatgctatccctctcccctcccccaaccccacaacagtccccggtgtgtgtgatgttccccttcctgtgttcatgtgttctcattgttcaattcccacctatgagtgagaacatgtggtgtttggttttttgtccttgagatagtttgctgagaatgatggtttccagcttcatcacacgtatgtttattgccgcactattcacaatagcaaagacttggaaccaacccaaatgtccaacaatgatagactggattaagaaaatgtggcacatatacaccatggaatactaggtggcagtatgtttttaataaatctcaactattgggccatcaactgcagtagctaaagctgacattcttgaaaattcaattaatttttcagtatcactgcaagagctctgatcagagaaagtagttctgtgatatctccagggcatgaatcaggtaccataaatgcatattggatggttccactctgctgacaacaatggattccaagatgttttcaacattctctccatccaactgaggcattattttaattttcagtgaaacatttatgttcaaagatctttttcaatgaagagacaaacagttttatcattgagagaccatagaaaattatctggtaaggagaaagggaagaaaaaaagatagaatctggtctgggagtaaacagacctcctacagagcatgtgcattttttatctctggatggagggagtagtgatagaaagtctaatggagtcagctggattactgatctattccctggtgtagttaagcagatggtagggctggctgttatgacactggtaagaattctagcacatcgtcatggggatagcatgtaaatgaagtctcaacattttctacgtatcttattctttaccagatttaggagtaacaaggcggctctcacgagatgctagacagatcaaacagaaaggtggatatttggaaggaacagtcttctcccactgatgaggtgagttgaaccaaaggaagaatgtaagccataagaccccttgactttctaggcagtaatgatgctgtgccaagaaaaatgagacagcatggttgggaatcagcttctgataaactataaacatataattataaacggtactggagaaacttaatctgtcccactggcgacatactatcactattatgcccccgagagggttgatacatcagcaggtgttgcattctcccctgtaataggtttttaatctcaggactattttcatttgattgtcaaataactcacgtcctggaatcagagctcaaatcgctttcaacgcatcagtgccagatgatctgccttcctggatgtagaaaatggccatcagtggctacaggtagtcaaaccatagcaataaatatcacggtgagcacctacaggtattcaccaggaattgagccctggaatattagtcattgactactagcaaattattagccaagactatcagtcagaccaaataattctgagtaagtcataggaaagacctcccaatctgtaatagtgaatccctcccattcaaacgctcagaatattggctgagcacctcccaagtgttaagcccagtaccagttattagagataatgaagtgaacacaatggacttaattcctgtctcggaaagttatagtccaggtgtctgctcccctggtcagtccaacatggcaagtggttcaatattgggcacaagtacaactatatattactattatactgagaggaaaatgtgggtcaaaatatgagtttggattgtaggttggccactagctgtcactagaacaattatttgcttttcaaattttggtttctgaaaatggttagagataccaatctttcagaatgaatgtgaagatacaatgagataatgtctgtgcagacatctggtaaagttgatacgctggtgataaatagtcaatgtcttcctgcttgcctaattaatgtgataaatgtgataaatcatctaaaacaaacaacataaatcgtatgttattatgaaatctagaattttctctttaagataaaaaacaggacaaggattcccactgtcaacatttatattcaatgctacacttgacattgtagctaatgcaggaagacaagaaaagtatatgaacattgtaaagattataaatgaagaaaatcatgtgatataagcaaatatattgcacaaattgaaacactaaaataatctacagaaattatttggcttaataagagactttggaaagaatttagagttctgtgtactagagacaatcaatgtttcaacatatgtaaatagattcatagattcaatgaaatcctaatcaaaatctcaaaaaatttaaaaaaacaggtaaaaagctgattcttcacaatctatgagaaaaaaaaagagtcccaaatagccatgatatgccagagaaagaagatgaagtaagttgcctgcgtaaagatggacatttattacaaaattatagtgctgaagaaaatgcattaggataggtaaaatgaggagaataacgataatcaaacttaaaatattcttaagcatatatgaaaacaatttacactgtcaagcatttcagataagtgtgcaaaagatagattagtcaataaaggttactgggacaatcagttattcataagaaaaaagtgaaattggatctttacatcctttgttcacaaaaatcaattctacatggatgcccgatttaatttagagaggcaatctgtgaaaacttgtcagacaataaagtttgatatggaagaatggaaggacttctaaaattagcataaaggcactaataaatattgatacactcatctacattaaaattaacaatgctgggtcatcaataataccatagagtaagaagttaaataacaattttggagaaaatattttcacttcctattaatcaacaaaggattataatccagaatatgccaagcacctcagcgaatcaatacaaaaataaagacaaccaatgaagaacacacacaaaagaaatgtaatttcatggaaaaacagatatgtattgcttatgaataatgaacagatattcattcctattagtattcaggaaatggtaaaaatcaaactacattcagataccatttcatagccatgaaattgacataaaacgaaaagaaaagagaataattccacattttgccaaggctaccgaaagtcattcttatatactgctgatgctgataagataaaaattgaccaactgtaataagtttcttttggcattatgcaatcccatgggaatttcacatattacaaagaacttgggtctcagtccttagaaaatagttaaccaggatcagttaactaaacatttgccaattccttcaactcatttgtcattgcttattgttctgctcatttgatgataggtagtcaagtgggttctggttcatgtatgtgtgtgtgtgtgtgtgtgtgtgtgtgtgtgtgtgtgcgcatactaataattatatatgaaaacaatttatattgtctggcattgcaggtaagttagcaaaagatacagaggtcactaaaggttgctgggactattggttatctataagagaaaaatgaaattggatctttacatccttttgtttcccagaatcaattctacatgatgaaggatttaatttagagaggcaatctatgaaagcttttgtcagacacagacacacacacacacacacacacgagagatccacttatctgaatatggtatttgcaaaattttacattcccactgaataagtagatctctgagtcagcaggagccttaaagacaatcctgcagcccaacccattaatttacattattaagaaagcgaggctcatggagtttatatgaccctcaaattcataaaatgtgacagtaacagaagtgggactaggattcagactactaatccagatactgtctaacatgccacaacacctgtgtgtcagacagaagtgatatatagcattgtgaaagaaagaaaaaaagagaaaaaaaactgtttgtgaagatatgtcttagtaagaaaataataactgtgttttagtctacttagtttaaaagagcaggtaatatattaagaaagattccacttagataactaaattataaagttttggagcttgaagagttttggtccagtaagaaggctgtagaattttatccaagatatcttgtatcattccaaatctgcataactcagaataaatctcaacaaaggttttgtttgccagataatgtggcatacccaaggggttaaataataaacagtttgcaattcactatgtaataaactttgaagttatatgggtgttgatgtatttttaacactatgatattccccttacttaaaaatgaaaatatatcatttcttttgtattgtttaattccaaatttaagtaattcaaatttacattaaaggcaaccacatagttttggaaaaaattcagtctgtggaatatgcaattaccttaaaatgccataaatgggacataaatctaagcagggaaaatatttcttcctatgttctttttcatgaaagaacatatatactacatgaaaatacaaaaatcactttttcacaatatataagaatattatgtttcatctaatcatttgctaccttacaatctttgtaagtaagctttgtgctattctataaacaaatactaagcagcagagtgtttacatatgtgtttctgctgaacacttaaagaataagtctacgtccatttttaaatacaagtcccaaataacttttgcatttctactatgtgctaaaacaacgaaaatgaaaaagaaattagacccaaagccacgtaaatgtcaataaatacttatatctaggatacaaagagacctcttacaaatcaataacaacaacaacaaaaaacaaaaacgcaacacaagccaatgggaaaaaaatgataaagtagttgaacagacattaaagtataaaaggctatcttcaaagaaatgcaaagtaaaccataatgaaataacagcacactccacagaatgaataaaatgaaaaatacaaaaaaatccagtgtcagtgaggatgtggggcaactagaactctcatacattattggtaggaactattttgtgaaattgtttggcattctcttttaaagctgaacttgggcctaccctatgatccaccaattccactcataagcatatatccaacaaaaaatacacatatcatcagaatagcatactagaatgtttacagtgttaccctgcataaattatctaaaacttaacactactgaaataacaaccaataatagaatggataaatttcagtatagtcacacaatagaatattaaataacaatgtgaatctatgagctgcaactgcaacagaaatacagataaatctcacaataataatgtttagctaaaaaaaatgcctgacacaaaagagaacatagttctgattccatttatataaaaaatttaaaaacatgcataactagcctctgttgttgtaaatcaagacagtggctatgcttggtagagatggagaggggatagtagtgaggagaactcttggggtacaattaatgttgttcttgatttaagggttgcctatgggtgtgctaagcgtgtgaaaaattaatttacctggacatttatgctacatttatcagcataaatactatatttcaataaaatgtttgaataatctggatgattaagcataaaatgaatttgtctgatgaagtattttcttcctgattaataagatgatatgagaagacactattcctattaatgctactattaatagtaaaagctaaaataaagccaatagtaataatttcaattgtcactttttaaaacttttcaatgaatattaatatcctttaattaccatttgctcttaagagtaatctctcaagatttaaaaaatatatatatacgctgcttggtagtaattgtttgaagatccatatcttaaatgtgttgattaatggattgattcaagatgaaaagagcctctatttctagccacagcaatgttatgataaaattgggaaaaagtaatatttaaaaatttgaagcatctttccaatagtctacaacaattgattttatgttgccacacagttggaggaaaatatttaagagtctgccatgggatttcagtcccattccatatccgacacactataacttagaagaaaattcacagttcttgctcatctaattttctgagagtaagctcaactttaagatttttttgatataaaaacaaacttcttatagaaaaaaaagttaaccattactgaaccacttcattggatgttgtagaaggtgttcaatccttagatggtagattgaacaaatggattggtttcaacaccaagaatcactgatttctactttacgggaaaaaaaatgttaaacaaagataggttaaatgacttcctaagttcacacaaaaattgattctcaggacaatgctcctttgcattaccagtgcatagaatataatctcattaatttgacccaatgcctctgtatcttctaacttcactgaacttcttcaccaaataaataatctgcaaggaaattaccgtacatcttaaagacaaggatgcctgcgggcagaacgaagtcccactgtccccagttacatgaagaatgtcaagtcatttttgtatgccaaaaaactagccaatattattattcttgattatattgcttttcatacatataatcccaaatcacacaggttggaaggttttactatagttatatgattcaaagattatgttcaacataaaccagaaactaaaatcaatatatgaaaaaacaaatgaatgaaaaaagatatttgggtgagagccctgcttcatttatttttctattctagaagtcaaatacacaaaaatattgtgccaaaaacatccttgaccaagcagatgtacacattagaagtctgcattattaaaacaaataagccaggctgtctctgctataagataaaacaactttagaaaagcagaaaaggaatgtctgcttattgaaattcatatcaaattaaatcctcagtccttaagaaatttactattatcttatttgccacgaactgtgtaactgagaaattaaaacaataaattgattattacaagtaaaaatcacattactttcaagggagagtagttcactcattagattttctacgtaatatatgttgtaaaatattctaaaattaccaactatttttcaacatatgtaaattctgagtctaacttctcttgttctgcagcgagtaatcaagatttataaaatattcactcttcaagacttatctcacttaggtaaacctcgagaccaatccagaaataaattgccaagcttctatcaaataattcaaaaggagacccaggactcttgatgatacacttgaagtcactaaatatgaaaggtaagttagacttagacattatttagtccagtgccttcatttattagatgaacagtgtcagggcccaacagacaaaactatggtcacataactaactgaggaaaagtcagaatataatccttgccctcttgataacagtctcaggttcttcctaatttctagatattgccataaaatgagcttctaattcattaccaaaaactaaatgcagcttaaatttgaggatatttctgcaaaagaaaataggacatgttccaaaactctagtacgataattttccaatcttattgtgcaattgatttgcatttgttaaaataaccaaaggtgctgagaaccaaacaggccattctgtgtctggctggactgactagtcagttctacatataaaatgagacacacagggaaaggaatgaacaaatgatcctggaattcattaggtgtgcaacatttcaatttctgggactgactcagattcaagtacctacaatgtaatctataagaactagatgctgtatcttttaacctgaagaaaatcattaacacaatcaaaattaaaagtagcttcatgaatatggactttataaagattctctgcaagaaatttgaaaatttctgggtgccaattaatgattacttaataaataagtaaattataataatgttattatattcaaggagatgtataggtattttgtatttataaacagtcctcatttatgaaatggatatgaagtaaataaatttaactatgaaatcatcttattaccgacttggtcaaggcaatatattctgagcaatttatctatttaaccaaaccccaaagaatagccaattgcttctttctccctagaatcagactggggtggtctgtaactctaaaaatctataatttaatttatgcaaatattgtggccatcttgtaagctgttctaaattatagaatgtatttttttaatatacacagatgatagcatcttggaaggcaagagcagaggaaaggagaattttcacagggaagaagaaagagttggtgaaagtgaaattgctttaacaaaataatgatctctatacctccttctcgaactgtggtttgaaggacagtatcatcagcattacttggagcttgtgagaaatttagaatttcaaggccccctcgaccccaacttactggtgcaaactctgtattgtaacccgatccccaaggtgattctagtgtacattaaagtgtgagagtcttgttatgaatggattcttatagtgctgcaatttagaacatcttttaagaattataaagacaattttgtgtctcttgtatctgaaataagtattaaaggcaaaatatatattgatatcatggcactgttcttaaggaattaacatccagatgaattattttgcatcttttcattggaaataaaaagcccggggctgggtggcgggcgaaagaatcagagagctctgatcagtgtgtagatgtatcaatatctatttaatatgtactccagcagagagtccaggctttaaatcattggaagcaatctctcaatttttattctcaacatgtttcacctttaggcaatattacaataaaattctctgtgggtttgtaaacttagtgccactcttctggataaatgtaaagggtgtataactcctggtatattctaacaagtcatcattattggtgaatatacttaacaagtttcatgcaactgcatttacggttctccctagaaatgtctttgttcatacactgctgcaactgaaaactatcatgcattctggatgtaaactgattcaatgaaaacaaatgggcctgggctgtcacatttccacttactatagtcaagtgaacttggaacattttaaagttagtaacacttagaaatgcaagaaatatatactgctaactcaaagtatcctatgttttaaaaaagaatgacagttttttaaaagaaagaaaaaaaactaaaattatcttgatatccccagcacattaagtagaggagagggtaataaatatgtgataagtgtaatgagaaatcatgctggatgggaagaaatgtacttttgtaactccatccattcgtgtgcttcatagaaggcttgaccaaggctttttggtttattttgttttgttttttttttcagatggaatgctactttgttattaaaataatgcaaagaagtaggtcagtatacactaaaatcagtataaaataagaacacttgaattgttgcataccattcttcacagtaggagcacaagagaaggaacactgaaaacctatggcatatctttgatttcaacacagaaagagcatagaatccaaaggtttaacacatgcaaatcccctattctagatattagaaatacaacagtaaataaggctctcagggtctccactctcatcaaaccagtgatggagagataaccataagtgagtcaagtataagtgagttatatgtgaaactgagcaagcaaaagagtgcaatgagggtgtgcaataactgagcagggaagttgttttagatgattggggaagctttatgagacaatgatgattaaattgagatcttaatgctgaggaaccacttgtgggaagatctggacaaagaatagaaagaataggaaaaaatccagtgagcattgagcacagtgacactggggcaatgtgggaatacaatgaaatcagagctgtgggatggggctatgtcatgtaagtccttctaaattttgggcaaactctttgattttattcgatgcacaatgggaagctactagagttttatagttaggggaatgacatggtttgatttacatctcaaaaatataactctgtctattgtgtggaaaataaactctgcgtaggcatggaagtgacagcagtgagtccaacatttatgaagttatagaacataggagtacgggctatgaaattatacatatctgggttcaaatcccactcacatgagcagttgggtaaataatcaccttaaagtcttagttttcttgtcagtaaatgaagacaataatactaggatctattttatagggtagttgtaaggattaaacaatatatgcataataagctttttaaagactgtcaatccatgggatatatttgtggaatataaacagaatatttatgtatatatgttatatttcttcatctactgcttttaaccattaagttacttcttttccccatctcttaatatcttgggcagaatcactgaatttgtggtcacttttggtttttaaaagtttgggctaatttataagttaatcatgtcatcatttttagttgaagtggaggaggaagatgtagtatgcctctaggtgtcttaccatcaccgccccctcaagacctggcccttccagtttattgggaaggagctgatgaggggaagagaaaagagcagtggttattcatatagtcctctttctgtgggctgtacctgcttctctggttcacccttactgacctctgctgcccttcatgcagtagactcatgagtgctccatgtgacttcccaacagcagtcaacaacatgagagaaattcatctgtctcatcccccagctcatctcccagctctaaccttcacacaacaccccatagcatctggctgctctaatcccctggcccagctagtggccttcttgtgagtaataccggctaggtggctcaagccaaagactcaaagggatatctcctttactgatgcctgtgggcattctggctgcaccgaatgttgctggtacagattaaattcttcttttttttttttgatagagtctcgctctgtcacccaggctggagtgcagtggcgcgatctcagctcactgcaacctccacctcccgggttcacgccattctcctgcctcagcctcccaagtagctgggattacaggtgcccgccaccatgcctagctttttttttttttttctgtatttttagtagagacggggtttcaccatgttagccaggatggtctcgatctcctgagctcccgaccttgtgatctgcccgcctcggcctcccaatgtgctgggattacaggcgtgagccactgcgccgagccagattaaattcttcttgtcccctctttctaccctgccagtcctcttcttccctcctcagaaaggcatagggcaggccagcaagtctgatgcatacaaagtcatgcattgggaatgcagaacaccagctttcatttctttcccagcatacacaggctctacatgtgattctatagtttcttccctcaattacttttggtaaaaaaagctaacctcttcattaacaatatgttttacagagcctatgccttaaagactctgtgctgacctatccgtcactgcttaggtagataagggaggtgggaagtggggagttagaagtagttgaagggtcagtctttcggtcctgtagtaaatgctgaggaaggttaactggccagtttagggaggttccatttacaatgaaggctacttaaattcttttctttcagaaggttctaatcaacaattctatgagaaaaatttccattcaacatatggtggacaatcaattaatgttagatattatgatcattattattaaagtaaccactacatttaaaatcactactcagcaattttaaaaaatcagctttttaccaaatgttttattgcccagaatatcacgatgcccaacaccctcattctaggagcacttggttaattaaggctcattacataagaacgagattgaagtattgtaaatagaaaaaaaatacatgtttctattgatggtttattcttttaaacaagtttgtgcctgagtaacttacaaaataattttataaaatatttgctatttatttatttttttatttgctcagggaaacgcatcaggctaagaattacgagagtgaaacactggtttcttcttggacacttttcagctctgccctttaccaccctacttagcctcactgggcctcattttccctcctggcaaagtgacacagtcagactaagtgatctccaatgtttctttccattctaaaactctatggttctataacattctcgatttattgagccactgtttcactgattcattcaataaacatttattgaagcccaattctgtgccaaactcaattgctctcctgctgtcaaaatcaggcaacatgctagagttaaaatgtctttaaagatttctgatggctgctgcttttaaaaggaacttcccatagcaacccctacctctttgtgcttctagagctagctctcctattattctgtgaggacttacaaattcagaaagacaaaggaatatggaaaggcctggtattcacaacctactagatgtaaatttcctattcctaatcacctttcttccacaacccagaaaacaataccttcaatggatttgctagtgttacagattgtgtttgattatttgtccccaaatttaaagtacttcttcatataattgcaaatatacgcatagaaaataaaatattttaaaagaaagctaatattatatactataagtcttaatttgagattatacatatttatccaataaaagtatagaaggatcaatcaatactgactagtgtttccctatgggctccatggatagagcccataatttgaaattaggagccctaggttcaattcctcactttatggttggtgctatatgtccaagagcagtaaatgtagctgagtctgactttatttcaatataatgaacatagatattctgttatgctgcattttcagatttttaaaaaattaagatctttaatataaattatgaaactgttcttattaattatatactgggtcttccataacttcccgttaccccatctatcatacctgtattgaaaacatcattaatcaacattctctagctcagtatttttcatcccagattccctatctggtttgagtactgttttctcaagtatctgaagggtagtataaaaccagcatcattccagatgcataggagataagttatttcattaaataagacagactccttagggttttattcccgtcccaagttcaacagagttacagattaagtgcaaacacacagaatttatgagaaagacttgaggtaactcacagaatagaaggaattgctaaaccacgaattcttggagaggaagatactctgggtaaacccaaactcttgaactcacagttcctggtctcctctaggtttgcaccactcatataattgagctccagtgaacttgaggtaattcttttcaggttctgaattccccaaatcagaaaacttggatagctctacttgtgttagaagccaattcccagatcagtctttgtggctggaatagggatgaggggacaagattataaagcagggacatgccagagaatggctgtgaggggacagcctaatcattcattaacacctggtatggtccacaagttagtatttagatctagtatttaaaaaaaaaaattttcctaggatgatgaaattattaccatctcttttttagttttacctttgacataaatttagatcttaggatccaaggtaaataatgaatttcagctgaattgtgacaagctttatttcaattgtgcatctttatcagagatctaagctaaacacagaattataaactttatagttggaagagggagatccataacatttacgagactttctctggtgcacaggcgaagttgggatgaaaaactgggtctctagatcagttgactcaaaacagagatgatcatcagaatcacctggaaaactttctacaagagtatatttccaggaaccctacccacttccactttaacaatattggggtggatctcttgctaacatattattatttttttagtttctagttagttccaatgaccagtttattttaaaactcaatgttttgcagtttttgcttttaatttttgttaaagaaatgggccttctctcaccttattctccatgaaaataattcacatcccaacaaatagcacaaaatacacaataaaatagacacattataagagaagcaatcaaaaagcagagcacattgtcactacttagtttggaagcaatttcattggttagagaacattctggccaaactgaataacactacctcttgaatatgtagttataattcacaatacttccattcacttctcagagtgagcgttctctggtctcatggataggacgcattccacattcacaggctccaattgctttttttgttgttgttttcttttctacttgtgggtaaaccaaataccatattaaaacaaattatttctccttttaaagatcattttccttgacagtatatggcaaaaatatttgatatattttatagcccatgcttgaaataagttgtctcctccaccattaaccatatgatatgccttccctaccaacaattcacaaaactatacaagttaaagagatcttccattcaagggctttgaaaaatttcttcccagttacccaggacacatatacaatacctcagctttctaccctcaatacactcttctacttgtgataggaatagaaattcttctaaattgatttcataatccaccaatggttcaccatccaaactttggaaaacacaaacgttattcaacctttccattttatacattaaaaaaatgaaggtccagggaagttaatagacttggcaaagaccactcagcttatgaatgcattggactagaatttggctttatgaccctatatcctgtgttctttctatcacacttttatgcatttatcatttttttctttctttctttctttcttttttttttttttttgagacagattcttgctctgtcacccaggctggagtgcagtggcatgatctcagctcattgcaatctccgcctcctgggttcaagcgattctcctgcctcaggctcccaagtagctaggattacagactcccaccactaggcccagctagtttttgtattttcagtagagacagggtcttaccatgttggccaggctggtctcgaatgcctgacctcaagtgatctgcctgtctcagcctcccaaagtgctaagattataggtgtaagccaccatgcccggacacttttctgcatttttaatgccattttggatagatttaaatggacatctttacagtttcaggatggaaatattcattctgtaaaatacatgacagtctattttttcatcatgacattccatcctaatttgatccctatcctagatacctaattttataactccttgagaaaatatataaaattataccttcataactttcatataatcaaacaatattatcatttttctgttacaatatcaaagtgaagtaatcatcccaactacctcaccatatttgcactaattatgttagcctctcaacatcaaattttgttttttgcagtttcttttcatatgtattattataaaattctttgactcaaatgttcgaatattcctacttaaaaacagataatggattttattttgatagaattcccacaataggaatagactctatatcattttgtaataaaaattacattaaatacacatcacaatcttgacgagaagttaattattagcaaatgctaacaattaccaggcatctcaggctaaggtgatgtgagaaaatgtctagtattcataagttgtcaaattaacatcaaagcaatatcaactaaagagcattaaaaaatagcaatgccttggccccagaccccacctcaatgttctcttttaattatcaccataagacttgggcactgggagttttagaagcttctcaggtgattctaatatgtggaaatggtaaaaacgcagagtttagagagatatgacctaggcattcaatgtgtaatatctgtggctctataactgtataaactttgtgtaataatatcacaaaaccttatggttctttaaactaaaattatactttagatatgatctatgtataatattgccttaaatttgcatactgcttatgtaacttatcaggaaactggcatattttctcttataaaggagaaacacttaaatgcatttcttcctcccctttcccaattaatatatgcttagatgttacattatcagactgacctttgtaagcatctgattttaactctcaagctttctttgtaagggccaatatttatgtaaaaccacacaaatgaatatgcaatcccagaagaataaataactatgccaatattacatactgcctttgcaaaggaaatatcatctgagagtaatataggattgtatcttgcgactgacttagacaatcacatttgcccagatacagagaaatccctaattagctaaattcagttgttttcaattttttctaaatttatgatcgtagcctatctctaaaactcattgtacaaatatatatgctttaagtatttctggtgaaaccttatgtaaccattcaaagaaggcaactgtcgatattatattctaaagagaaggtcatggaagaaagtcttgggataaaataagtagataaagaaataaagacaaagaacaagagctagtcctgaaacagtttaagagaaaagtagacactccatccatcagtagcttttcctggataggctcatctttctttaacaagttgacacatttgcaaactgcaggctgaaattttaaacgtctaagctgcttttccttcttctaatagaaaaggtacaaaaaatggtttttgcttcctttactgctgtgccttaataaacatttggctcaaggttttaaccaagccaaatgttgactaaaagcctcctcataaaaggctttaatacatttttgcttgtgttttctttacatgtatttcaatttgatgacaaataatttcttccccatttccctcatttgctgctgcatgttggactaattaaaaagcaggctctttggaagctggaatgagagaaaatggaagagtgggcaggtgggtcaagattgaatgtccctggctctggcaatacataggattctcttcagtgaaacattctccatctagctcagattcaaggaaggcaccgaagaagcccttcagcctttcctacttcaggtcagagttctttttatatttggcatacaaccgagagacatcagaattctatacaaaatggaaagttttattcttcccagcaattccactgcattctgtggcctcttggtgctgtgggcagccttagcagatttgaggcatctcttagggcaaagcggttttgaggtattcttggcgactgggaagaataatttaacttctcttggaataatatcacattcagcagaaaagatctgctgtgctcaaggtcataaatcttggctctgtgaatattcagttattcagcagaacagccactccaagccttcagagcacttttggatgctgctgcaggtgtttcctgtagagaactccctgacatccactgagttcttgcatctgcctttacccttcttgatgctgtccattctgctctctgaacaaacatattctcttacacttatgcacatgtatgaaatcctagagatttccctgaatcaacatatgcatatagatatatgatggacagaataaagtatcaagggataaaatatatttttaattttgtatttcacttgaaaattgtaaggaccattttataatgtattgcttgcaaaataagtcatggaagccctgaaaaattaatcaattcactaatcaaagaaacatatattaaagacctactatgcatgaggcaccatgctaattgctttgaagaagacaaagttgaattagacagggatccagtttacaagatatttacaatgcaaagggggatacaagacatataaaaggctatggaacttaaaaagaagaaaaaacaattctaaagtattgagatacatttcattacaaggcaaatcttagataacatcttgaaagaggacacatttaaaatttaggagatttgaggaaaagatcctccagagtatgatataaaaatgagtgaaggttttgaggtgagaaataaaattaatgaaatttgactcgatctaaggtgacatcatgaagaataatggcaaatgaagttaataagtttgtttcaggccagcttgtaaaaagtccttgaaaaaagaaaaaggaattccttatatttttattagaatatccatcttaaagtgaatggtgaattattgattggcatggatttagggacaattgcatgtcatctttttctgttattagtattactgttttgaagaatgcaatctaccaaaattgaaggtaatagtttcaatgtaaaaatatgcagagttaagcgtttggaaagcactattcaggtttagtatataggaggaaatagggatgggaatggtctattactagacatttttattcttcctacttatcaaatagaccaatatgtgtggaggaaaagccttcttctaaaaagggtttgttttacactacctgtcaaagaggatattggttcactcaaggaaactaagttatattctatttaactgtgagatatattccaataaattgcagtaaacataatcttaaaatattataaagaggcctcagattgtttaaaaatactatattgaatatatgagaaataaaagctcaagatattctttaaagtatatcctatgtaaatgccaatttttctttacagaataaatctaactacaaatgcatacagggcctaaatatatttttatcttgattttgttccttttcttgtgtttaagagccctgactccagaatcacaagagacaaactgccacttcatcacttattagcgctgtttgtgtgggcaggctatttaaacattccaatcctttattttctcctcaataaattgtaaaaaaaagtaatgtttactcagaggttaatgagttgacacttataaaattattagcatggagcctggcctcagatatcattctcttctgtatacaatttttatgtgtttgttctttaaacttataaatcagttccatcagactttttacttcatggcaagctgcttttatttctaattaagaaaacattcctgactccaaaatttataaagactttttctctcttttcttcaagtatttctataacattgtaatgcatttagtgtttatccatatgaacggtatgatattggaatctaattttacttttccacatgtataatcagttcttccgatactgttaagtattgtatcctttatgtaattattaaatatcatatataacagataaaaaactctgtatgtacttacatcgatttctagactccattttctctaaacatcccttgtctgtttctgtgccagaactagactgttttaattatagttgtttcatagtaccttttggtatcatgctggtaacttccctaaactgttacttttctcaaaaaatttaggcttttataaacatttagcttgcatatcaattttacagtttgtcaagtccctaacctcctccccaaattgagactgtgaattgaattgccctcagtctataatttaaagtttgaatcatcctattcagaggcacaaagttgttggttttttttgtttgtttgttttttacttattttggttgtgctttgtacccttccctaaagtgttattattttctttatgtaaatcttacataaaaccagtattttttaacgttcaggtaagatttttatattcctaggatcttcatgtggaaaaaaaaaacttaatgatttaaacagctatattaacttgatatatgtaattatttgagagaaaatctagtcaataacttttgccttcccactccagacttctaccctgattatgttaggtaactgaattggaaagaaaaatatttattctttatattattttttctgatctgaaaaagatagcttgtttccaccagatacattcatattaatagccatcaagctatactactttcaaattatatttatgacaataaatgattcctacaaattttagagaagactatcaaaagcaaaagaaataaatacaaaaattaactgggaacaaataagcaacccctggaggattcatctctatgaccctacagtccgaaactaaagaataatacatcctgatggacggctatggaatgaaataaaattctctattaccagttcactagaagaatttttttcccccaggtttgatctctttatttagtttatcctccaggttaaaagaaaattattcactattactcaccaataactcagtaaataaaaattttgcaaattcagccatttcaacatgccagggaatatctaaaggtgtatatatacaaatatttatatataaattttgcatatgtatataaaagaaatatatatataatatatatgaatataaacattcaggtaggatatttatatttatatataaggatatataaataaaaaatgtatttatatttctttttcaaatgcacagctcttatatacatatttctttttcaaaagcatggctacataaatttcttcattttgatgttctgcttctcttcagtttgatcttgcatatcacagtgcatttataaaatctggaaagccatctaaagaatttcaaactttctgaatacaaaatgtctttttccaccagacaagagtcaccccagtcactaaacaaattgaccaatttcagagtatttcctgcttctacttgttactgatgcagcatctggctggaacagagtgcgactggatgcagaaaagttcatgattgcttgattgactgattttgatgttgaaaatcatgtaaaattcatatatattcaaaatgtgattcaaaatagatatccaaagacacatcccagaaaatcagtgtttttctataagctacattaaaagtttttctaaatcttcatttctaagaaaaaataaataatacaagaatgtatataaataagaatgctacctctggaattaatagcacctgcatctgtctacctctttagcaggctttagttttctttctataaatactcgtcatcacataaactataacgtatttatttatttctacatctcccatgaaaacgtgagctccatgaaggcagggacttttgttgttatggtagtcgtcatggtgattgtttaccactgcatcccagggactgggagagtgcctgtcatgtactaagcattcaacagatatctgttgaattaattattcataattacttaattcacaattttaacatgagcataagaactaagatcagaccaaataagccttttcaaaatattaatgaaattttatattattattatctactacccttttaaactttactgtgcttaaaagaaaaaatccagcttgattacagagctcaaagaatgctattgcctgaatgtaagatcgagaatagcttttctttacatgattcccagtctaaggagagaaagcagatagtaaatcacacattaaacaaatcattcaattacattcgtttaaagtgctgctacctaggaaggaaactgaaatgtgccttgagaacagatactcaactggcatgctggaagggcttccctagaaagggatggtttggtttctaggacttgaagaataaggtctaaatcaggtagaaaaggcagggaacattccaggcatccacaaagatatatagagaggctgagtccaggaagatcttgacaaactctagaaactgtgagactggtaatatactattaggttggtgcaaaagtaattgcagtttttgccatttcttttgcaccaacctaatagaaaagaatcagtacaaaacaaaaggccgctattctggtgtcagattttcttctcacactgaagccagctggagtccttagaactttcctgaacttttctgcatccagcagcactctgttccaggcagatgctgcatcagtaacaagtggaagcaggaaatactctgaaattggtcaatttgtttagtgactggggtgactcttgcctggtggaaaaagacattttgtattcagaaagtttaaaattctttagatagctttccaaattttacaaatgcactgtgatatgcaagatgaaactgaggagaaccagctctttggctgcagatctgagatctttctatgggaggacaaaaaggagctaaatcacattaatctattttccacactagtgacatgaactaggttcaattattcaactacggaaaagtcccctttttatgattcctcaaacggtgtaatttttcctgcctctgtactttcatgttgtctttttttttttttttttttttctctctgagctgttccactaggcacatatttctagaatcagctgaagttccaccatgattctctgtttggactatccttcctctgaactcctccaatattttatgcccattactatacaactcttgattgcatctgagtcccttgaggagacagggaggaacaggacaggagacagggaggaagaaggacagactatgcctgtgaatacagagtattttcctacagagaatatttctaatgaagatgtaaaagatccactcaaaactcaagcattatattgtttgagagggcaattttttttttttcaatttaggtggtctgttttatggtttcttctatggaatatctgtgcaacaggagatcctcttgaataattacccgctgaacaaactgtatctctcaaacacatctcaattttagacttgttgtttaggtcattccctggagagtgtcttgaagaagaaaaaaagcggaaacttacagatagtaggcccagggaaaatataaattattttatatccacttttgagggcctcatattttcttggcttaggtactcaggagacagatataaggcataaaatctttaacattattaaaaccaattcagaaaaatcccttaaccttccaacactaaagcagatagagaacatgaaaactatctatggaactgaaaatcagtgatcaatacatctatgaaaaatgttactattttataagacatccaaagaaatacacaggaaaacaaaatagaaatagcttacaacattcgacactgcttgtgtataatcacacaagcacgtggtatcctaactagtggaaatgcaaagtagcgcatactatggggaatataaattggcaactcatataaagacccaaagaaaagctttactcttgtcctcataattccacttccaagtaatacagcttaggaagaaagtcagggacaagaacaaaaatttgtataccaggatgttcattacagccttaaaattcaggaaagtttgtaaataattaaaatattacactattcaaaaacaagcaatttatgacacaacattaggatggaaaatttgtagtcagtaaaaatcatcttttcacattctaatgacagaagaagaaaaatactccttacattaagctaagcaaaataaatgtagggcatacaaattatactataaattgtactgtacatgtgtgtatatacatatatacacacatacaaataaaggaaacagaccaaaatgatatcatgtatttatttcctttaaacctttgtgtactttcccaattctctacaatgaatatttttatgaccaagaaaaagttaataatattaaataattaatttagactcatttcattatatgcatgaattattccacataaatagctccttgttacaatcaagccaaagaactgtcaaaccatattgggatctacagagactcaatcgccaacaacgacataaggcaaaacctcccacagagaccctcttctctttcacataacactgtattttttaacaatgtttaacagttggaaatgctgagaagccacagatgagatcattaggagaaagtattttccatcatgcttttgtcagggaaaatcccttagtagttctatttctgagttatatttttagccaggctgacaaaatttaaagcaaagtatataaaatgtgtatttgcaagcatctttctctaccaaatggaattcactttaactatcacactgataaagatcatttatcataggcttgtcttctgcatgaccctgtatttggagggtgtgagagactacaagacagaagtggtcaggacctcaaaagatggcacgtgagccgctgcttcaaaaaattaaccagacataccagaaaaatatgatgatgtttatggtctgataggcatctctgtgatctgtaatttatgtatcctatctctgtgcaaccaatggatttaatgggtcagcaagcttcaggaaaaccctaaatggatttgggttcagcaaacagccggtcatcacttctaccccatgcttctaccccacttctacccaccgtgctgaactgcgaagccaaggacttgcttaaactatcaaatccagtttcctcatagaacttttggcccttctatttgtaggtccatctttgcctttggttgctgacatcacattcccagggactgttttctcttgtataaacatatatccatgtaaatccttaaaattcatggcctttgggtttttccttgtcagtcaatctgaatgtccccttcctcagatcctaatagctctgagctggattaggttttccctgatttgcccagcagtgaattcagcttaatttaaaatccactctgcctgagagtttctatttttactttatgaacccataggactgatgaacaatagttagaattgtattcaaattttggatagtttgaattatgtattagttgggaggttcttctttcaaggaaaagaatacaaaattaggtacaagcatgtatacacacatacacacatacacacacacacacacacacacacacacacacacacaaagaaatcacaagtatttactgaatacgccagagctgttttctctgagatttctttaggcagttatctatagacattgtcatagaaatgcttccagattacagtgtggcttcctctccttgtggagaaaactctgtagctcccaaaacttcactaggggaggtgcaaatgagaaaccctagattttaaggtgaagagaatcaaacttacattttccatttgcagaaatgtgttcattagcttagtgagattggttggttttgcttcttattgtctgttaccccctctttgcttgagggtggatgtctgtttctgacaatgatttttgtgaccctgaagccatgtaaaatggaactagtaatacctactgtatcacttgattgttgagaagattaagtgaaatcggagtgaaatggattaatatatcattgtctgaaaattgttacactagaaggcaactccttagagcaagggaattttgttgacaaactagcactcttgctgggacatgatacagagttcaatgattaggggctgatttgcttgaggaatgtgaatgaatcatagatgctataattgcccttgttctgtccctaaatgaagaaaaacgaagcagctgtggtcatctacattctcactgtctaatagccacaagtggtctaaatccagactaaaatacaggggactctggttgcatttatatttatcccccagctgtttctgtctccctattttaccaattccaattcaaaatgctcttagccctgaagaatctgaactgcctcagttgtgcactgtcctctgggtttgcagatgccatagaaatgtctgttctgataataatgtactgagggcatcatgcttatttaacctctggtgaggtagttaggaaaatgcttctgatactgggtaagatcctgaataggaggcccatgctttgtgatgccagacctcttgctttttactgcctttatatacatgataaaacatgatttcagtcagagcaagtggtatatgactcctgacattgtgtgataacacagcacattgtttctgtggagaagtcaacacagttctggaaggatgactcgctttccggttttatgctctcttcccctgaatcctcataagaagctgctctgaagtttaaacatcgaataaaaatgcttccaaacaattaatgcgacagcaaacacaccaataaacctatcggcagcagcctcagtattttacctcagtctttaatgtcagcttgcttttttattccagaggtcagaaaaacaaatgctctgtgagctcattacgtgcatgcctaaacaagcagaaaagtaggtgcttttccaaatgccagacaatgaaatctagatttttctctttgtacttcactgtaattcgggtgatagaatacttgctaatacaagctattaaaacaaaccaacaaacagaaatcagtctctcatagcctattttaaaactccctccctgtgttcttaactgttgacttttaaaccaaaaatgccagtcaagaagtacaaagtgatctttagcactgtctagcttaaaatgttgatagttaatatttgaatataaaaaagtataaaaataaataatagacaactcattttagctaacactttggaattaactttgagtagtagaaaactacacaatataaacctgtttttcagtggtttctgctatcaagtgaattgatggattatagtaacctttgttacctggcactcagaatactacttttaagcacaggttcttttaataagaaactaattgatatccataatgtgacccaaataaattgtaaggtccttgaaattaagttctggaaaaaataagcaaattcttaggcttattttattttttctgtaattctttaaaaatgagtgatctacatgtcatacatgtatatggtaattctctcctgtatagaataccctctggccatcctgaaaaataaaattaactcttgagctttatgagattttctaaagaaaaagtatctctataaagaatgttagactgggcatggtggctcacacctgtaatcccagcactttgggaggccgaggcaagaggatcacttaagctcaggagctcaagaccagcctgggaaatatagtgagacctcatctctaccaaaaataacataacataacgtaacatgacatgacatgacatgacatgacatgacatgacataacatgacataacataacataacataaaatacactgggaggctgaggcaggagggaggattgcttgagcagaggagatggaggctgcagcgagctgtaaacatgcactgcactccggcctgaatgacacagtaaaactctatctcaaaaagaaagaaagaaagaatgttaacttgccgacacacatgctctcttccattctttttcctctccttacaccatcccttcttttttccattactcacaatgatgggattagtacagcttgtactggggctttggaactgtaataaacaaggagcaattttctggtcctaattaactcctgttaaaataagcactgcacaacaatagtctacccagagttgcactgaaaaaaaccacaacaatcctaacactctatgaataatgaaccctatttaaatgagcaggttattgtagggtcttaatgagctgctctgtggccacagggcacatactgcatcccagagtaatggagcattttcctgcagacacttgcaggctgggctagcagcagaacagcttcttccctggtaaaaccagagaggtagcatcaaaggtttgttatgtttccattttactttttcacacacctcttctgcaactgacatcagccatccccatccctttttgaaatgttgtcttccttcttttacctccaggcttctatattcaagcatcctcctcctttatatcttttctgaagtataatttacagaccataaaattcacttcgtttaagtatacaattcaatgagttttggtaaatttccagtgttatgcaaccatcattgcaatctaattttacaacattttcattgcaccaaaaagaaactttgtgcccattcgtagtcattccctcttcccacccccaggccaacctaagcaaacactaatctttttgtctgtataggtttgccttttttggacaattaatagggaaccacataatgtgtggacttttagcataacgtttctgaggctccatgtagcatatagcatgtggaacacaatactattccactgtatagatatactacattttgcttgctcactcatcagttgatgcacatctgtgctatttctacttcttgttattaagaatgctgctgctatgctgtgaacatctgtgaacgaatttttgtatagacacatgttttcatttctcttaggtaggtacctatgagtggaacagctgagtcatatgataaatctatgcttaacagtttaagaaactgccaaaagcttttccagagttttgcattactagcagcaatgtatgaaggttccatttatccatatatttactaacactggttattgttgatgttttccattatagccatcctagctggcgtgaagtgttatcttgtggttttaaccatttccctattggctaatgatgttgagcctctatcatttgtgtctgactgttgtttctgttttattttgttttcattcctcgttttagtattccttgacttttgtaatgtcccctttttcctgtatacctatttcctgatccacatggatcatgttgactcccactcatatgcaattaactaccatatcttaatgaatgctgctcatggctcattctcaatctatttatctccatgaagttactgataccatatgttaaaagaaaaactttagacaaaccaaatctagcagagtttatttgagaaaataaatgatttatgaatagggcagcagtctggaccaaaaatggttcagaatgctccactctaccacatgtgcagtctatattcatgcccatagaaaaggaagtaacatacagaaacaacctgattggctgcagtcaatgtttgccttatatagtcgtatttggcagctttcagtctcttaatggctggaggtttagttgctgtgattgattgagactcagttactttttacaagagtatatacttctagtttaggttatagcttgtaaatacaccaacttaggttacaattcactatgtctagagaaacttttaggcaactcttaaattatttatggaggcagttttggccaaacttaattcaatttcatacatatttctacttggaaaaaaggcaggaaaattgaatttttaatttacacacaaataatgaacagaagttcaaatgtaccttgatttaatgcataatataattgcgtgaagtattagtataccataatcgttcataaatatattgcttttacataagcatactgaccacatgatcagacttgcctgttctcttactgtcttacggacagtgtaggattcactaagctgcggtcatttcctctttagaacctagctgtgatcatcttctctgcctgcctcttactttgtttccttcattttcttttgtgacataatggctgtagctgaagcatacaggtagaatctcactatgccccctactttcttctcttttggccttttcatcttttttttttttttttctggttctccaagtccatttatgcatttattcattctttttctctttttttttatactttaagttttagggtacatgtgtacaacgtgcaggtttgttacatatgtatacatgtgccatgttggtgtgctgcacccattaactcgtcatttaacattaggtatatctcctaatgctatccctcccccctccccccaccccacaacaggccccagtgtgatgttccccttcctgtgtccatgtgttctcattgttcaattcccacctatgagtgagaacatgtggtgtttggtttttttgtccttgccatagtttgctgagaatgatggtttccagcttcatccatgtccctacaaaggacatgaaatcatcattttttagggctgcatagtattccatggtgtatatgtgccacattttcttaatctagtctatcattgttggacatttggcttggttccaagtctttgctatggtgagtagtgctgcaataaacatatgtgtgcatgtgtctttatagcagcatgatttataatcctttgggtacatacccagtaatgggatggctgggtcaaatggtatttctagttctagatccctgaggaatcgccacactgacttccacaatggttgaactagttaacagtcccatcaacagtgtaaaagtgttcctatttctccacatcctctccagcacctgttgtttcttgactttctaatgatcaccattctaactggtgtgagatggtatctcattgtgtttttgatttgcatttctctgatggccagtgatgatgagcattttctcatgtgtctgttggctgcataaatgtcttcttttgagaagtgtctgttcatatccttcaatctaatcagtagccaatatagtgattccattcaaaggttcaaacgatgcttaaaccaaaattattatccatttcacactctccaaccaagtgaacaagaggaaagaggagaacaaagcaaggaacaaaagaataaaaaaggtctaattaatttgcaacctggagaaaacatgtcagatcttgatgtaaaatagaaaagtctggaaaattgggattttccaatatgcagttatgtggccaattttagagatgcaataaactgagtgtgattaaatggtaaattggactgatcaggtgagccatacttttcttgtgaaaagtagcaagcatggaaaaaaaaaagatacagctctatttccctttacttttccatctgtatctttcatatttttcaaaattaaaaaaaacaccaaactatttttcaagtattaataaagaatcaggaagaacttcatttaaaacatttttgcctgcccttcaaaaaactctttcactgtttcaaggccattgcttctggaacccagatttgttctagcttacagcctaggaataagaatatatactttcctgtcaggatggcttttgagaaactctgagaataaaatctgacccagtccaatctgacaaggttgctgtgcttgtttgaatgtaaaatgattcacaaagtgaaccgaaagtttttgttaattgttaaaaagcctcagcgctgtggcttagtttaagagctacatctggcattttggtaggaacaaactacttatgaatgaggaatagttatattttttgtgttgttgtttttatttttcttttggggggggagggaagaaagaggacagaagagaactaggacttagtattttgaaaactgggacatcatcactggcctacccaccacataaacgtaactagtgtatatgattttaactttgtaatcgtgtacattgacacttctttttgatattctagatctatacaaagaaaaatactcaaagagatgcaggaaaataaataagaaaagaaattctctggccagcaattatttagcagtaaattgacatataaatgtggtgtaattaaactcaaatcacttttaaacctaattaccgatacaaagaaatgggaaagcatcgacctctaggcttcagaaagcttaggtaaaatcattacaaatctgtcagttgtaccatcaaaataaatctggaatctaagcacttcttatcattttcattgctgccaccctggtctgagttacccgcattttctgggacttctgaaataacttccaaactattgttcctcagacttaccccacctctcatacaccacttcaccccctgcccccaaacacacaaaagcaaagtgatcttttttaaacttaaagtctaatcatgccccttcttggctcaaaacccacccatgagaaattaaataggcttttaaagttacgtatcaattttaaaagtaacacttataattctatactctaaagagtacctgagtctgtactaggacatttgcttccagaagtcatgaaagtggtctgaagaagtcacaaataggagtttataaagttctagaagtatcaagtttctagattcttttcagtttttgctctgtttaaacattcacaccaactgaggtctgggggtgaaaggggaagttaatttatcccctaaataatatttattttgtatacaaaagaatggttaaatgtattcagtagtctaacctgctcttcttggctattcattcctgaatgacaggaattccgtttgtaccaccctcatcaccaccattaatttcatgatggactagctacttcacagccctcatgtccccaccactccattcaagctcaagggctactgaagcatagtagcagcttacaaagaaaaaaaaaaagacaaaacaaactcttagcaataatgttatgtcattcacactagagacaaaataacttcattattagagatgctatcattgaaattaattcactggttataaaaggaaggctatccaagaatatctgcagttttgatgccttggaaaataaaattaaatggaagagaaattaacaataataactcagaaataaacactattaatattttatgtaagttttccaccttccttgatatatgacataagcattttcttaactcaataaaaactctaaagaaacatagaaaacaataacaacaacttgtgtggtttctcgtctctctcagagtaaaagccaaaatcctgaggatagcccgtaactctatacaatctggtccaccatttcatctgtgggctcatcttcaatactaccctaaagcctccagttttgctttagccacatccatctccccattgactctttaataagccagacagttccctggattttggcatttcagtggctccttcctctgcctgctaaattcctctccaacatgttattcactgtgtgctctctcacctcttctaagtctttggtccactaccacctacaccttgcctttacatgccttgctttatttttctccataaaacttaactactgagtataccatagttaatcactcatgtttaaatattttttcgtccatctcctacagtagaatatgagtgacagaggacagggatcttcattttttgtttgtttggtatacccagggcccagaatgatgccatactcatgataagcagttccgtaaagagcgttattccctgtgacagaatgtcaggagtgaagttgtcaagtcctttttctagagaagtggtgggtgttcttgcttctcattaactaaggcacagcctggattgaagagtagacatgagataagagttctgtgttctgccatcaaaaagacaaaaaagaagtatacatcttttcaattcttttatgcttgaaattctcaccttcctttaaatcacaaggataatctgttgacccttacaacagctctgagctgttattatccacaactgagaaagaaaggaagaggctgtggtatttactgaggtcctaaatggcagaaccaggactagtaaaccatgttattaggtttctgcttctatatagtcacaatgaactgcagccacatctcccagaacaataaattagcaagtagacagaagtctttctttccaccctcaaaagaggtttttagcctttacaattagcttttcaataaagatacaagaataactatttcattgatgtgctctcagcagatcttagactttccattatttatttcctttgtttagttcaatgtgaaagtgcttggctttaatcttcatttcacttagttttatcaaaatataaaacccctacatttgcataggctatcccagggtccagaaagcattcacactttgtccatctgatacaccctcaaaacaacgctagctgaggtaaaagcaggtgggtgtatctttacctcagaaggatccttgacctgcccaatgcgacatcagtggtgagcctcagaaacagggcaaaaaaaaattgatctctttagtgtaaactcaatgtttttaatttacaggaaatgcattcactggtgtgtgtgtgtgtgtgtgtgtgtgtgtttgaggcaggggagcaattacataataggaagaaattatctaaattattcttatttcacatgtcttctagaaatataattgtcacttttgcactccacttccacttcctggcaatttttctgctgccataattcaaaaacagactctttggccgttccttcacattcctttcccttttgtctttacagcctcatcacttccttctaccgatcttcatttcctgcttttgagactttcccgctgcctcctcctgtcatcttcaggtcccaaatgcagttttgccagattccacatccaaaattaacatcatttcctctttggctacactagtaaaggtgcttccttttatccctccagatccatatgtagcccaagtttgaagaactttcttctccctttttagagttgtataagcttcctgagagctggctctacaatctccatactctccagcccacatcacagtacagcactgaaaacagtgccttttatactttgggtaggcataggtatttgagaaatgagccatgaactcaaaaagatagcttcagggaagtcatgagcaagggtgacggcaggaagcactgcttgcctttcttcaccacccaacttctgccctctggccctttttcagtcctccactttgctccccactggcatgccacacatgtgagacagcatgaggtatgactactgttccatcaagtagggaggatgctgaatgcatcaatgacacattgcctcaaggttccattccactataagtatataagcaattgttctttggccagtgcatgtttttatgcagtaaactagttctcattttgctggacatttattacaacatttacccattacaaagaacctcattatgtttaatatatatgaaaacacgttcatttgataggcctattacttgatccattttatttgggtatacaggataacacaggatattttccttcaataaaatagtgagaaatttttgatctaagaagcttcaatatcacttttttttttagtacgcaacacattggtatactgtctgggggcaatctatataaatggaatgaatcctacttaaaaatcatttgttgacataaattattgagaatttcatattttaaaaatattataaatttctttacatttagaaaccaaatatacttctataaatgccacacttatttggaatatatttctgtacagtgtaagttgaatattcatttatatttttctgcaaaaattagttgttcattctttaattcatatacattttagcttcctttttcttttttttttttcccaaatccacaacttttaaaaattttcaacaggacttccctttctgaaagttaatgccttgattaacatttcacaataaattataactatgatttatacttgatttttctttgatttcattctaaattaagtttctattttaatatgattagaggctttgaagaaacaatgggatctgggaaacatacttccgctttatattaaaaaacagatttatcattacaattgttccaagaggactggcctttttctattttattcattgatttatcccaacatctagaacagtgcttggtgttcagggggcactaaacaaatacatcaaatgcctcctatccactgcactttacccactggggacttggaaggtcaggagaggcccttactgtgccagacattatagtaagcaatgtcacataatctcatttaactatcataaatattctttgtggtaactttcaacatccccatttcacagatgaggaaatagatgcattgagaagttaaggttttcatgtaagataacagaggtaataaattgcaaggttagaataaatgccttgaagtctgtctgtctgcaaagtctaggctcttaacaacaccctaagttgcctgccttcacccaaaagtattgtaactagaaggaacattaattactcttcctctatctccacactgtatatgaatattcagactgactgagataaaattacttgcaaaaagaaatctttgcaagtcagtgccacaattaagtcacgacctagtaccattaatctgttttggtttttagaagggtggcattctcctaccttgaaacatcaaaactcatctaatgagaagagaccttgttcaagggtaatgtgtagcttgcagttagaacaggtgagaggcttgacagtagcaagaccgactgctggtttacagcaatgtgaatgtctggtgcttggactttccaggaagcaggccagtgccatatttctggctggctgtctctgacttgaatttagggtcctccaagatactggagcactacctcccagaacctcacgtagtccattcatcaatatatccaacaaatatatatatggtgtttcaaatatgtggtaggcactgatctcagatttggatatatggagataaagaaaacaaagtttctgaccttagaaaattcacaatcttattgtatgtgtaggtgcatgtctgcatatacatcttaaaatatcattgcaagttctttgtgtagtatgaaattgtaagggaaaggacatatctttcattctcatctaggttcatgactagaatcttacctcaagtatcaagtggttagtgttcattcttgcccatatatatatactagtatgtacttttactattcacattttacagagaaagaaactgagtttcagagacctccaggtgactggattagcttctcacagcaaatggtgacaattcaaggttgaaagaatctctggtctctttgataccaaagacaaagttctaatccaccacggaagaaaaggttcaggaaaaggttcacagaagaactcacgagatatgtctgtggtcctacttttagacgtgcatttttttgtggagattgcttcctcacctgagcctcagtttaacatgaactgttcaagcgtaacaacaaattaggtgcatgaatttctctttactttttcagaagccagttttattccatttagcaaacataaatagtgatttcctctgccacattgctcaactatagcttattaatggcttccacttttccttgcttgtgccttaagggtcctcagtaattacccaacagctgtttagacacatagccccagaggctggtatggtctcctatttgctacattaggaaaattctatggtacagcaacatgagtgacagcatcaatataccttcataaaatgatgaggttctatacagctagggtttccccttccttctaaaataactttactttttcatgtcatttagaacccccaaaaaaggattactacttctgatgcaccatctgaagactatcctggatacttttatattaattagaaactgaaatgcttgacatgcaaacgctgtggtagccgtctctccccaggcaggcctgttgttatattcatgaagtgcttcctgaaagcttcttagacttgcagaggctgggaagggaattgtttggtctgtccatcactgcaattcctcctatttgttatttgtattattccttaaggccttcactccctacagattctgtgacagtattgatattacaatgtacatagcatatatttttcaagagtctgagggtacatgtacaaagtctatttcaattcctctcaacaggcactgaaatgctataaactaaacaaaatgtccttaccacagcttgcataatgtagaaaagtatatcatctgcaaggaaaagctgcagattctattttgctttcagtattttgaacaccacacctgccctgctatattcagggctagatctttgcacagggagttagtggccacctacatggtatgttttgaaacatacagaaatggacatcttgctcaacacatacccccattaggtaccaaatgctccactttcctatcttcaaattctagccaagtatgaatggttaacatttcaagaaaatgatggtattgtccaaaaacaattcctacaaaacctatttcttctctaattaatatattagaagggtttagggtaagcttctccaaccagcaacctgtaggccgcaggaggcccaggacagctttgaatgcagcccaacacaaatttgtaaactttcttaaaacactatgagttttttttcttttgttttgttttgtttttgcgattttttttgttgttgttagtatattctctgtgtggcccaaggcgattcttcttccaatgtggtcaagggaagccaaaagattgggaatcccttgtttagggcatcaagtagtaaatcctgaacctctgggttctgaaacaatgagaattttgatcagggaaatttctgtatcagagagtaaggtccaacctaatggtagcttataaggaataagatgaggacactagcactgaaggtgtagatccaggacttcccaacttgagacagaataaaacttctctagagatgttgtaaaatcattgattcttagactctacccccagtgattctcatttatttgacctggcaagacatccagaaagcctaatttttaacaaacacacagatgattctgataaatcattaggatgcatggagcactatttgagaaatgatgcccagtaataataaaacaagatacaggtgatagaggccagagaagaaaacatgtccaagacatcttcatctgcttcgcagtgtttcccagggctattgtgctctttgacttaaaccgttcatcatgtccttttgctcattgaaacaccatccacatactatacatattttttctgcctccaaagaaattattttctctagaaaatcaccttgttccttccaactttgctgcttgttctcacatctctgtcttttagattcatgagttttgagaggattcttggttcttctgggaaattaaccttcggactctcctttgtgcttcttagacattggtttttgtttgagcttcagctctgttccctctgttttcagtttattgacctcctctccatgatctctggtaacaaactgcctattctaacctgaccctatggaacctttaaattggagactgaagtctaagttatctctttagataaatagaaaaaattagagaaaatgcaaaaacacatgtttggcattgtactggtttagaattggctaattctgtttgggttggactaatttcacaattacttgcatgcctttaggatacatgacaattaatgtagtaaaggtaatttcaattcattctgggttgcagaaaaatgtgaatctggaactttcaaatgcatatgcataattcacatatgaatcatccagaattcacaatctatgtgtgtcacagtatgcactacatccacttattgattctactgcaattttctgtatcccaaatacaattttgagcctaaagatttaagaatatttttattactttaacttttcttattttagttggctgaaaatacctagaacctatttcccaatagctgaaaccctgctttctgattctatgcatctgaatctcaatggcaccatctctaggaaaattgttacttaaatatttcaaatacaatctttataaagctcctactatggtcaggcacttgctcaggggctaggaacataatgctgaacaaacagatcctctaggagcttacagtctattatggcagacagacgacaaatgcacaattaaacaaaccaattatttaaatcatttatgaatgctaaaaggaatattaaaatttattgcagaaaaccttctgcattttccaaacagaatgcgtaactttccttctccctcttacaaaagaaaataattataagacaaactaaggaacaaacagcatgcttctctcttcaaagaaacttggctaagccaagtaattttctgctatagcagaaaatatttatcccaaatctctaacttaaaaataaacttttgagaattcaaagtttaaagcgtgtgtgtgtgtgtgtgtgtgtgtgtgtgtgtgtgtgtgtgtggcgtggcgggggcgggtgggtagaaggataggcattgggtttttttctctacattgatgatttaaaaaaaaaattcttctccaactttggctccagaattaccatgtggaaccaaaggcaaagcccttgattcgcttgaaaaatttagcaggaaagtatctgtagttaattttgggttacacaatgtccttcactgtctgggcatagaaaagctagctagctcatctcatccagaaactctgccatgagtttaaaaaccaaagcacatactttgatattcactctgaaccaagataaagctttaggttgacataataaaagatggagttaacattcctaaaaaaaaaaaaacaaaaactatgaagctgtaggatatatttcagtcttattttgcaataaaaatgacctaatgctatctatcaccttctttgcagaacaatacttcttaataaaaggcatagagatatttatccttcaaattaaaaaaaatcatgtaatttttggttctttcacatgtatgctttcagaagagaaaaaacaaatcatgttaaactttacagtatcaaatgtgataaactaaaagcataattaacttgttctcttaacataatatggttgttttgctagatcccagtatactactttttccacaggccacgtttttcctcagtatgcacaaatgaaaaagagattaaagaatttgtgtgacctacaataaggtcagcttctaattattatgctaattccatgtactagatttaatagatctactacttttctaccagttaataaaatagactctaaaacactatctactatctaagaagggtgccctctcataccttaaaatactctgtttgaatagctgtgaaggatagtaaaatgtcttactattctgttattgatcctgaattttaaacagataaatgccaaccagaattaacttatttcatgcagcaacatctcaactctttatgttttatttttgaaagagccatttttctgaaattcccctactagataaataatctgccgaatcaaataactgatctattggcaatcccctcaactgaccaaataggctacaatgagttaatcacgcaaaatgctcaccacttgaagtcagaaatccaaattttgtgctctcttcaaccgactctgcaaagtatttgagcttgtgacttatttgagaaagtaacaatttattaacaacacagcgtataaaatggtaggttttgctgtggttttggaggtcagtttatcaaagtgaggcccttctctaatcatatgcaagaattgaatcaactaaaaaacacatgtttggatggatcatataatttaaaatctggattatgcagtgtagaactgtgaaaaaaaggtgaaaacctgctttctattcttggttcaattaattaagtgtgtgtacctcccaccttttataagcatcttcttaagacaccgttgacattcagtaaacaacacatgttgaaaatatgtaatataaaatatcatagatgatattttatacatctatgaaactgcaaaataatcaaaggtaacaagcatacctatcaccccatacatttttcgagcctctttgtaacctcttgttcccttccaccgattctcctggtaggaggccaacatttatgtgttttctgtcactacagattagtttacaatttctagaatttaagtaattgagataataaagtaagtagacttttttgcctggtttctgtcactcaacataattattttgagattcatctatgatatgcacatcagttgttcattcgctctcattgctcagtagtatttcttgcatgtatatgccatattagtctatgcaagttctggtggtttccagtttttgtcttttacaattaaagctgtcacaaacattcaaaaacaagtcactacagtgaatttttctttcatttctcttaaacaattactggggagtataatggctagattatagggtaggtatatgtttagctttttagagatatatggtaggtataggtttaacttttttgagaacctcacaaattattttccaaataattattttccaaagaagttgtaccatttcacattcccatgaatggtatgtgagagtttcagttcttccacattttcgccaacacttggtaagggcatgacaataaacagagtgtttgcttcatgggaataaatgattgtattgggatgtttatatggctgcttcttactctgaagttccatcattcagaatagattatgcaggtaaaaaaatagtcaacagctttaaataccaattgtaattgttacaatattttagaactactaacccagtattctgggtcaaaccaggtagacagtatacattagttccaagttccagagcataaaataatgatgatgatgatgatgatgatgatgatgatgatgatgatgtgtgtgtgtgtgtgtgtgtgtgtgtggtgaagctcatttaaaaaactttattgattctaggattagagaacacacgcatggcgtggtgagagtatataaaagagaaatccagtgaaaaataactcattttgcttttaagtagctttacttgaatgaaatttgctttattaccatatacttcttcattcttcaaaagcaattgggatgctttactcatttatgaacttgtgcttttattctaaagatttaaaaaatttataaattgaaatataaagaatttacacaatttctttcatttttacagacttagtcaagtaaactgcacttttctttttctgatgatgcatcttaattgcatattatcaacatagtttgctattcagcagggacaatttcataattgctatcttcagagaagtaaaataatagagggcttcttctattaacatttagtaaagtgttacaaatagcacttggtgaatgaagggcttcaaattattagaaggacataatattggttacacatgttcacagaataagaaagatatttttagttcctttcagtatatcaatttctgtgaaataaatagcattctgcaagtaatgatatgttactgggcaagtaaagctatgttgttaatttataatgaccaggatagaatgtaatataaatgggatgagcaaaggaaattcgttggttcactgctgcatcaaatctgaactctgagttttctccttatatccatcctttaatgctcagctcaaaatagatctctaagaaacgttctctattgtttccctattacaaagtatattttccttctttaacatactgtatcccttcttatctttaccacctatatgtttctgtttttacccctggctttatattcctaagtattattgcatctttgtatctattctaactgcattaaaagttcccagagttttggagccatagtctgaagttggttaagccccagtgacaaagtttactagcatctttctcattacttacatttgtataatgctttatgtatttcagaaaattttcacatttgatattgtctatggcataacaaaatgccttaaaccaagtaagaattctatacatcactcatcaatgatggtttctcttgggttgtctttgtgtaataagatgctttttagaaacaatgggagctgtaaagtatttcgaatggtatttcaattctagcagtgtctaatgtctcaacgtctcctttctttttcaacaaagcctccattttactgctttccagggtcacacttgattatccattcagagcctcagtggcattttcacagatcatacactatatgatatgtgggacaataaaataaaatagtgaaataagagtgattatctcaaggtctccttacttaatcagtgttctttttttcaagcttaagggaatggctcaaagagtgaaaaatatagtcaacatgtgaaaaatttttgtttgcttctttacagtctacaagcttattaaatcattactgcaatatattctccagccaaatattggtatccataagttatatgaaaggaataattgcatatcatgcagcaggaagaagaaaatgcattgattatgggatttaagaagaaatactgctctgtaactatctgtacaattggtacaataggttgtgttttgctttaaactggacagttgtgctgtgatatcaatatttcttctcttggagtagcttagtacaaccagcggcaaacagtctcctcaattacttcaatgtgtcattcaaatatcatcattttggcgggcattctgatgtgtaaaagtttggaacgcatggatagcattaacagcatagggattcctcctcctcctggttacagagcatgtgtatcagttttgtgccttagagatacagcattatggaataggaatttcaggtgggaatttcataatcaaaggttatgattatggggtgagagaaatgaaggaggaggtaaatagaggaaaggtcagattcaaacccagatgcattgtgatatacaaaaagcataggctgtttttcagtgtcgaaataaaaatcgctgaggatggtgctggtcaggggatacaggccctccaggtgatgaagtttatgggatttgtgggaactggagagaagaaaatctacgcaggagaaatgggaggggaggagtggtggccatcaggaaattgagtgtagccagctggtctgaagaaagagtttactcaaagaaataacaaacaatgcatttggggatttaagctctgagcatgtagaaggcaaggctcagtcttactttagttcgaccccggtgacaggcatgggacctggaacatggtggagctcagtttattaagtgaggtagcaaaaaacagttgaaaaaactcggcaggattagggagactgagctttatctttttaagtctttgaaaagtcccagagaggttttggagtagaatataatttttcctgaaatactcattgcaatagaaataaatagcaatatcaaaaatacaaacagaaactatctttttgtataacattttaaactttacaagatgcttctataatcactatttattatcctcacttggagatacagcataactattaactaaccactgaactatttattgctaataaagtagacagtatagctaagcaagtttcaaaacaaattattttgggtgacacatatcacttgaataaaatactatataatattctaataatgatttttaaaaggtcctttttattcccatccatcattaaatttgtcataatcacatcccagattataaacaatgtaaattaatatggtaaccctcatatatatgtagagatctgagacaaaaattgtgatttttttacagaaatgcatgttggcttttccacagctactcaaaataaataaataaataaataaaaatagaaataaaaataaaaataaaaaaagataaatccaaaaacaacaacaaaaaaaacggaattaatcagacctcaaatttagaatagtaatctccaaaaaggctactgctagcataattttcaaggctaatccaaaaggagaacacaacatgaaccagtaattccaacacataatttttgttatagacaaaataaattttaggagtagttttatacatgtatagtccatattgtcacactgtattcaattatttttaatcctagctgcatatatttatctagggaaaatatgaatcttaagagcgttgcactatgtatctaatgaataaatacaggtcttttctcactctgctatattcctaaagattagttcaaggtgaaaaagcatcatacatgttccaaaagtttgccataaaatcagtaagaagctgttcacatttatatattaacaaagtaatcatttatcattaaaaaaaaactagtgaaaacttaacaagtgctcttccatatatttaatgctatttatttttattattttgctgagatataggtatggctttctgtttttattgtaacgtaaacaatattaagtataactttcttttaaaaaataattttagatttacagaagagctgcagtgttagtacagacagttaccatgtatgttcttcacccagtttgtcctaatgctaatctgttacattaccataggatagttattaaaagaaactaacatggattcaatattattcaccaaattacagactttatgtggacttcaccagtttttccatgaatcttcttattctgtacctggatccaatttaggatcgtacctcacatttagttgtcctgtctccctaattcccttggtgggagcactaaggaaacactgactcttttaaagagtatagatcagttattttgtagaatgtgctgctgtttaggtttgtctgatattttctcattattagattgaggttatgcatttatttaaagaatattccagaagcagtaagtccttctcagagcatgatgtctggaggtaaatgatattgcttggtgatctttgatcacttggtttagttggtgtccgctgtgttactccactgtaaaagttactatgtatcactttagagttaataaataccattggaaagacactttaagattatgtaaatatcttttctcttcttaaatttttacccactaattttagcatgtatctgtggagcttatctgctttaatggtatcttttttgtaattcaaaatgtgtaacttacataaatctttaaaaacatgacttctacaaagcttgtatctatttattttcttcttctggtttcctgacaatgcaaacaaatgttagagaatttatcttgagaacaacatttcccaagttgctatagaaaccaagtaatgaagaaaagactaataacttttctattctatatagtatataagaaatttaaaaaattattttagtgtttaatctgtttggctattttcacagaaaatacattttttttctgtgttgatagctaaaattcagattttccagtagctgaatatggcaaaattatatgatataattttatatacttcttgatttattttatattatcaatatcatgttcaaatcatttttctgataattataagtgatacatatacattacaccaaatttatttaatattcatccagtcagataaatcaatttttgcttattgcatgcactttttataactaaatatatactattgataggaaatggttggagtgtaatttgtagtataagaaagcatgctggccttgaggaaaagcttttttgtatttaaatgtaatgacacattttaagtacaacagtaaagaattaattattgaagtagagatttgtaaattcagcagtaaattttaaccatcaatatatattttgctattttgttaagctaacataatttaagcttctagtaagtatataatagttgtaactgcacataaaactttagagaacaatggaaattttccatcagtgtttatgatagggacaaacccaaaaagaaaatagaatgagcttattacgatttaaaattacctttctgtatcttctattgtcattacattttatttgatctttattagttttcaacttttaaataaactttttaaatattcaacttggtacctaacctaatgtaaaaactacatgtaaaaatcaatgagaacaaatttatggtgacccataatatttaacgattgctaaattgattctgaaaatatgtaaccataatttgctataataccattaatctctgttgactatttacagcatttcataggaacttaaataatttgattttttacacagcaattcaaaattttcttactggcttcttcattatgtatcatcagctttcagctataccaatgttaaaaaaaaaaagccacaaatcacagttagtccagggaaaatttcttgtgaattgtttttgtttgttttttaaagtggagtgtaattgctaaagttagtctaaaaccatgatttcattcaaatgtggctatgctttattctacagagaaaacttgccttggtcataaaatttatgtggtcaagaggtaacacatgcttgatgagcttgatttgcaattttaagttgtggttaaatccctagggaagcacagaattctttatagaggtcttagaacaacaaggctggaaatagtgttacaatcatccactctgatgttatggtcctccacccccatttcagttttcttatgagtaaaatgtgagtatcaatattttgcttagcaaggtttaaaaaaaagaggctaaatgaagacaaaatgatgttcagttgaatttcccagctctgttatagataaaatattatacacattttatgatacttaaagaaaactgattattttgaaatttattaaatatattttaaatggcaacattcagtgaaacttttccatgaggtccctgcaatgggagatctcttatgaaacattagttattaaatcaaacatgcttttgtgtgcaccactatgcatttataattcaaacatatctttacatttgcaaaacactatattgagatcacatctaatgttattcaaccatcattttgttctagcttactaaactggaaaataaactgtttacttaactggtatttatttaacctgaacatatctgcatatattacaaagcagacaataacagtgggcaatgtgatatttgaaaggagtggagaaaatgaagacggtggcaataattaaaactaaaagtagtttagagaagatgccagctctcagatttgcttatttatctctaaggatatatgtgtaaaaatgtatttctattttagcccaaaaattatctagcacaattttaattacaatttattatgtgagaaattatgatgcctttgatactatttaaaaagacatgtttagatctaattattttttctaccaatactagcaaaaagtgcttatttgctaaattatatatgtatttgaatgaaaataatatgaagccagagtcattaaagttataatttacagcaatgcctacagtacagtatttaaattgcttaattttttcctttcaggtagaaacaaatgtaaaaacccaatgattcccccattctatgcagaatacaagagaaaggtaatcttcagtactgctcataaaagatgtttacatttagcagtgtaggaatcatggctgggtgtgcaagattattaggatgcttcagggtggttgctttattttgttttattttgcaggaaattatgtaaccagcaaacagacagaaaaagtaatttgttgggaatatactagcatatgaaaaaaaggacccattcactaattcatccatctatctagccattcagcactgattaaacactttttatttatcagggtctattttacttagtaggaaaacaatgacatgtaagacatagactaccatcttcaaaagcttccaactacaccatggaatactatgcagccataaaaaaggatgacttcatgtcctttgcagggacacggatgaagctggaaaccatcattctcatcaaactcatcacccgcctgtcagggggtggggtgctgggggaggcatagcataatgagaaatacctaatgtaggtaactggttgatgggtgcagcaaaccaccatggcacgtgtatacctatgtaacaaacctgcacattctgcacatgtaccccagaacttaaagtataataaaaaaaaggaaagtaactcattaaaataatgtgtaataacagccttaggaaaagtgtttacaaggtatcatggcatttacagaagagtatggaactcttggtgatattgcctggaagggtaaagttagaatgaaagaaaagtcattctcgttagataacagagcctaaataagggcataagaaacataagttaaaaacaaactaacaaacaaaaactccaagtagtctggacatcagaagcatggaacagaagtggagcacggacagtagaggaaagcacaaccaatgactcaggcaggcagaaaccaaatcaaggaggccttctctccattcattcttaggccgtggagacctgggagtgatttttagacaggaatagcataatctcattggaagcttacagtattaagtatggaaaatagaaaggaagcaaataggaaacagagaggtgagttgagaggctactgcgatagttcaggtggaaaatggtatgtctaaaacagtagtagtgacatagagaagacgggtgacacctgagagtgtttgggagtagaaagggcagaactttgtgatcacttacacatggagatgagacagtggtaaaagttgaaaatgactcccaggtttttagcttgggtgaataatggtgtagtcaacacagggtgaaaataaaggaagaagaatatgttttggagcaaagataataagtttaattttaaatacatttaatttgaaatgaaaatagactagctatggaagaactaaatgaaaatagcccagtgatatggtttggatgtgtgtcccctccaaatctcaccttgaaatgtgacccctcaatgtaggagatggggcctagtgggaggtgcttgggtcatgagggcagatgatccctcagaaatggcttggtgttgttctctgtggcttaaaaagagcccgacacctcttccctctcgctcctgctctcaccatgtggcacactggctccccctgccttctgccatgagaaaaacctttctgaggcctcaccagaagccaagcagatgctggcatcatgcttcctgtacagcctgctgaagtgtgagccaaataaatctctttactttataaattacccagtctcaggtattgacttacagcaagacagaagagactaagaagcccagaaattctacagactataaatgctatttgtgaatcaatagattttaaattaattggcgatactgcttgcgtctaacgtgctcctcaagtattttgggctgctagtcaataatagaaacatagacagatttcgagaatgacttaattcattgtgttagactacaactgcttggaaagcatagtttaaattcatgctgtatcaggaaatcaactagacttggcttgctgtataaataagcagcacaattaggaagaaagaagcatttgcatttggccagtggagtgatgataaactagaagattccttttgggacaacagtgaaatatgttaaatcaagctattccaatgcaatgtaaacaaacaatatatatcatctcagaaattcaattaaaccatgaatcatcttgtcattaccgttactccagtttactgttaacatggcataaatgtattttaagctgttaaacaggggcatgctattctttgaggaatctgaattttatgaactgtcacaagagcaataataaagatggagagtatcagctaagaatatccataattaacaaatcaatatgttctagttatctgcagtgtggttagctccatcaagagcaagataaaggatcaagaatgagaataaagagtgaattaagcagcttaagatccagtcaaaaagacaaaatattcattaataataaaaaaatcagagtcaagtcctgttgcaatttgactcatgtaaaagttgaactcatgttcaaacgtaacctccaaagttgtaggtgggcctagtggtaggtgtttgggtcatgggggtggatccttcacgaataacttggtgccctcccagagctaatgattttacaggatatcttgttttttaaaagagtctgggacctcacccttctctctcttgctccctctctcaccatgtgacatgctgactcctcattcaccttctgtcatgattgtaagcttcctgaggcctcactagaagcagatgctggcaccatgcttgtataacctatagaaccacgagcaaaataaacctcttttatttataaataacccacccttaggtattcctttatagcaatgcaaacagactaacacaagtcccgaagaagaaggttagatagattagaagacagattagtggttaagaggataggttttagcgtagaatgtctgggattgattttcatttctcctccatactagctatgtgaaattgggatgactacttattctcttggaggctcaattttcttgtctgtacaatgtaatatttgtgtccacttaactagttgttatgaaaatataaaacgataatacatacaaactgcttcaggcagcaccatgcatatgctaaccattcagtaaatgttagctctaatgataacagtaattggtattattattataaaaatcaagaaccaaatcatcagaatatatataagcactaaagagttccaaagaaaggaaaggtcaattggtcctgagctctttgttgaggcttgaaaagccagataagctttctgaagtaaagagaaaataagctattttaagtctctgttacaattcattcattcattcagcattcattcatttattttaaaattacacataaaacattgattaatcatttgatggcaggtgctcaaggccatgaaggtggtaagtgtgaataaaataaaggtttgtttttgagaacagtgagatataaagtatatgggcattcacagataacagggcagagggtagatctaccattgttctcatcctactccttctttgctgccaagtaagtatgaactatataagccacaaaggggcatgacagcttgtgcatatccttcagtctttactcttttgaaacattattgttaaaaatctctgcctttagaaatagtaaattataggcaaagaaaaacacggagagcagccaatttgggacattcccaaagtgttttttgttctagctctgtgaagagtctctggtcagattttaatgagttttcaatggccaacataattgatattctcttccagaatttaactttggcatgtctgtgtgcaggctattgaaagactctgggataagtcagtggtattttaacgtgaggatacaaatttcttaagttggctttcctatttcttgacactgtctaagaaactctactgtatttcaatctcttttgccaactagagggatatttttgttagcactcagtttaaaaagcctaccattttgactaaatttactggcctaattcagttacacagctaatcaatttagttaattcagttggtttgtggacctttcattgaattaattgattttttttttacctcaactggctgagagactagactggacttctgggaatgtattctctaagcacatataaaagacaattgttttgtgttaaaccctagtatgtaggccatgacaattttcattaaagaagtccagatataaaacaaaattgtaaatggatattccctttctcaggtcagtatttggaaaagcaggtttcccacccctccatttccaaacccattcctacttcttcgtgcatgtggagagaaccacaagaggcatattagtgcttcctgcagtacaaatcaccacctacttttaaacgacatctcagaaattattttaaagtatgacaaatagaaacatgtattctagaaatcatatttctaaatattaaattttccttcattaaaaaaattctatcatcttagcattcaaaatatattttttaaaaaatatcaattgggtaagggtctgagatattacaagaataattttcttccatcctcccaatagttagtgacatttatttagaacattccactttcttttctgcccaatgcgtctgattttatcaagtcaccattctaaactaagcactgcatctggtgttttgtttggtaagacagatttgtggggcaagttcaccaacacattatgatcaagcattgtttagattaatataacacgaatacacaaggctgtattacaatttaaattttatttcacatgcaaaaaacttcccctttacagaatttagattaatcccatggtttgttattgactatctttagaaagaatcctattattccaaatgacaactttgtaaaaatgcagtgcagctataatggaaagtacaaaagttatattaagataactcctttctgagtacgtgtatattcattttacatgtttcaactagaatcaactcttacaagtctgccttcagccatctgtatcactgaccagcattggaaaaacctcattttcaatttctcggcaccgttgacatttggacctttaatgactcattaaccctttacagcctccttctccagatcttttcaatcacatatgatcatgtcgccaaactgagatatttttgactgttcgttgctagtgcagataatattctctcctcttccattctcccagctcagtgccagactggactgtatatgtatgagatgaggatgataaatgggagaggagagagaaagccaggcaagaggtgggggagtagagcaagatgattgagcagagcaaattagaacccataagttatattttactggttttagaccctaaagagatagagcttagaatgactcaaaagggaatttatgagactatggactgcacagtgaagcattagaaattctagggacagatgtacggtcagagttgggaaggaaggaattgtctacttgttacaaggtgcagtgccactctagagaccacagattggtagctcttggggcatgtacaggcacatgcttaacatggatcgggctacattgagattttcttcttggaagaagaagatgttactgtcagaagagtatgtggaaaagtagattcccaaggagaagattagtaatggggtagatactaaacaatgagatagataccaagtagggactccaggtgatgggataggttttgagcatggggagacatccctctggaaggattcttggagtatgggacaaaggctgaggtcctcccttattttgatgggcacaatcaagccagcagacaaacaggctactcagaatcaaagaagaacaccaagaagtaatgttgtctgtctttagcaaggagcaaggaagagagcataggcaaagaaaaatatctgaaaatgttttagctctcccagaatcaagattttagtgtggtttcattgcttccaaaaattacaaactttccaaacacactagagtaaagctcacacaccacatattaaaatcaatgagagatgatctgtgattactcactattgacatggatcattgatgacagtaagaccctgcaaaataaattcccttactggacttacaaaaacctcacaaaaatataaaagtaaataaaattatctttattctattaataaagaaaatgtatatgaagaaaatgcactttacaaagtataagtaatttgccctgaatgacatggttactgttagaaccatgacttggattcttaaaggtttaatatcctgtcctatatgctatgctacctctaaacatcacctcaagaattcagtagaggccaggtgcagtggctcacacctgtaatcccagcactttgggaggccaagatgggcagatcacttgagcccaggagttccagaccagcctgggaaacatggcaaaacctcgtctctacaaaaatacaaaaattagctgggcatagtggtgtgcgcctgtagtcctagcttggtgggggttggggtggggggatgtgctaaggtgggaggattgtttgagcctaggaggttgagcctgcagtgagctgtgattgcacctctgcactctagcctgggcaacagagcaaagaccctgtctcaaaaattgaatttaggaaaaacaacattacatctattactttttttaaatatacagatcactcactgaatatataattataatatatctgatgcctgtatgaattaacctaagtaaaaaataacactgtttcttctgaatttattttgatttttctttgaatcgaatttattacccaagccactctcaagcatcctacagagacctatgaaggatgagttcttatgtgacttagctttaaaattaaaaaagaaaaaagattttaaaatagcaagcaagcttttgcttttcttaagaagtcaagaaaatggactatagatataggtaaaatacagttaaagagcaacattgttataatgttgatacaaagtcaaacatatgaataaaaaaaatgtcaatcaactggatcctttcaaatatctccccaaacacctggaagatgacaaattttttagattgataacctttataatgtaaccaagaatattacacagcctttgtgagatagaaattgttttaatataggatagaaatgagcagatatcacaatggtttgccacaagtaaacgaatttccttctttggataactttaagtaaagctaagttcaagtgaaaaaaaaaaaagctaagcatgcagtggaaaaaaaggataatctgtttggattcaaggttatgctattcaattctcaaatcactgagcagcatttacagtaaaatgacactctcatttatctcccaggcaagcattgagacctgccttaagatgcaggaggttagtagacttcatagcacttaattttctaacactacaataataatagttaacttagtaaaaaaaaaattctgtgtcttcacataaagtgaatcaaaatatatctttgcatcactgcctactgtaacctcaaggaacttattcatctaccaacagccaagacattaaaaaacagagaagttggtctctcaggatagataccctattcacttaaggtggggcagataatgcacagactctaatgttggatctgtacactattggccccaccttaggtgaattaaaccaacaacatcaacagggaaaaatgtgcaaaaactgtgttgttctcactttatcagtctttccaatgtttaagaagcacagattatttgctcagaagactagaccaactggaaattgaatgatcttgatctcttttaagaaaaaaccatttgatctaaatcttcaaataaacaaaataatttgcaatctgtgtcttatgcttctattttgggagtcagaccaggcatgagctgagtagcccattctgtcttggaggacaggagcaaaagggactgaaatataaagtcacatgtgggcattaaagaacatcctggagtcccaggccatataaaagggcttgtaattagtattttagtaaatactaatgagaatgcatgtatcaacccacattagtaaatattaatctgaagtaatattctaggactatttattaattactttcaactcttcccccaaggtctagtaacccacaaaaagcttgaggaagaaaggaaatagaagctttgctttgttgaactatttgatactaataaatatactgggcagccatgccatttttataactaatcaaagcaagtggtttgatgttaaatcaataatgtttatacaaatttgacttattagatacagtgatagttacctcatggctggaaatcagcatagtaattaaaattgtgttctgatatttattagttctatgatctttggcatggcacttatctttctaagcctcatgctgtctcatctataaaacagaaactgataacaaaatccacctatcaaggattctgaggctcaaatgagatggtacagaaaacataaatgtgcctggcacagggtgacagccaataaatggcagctgttggccattaaagacaaggcccattaatttgtaagttagtgcctactacaaagagcatagattagaattcacacctggattaattaattttcatcttctatgtcctaaaactcattcctccttgcaaactgggtgagactatgtagatgccccagcaaattacccagacggaagatgatgagcaagtagcatctctttacttaaaaagaatcatattttctttccaagaaaatcttcataaaccttagcccatttacataaccaagccatctctcaattggtcttgtttgagtttactatcccatgtcttcttacttttttaaaagaggtaagaataggctttgaacacagaatctggtaatagtctcaaaattatggtgctaaatttccttggcttatcaacattaaataagggaaaggaaaatctactaggagcatcgtgacttggttgacacacatatgagcacgaaaggtagggtaatatttttaactatatttagcgatgttatagcttggggtcagttcagaagcagaaagggtaaaaacaaagcgagtaatggtgacatgcaatattgtcctcattatcagaagataaaaccatcatactctaatgggctgatacagattgcaatttttagtagctgatatttccaagggcctagcaagacagagtgcaacagtacgtgtcacattctaaagtctaggagggaaaccaaagtgatctcagtaacataggaaaaattttaaagatatagcttatatatacattctttagtggactcaatagctgtattaattatgagacatggggggaattatctcaatacagccttgcacataacacatttgtatgcaagttttacacatacatctatacctatatatgcatataggtctatacacaaatattctgtaactacacatatacttgttcattaatcaaccattgagggcctacaaagtacagtgagtgaaaatatatagaggaagcaacactgagctgctgtggacacagaccatacttatcttgaaggtctctatcctgcaatcctaacttcccagagcagactactaatatattacaaagtaatctactttgtaatctgttagttttattgctgacggtattttaattttctgctatttggcatgacgaaccacagaggatcagaggcaaactgttgctctcgcatggaagtggctcctatatgaagacacagtgatgatgacaagaagcaattgctctcttaataagggagaaggatttaaaatattagttacaggccaggcgcagtggcttaagcctgtaattccagcactttgggaggccgaggtgggcggatcacgaggtcaggagatcgagaccatcctggctaacacggtcaaaccccgtctctactaaaaatacaaaaaattagccgggcacagtggcgggctcctgtagtcctagctactcaggaggctgagacaggataatggtgtgaacccgggaggcagactgtgcagtgaaccaagatcaagccactgcactccagcctgggtgacagagcaagactccgtctcaaaaaaaaaaaaaaaatatatatatatatatatatgttataaatggtagatctaggaacttagaaagtacagtagtttagtgtgagggcaaacagctttacatacttcagctgccccaaaggactgactgtattacagcacagtacagtgactgatgttcacaatgatggctttgggttatcaaaaagaagttaactcacgttagcaagttcaatttaacaaggtacgatgtgtgtattattttcaaaatggtaaaaggagcaagaaaagttttcttgcataaaacagaaggcattagttatatggaatgctcacttctgtaaatacatcttccctaatggtatgagatagttagtatacatacccatccatccatctatgcatttcatctttggcaattttctgttcttttagttaagataggttaccgactactcctaccactgcaaatatcaccaaactacaatacagtatactaattactaaactagattaacactgatggctaactttattatttataattgtaatttcagatttcatatgaatgataaagaattctgtaaaattacattattaacatcttagagccaggtggctcatgcctgtaatcccagaagtttgggaggccaagtcagaggcaggtggattgcttgagtctaggagttccagacaagcctggacaacaagttgaaaccccgtcactacaaaaaaatacaaaaatagccgggcatggtggtgtatgcctgtagtcccagctactaggaggctaaggtgggaagatctcttgagtccaggaggtcaaaactgcagtaagctgtgatggtgtcactacactgcagcctgggtgacagagcaagatcctgtctcaaaaaatggaaaatacaataaatttaaaaaataaaatttgagaaaaattgaatgaagaaatatgtaataatgggtggtggtatctgtcttactgcaggtaagttgttcctcaactaactctttctgcctcgaaggtggccataaattgacacatactgataatcgctaagcaactgcatggattatttaatacccgtcaattgtagattatgacaaacataaagagatagtctttgccaaggtccccagtttagattgttaaggtaaaaccctgaaatcttactttccctttcaagtttcctatactttattttagataaagctaaattgacatgtttagttttcataaaattgtaagtttctttgcttacatattactaatacttgaagagtactgggaatatcatcctgtccttgttaacaaaagtgaacagaacatgaaccagagaatttgaacttggagatctagatgatagctacatcattaagaaataaaagtagtcaaatggaatattcagttgtttttcataatatgactttccaaacattattataaattcaattttggcttgtttctctcctaaagaggcatgagccagtttatatactaaaactacacatctcacttaaacaaaattattatttttattattatttcaattaactttctttcatcctaacttctaagatgctattttggttgttctctttgatccgcctgtttttcttttgctctgtaattgccatcacatagcaagatctagcccttagccttctacagtctctctaaaaattaagcatatcactaggtggatttaaagccaacacactcaggaatattcagtagttttgcatgtcactagtttcctgatctgaccttactgccatatcatctggatatcccacccttttcaaatgtaagacccaaattacaactattttttctcccacaaactagtttattgacatcaccattatctccattgctaaggcttgaaaacgagtcatctgtttctttccagtctttattttcatttggattcatcacttttttctttggaatctataatttctatccctttacctctcttctcaatatcctccaatgagtataggatcccttaagttcaggcacaaataacttcagcagtctctagtctcttctctcctcaaatccattttacaattaatttgtctaattttgtttcatcctgtcagtatcgtattgaaaatactaactgaataacttgtaccatgttcttattttgaacctaaaaggtgatgcatcatctttgcatcatcaaaccccaatgtctcatttgcacctggaaaatcatagcaaactggttttaatgtccctgtttccaatatcatcagagcctgcatacttgttgtagtttactttttttcctacactcaagtttaaccgcatcaaaaatatagatcttgcttctaaaggtaatcttgaaactagacaggctttctctaaagtataatttcaggggcttggagctacttacttcctctccctcctgaactgattctctttctgctgtctatggtgccacaactagaaatacatttctccaggtttaaagctgaaccctcataactttccaagtagccttctagcaaaaaacaaacaaagaaacaaacaaacaaaaaactagagttttcttttttttaatatatttaagttggcttttagaaactggatggcagagtgttttatttggcaaacatagtacatttttaaaaatgaagttattatccacatttacacgttaggtttcaaacaaaaacttagatttccagtttctcataaaaaacagttgacgttgcaaccagaaattgcagcaaattcctctcacactcctgagtctttctaaaaggggctactttggagggaaataataatattttagacagttgaaagggaactatgtcactagatacaagaccatgtcagcctctcttaggagaaaatcacctttcttgtttcaggccttctgcccatctgcaaaaacactactgcttgtcttctttaataaatggaagcaatttaaagaaaacaatctataaaatgctacataagaccacattaaaactacaagtaaaaattgacatccaacaaaaccctgctttcaaatacaatttcttagaaagaaccttgattctgctgtatccaccacatctcgagtctatctccagggaaagtacaatagcgttaaaggtaacgggtagagactgttgccaagtcaatgaagcaaagactttctctctagatgcatggaaatgcacggtgatgggttgattaggtcaaggcatcttttgtattatgcatgtaaatgggaattaatgtcctcagagtgccagtagctattttgttgaatttggtaaaaatgaaaccctgtgtttaagcttcaattctctaaagtttatgttgggaggaagatgcaaaactctttatacttccataattaggtattcctttgctgacttatcaattgcctcaacttaggactcaaagtgcttagcgtcaaattgaaagagaacacatcttttattagaattgcttttggtttgtttcctctgataacaaggtaatatctgcaaaccagtgaatattgacactatttacaaccaaattataggaaaaagtcagtagggtatttaaagatgggattagtaatacctcatttacctaggcatttcctgggaaggagcaattctggataactgaattttctctgtacctgaagcttatgcccatttaaacctaaatattagatagaaatcttcataaaatatattaactgctacattcctgtcttcctacatagatacttctaaacataatactatcttttttttctcctgatgattcaggggtcatctctgtgagcattcattactgtaccatgtggttatatatttctatgcatgctttatcatttttttctctcctccctcaacgtcaggctttcagctgtcactttggctgtcactgtgtctcttctcagcttcccctttgctgtttctaatctgtcgtgggctgggaaaccagataaccaagtttattaagaatgacatgctgaataaaagtcagtaagactcagagtgggcactaagaaataaaatgcatgactttaatgtgcagtttttgtgaaaactattttgaatatgcagaggctttttaaatttaattttagattgggcaaccgcgttagggttgaggttgttgtgagaatttgtagaatatgtccccattcagtttcaaagtatttctctgcaggagaccaaggcagttttgacaaacacgggcaagagaagctaagttttccctttggaagcagaggaatctggtagggaaacactcaaggacactcatgtgaggctttaggcaactgtggagatcaaactcttctctctgatcaccagatatcctcttcttcatatcgagatggagggcattgcctgaaagaacgaaaatttagcactaataggtaaaatgtatggattcctgttagaatctctcagaattttaccttctcctttatagtagaatgttggctaggtgagatagaggtaatctgggaagggaaaagtccagaagtcactgtttttcccatgtattaatctacccacttcacttccatctctttctggacaatgcacaaatcagaaccctaacccaacgtttcttttcctgagactaatgctgtccctgaggatagtctatggggtccccaagtgcttgtggcatcctgggcctccccatatcaatacatcaccaccacctgttgttaaaacataggctcatgtattcacttgcttttattcgaatgacttaatcttcatggcctagcaacaaatagaaccctccctacagagccctccttatataccttattattgcatactcactctttttatgtcctctctcagtgcttctctcagtgctcattttaaaagaatttcacctctctaaaacagagtggtgcaggactgggtgggtagaagaaattgatttgttttgcctgcccctgtagccacagaatccagttacagccaggtttttgctgcaatcagtaaggatttctcatgttctaacaaagatgaaagcaataggagatagcatccgttatcttctcagggactttcttttcagtatgacaatgggcattttttgttgttgtttttgtttaaagccaacttacatgctgtacagcaagggcctccatcttccaaacactctaaagagtaaaattagtctgaaatccagtagaagaatactgattataccatcagtccaaaatcttcagggccaccagaaagtgccatgggcttgcggctgctaatcacttagtttggtgctttctaacaaggtgttgtctttcaggttttttgttgcatcacactaagctatgcttgcttcctccgaacacatttaagtggattctttttccaatctggagacttataaaaataaatatacatacccctttactactaatagtagggttttctgcaattggatctaagttctgggagcatgagtcaggggaatcaatttattctattttaggatatgcattgagatccacctcaaaaccttttaaatcaagattcaattaaatttaatatatgtaagtttgttatattaaaaaaacaaattgaaacaaaatatcactggagagacacaagaaaactgtacagtcctgtggtccttattttatctcttctttcagaaatgttggaagccaaactaaaattacaggcttgaaaagaaaaccagttttagaattccatcgccctcaaagatttcaacaatcaaaacaaaaccagttttataattccatcaccctcaaagatttcaattatcaccactacaaatcaatataggtaatcacttgcatacaccaagacaattttactctaaatgccatgtctatatacataactggactccatcctttaaattctctgtataaaaagacccagctcaaagttacattctctttgaagctatctggatttcccagatagaagtctttggtctatatttttaatctaagtttagcatggttgcttggtcttgcactgtcatgtgttgtaccacatgatcactcaataagctttaggtagcaaaagagggagttctttccatctctgtgttctccaaaagtgtctagaagatagtccaatgtaggaaacaaattatatttaagactgtcatacactgctttgtctaaaaaaggagttattttgaaatgagaaaacaaaagctaacaacttccaactttataagcccatttgaggcttcccatcagcttgtttttttttgcttatttgtgtgtgtgtgtgtgtgtgtgtgtgtgtgtgtgtgtgtgtgtgtgtttgagacggagtctcgctcttgtcacccaggctgcagtgcaatggtgcgatctcggctcactgcaacctctgcctctggggctcaagcaattctcttacctcagccctgggagtaggtgggattacaggtgcccgccactatgcttggctaatttttgtatttttagtagagagaaagtttcatcatgttagcaaggctggtctagacctcttgacatcaggtgatccgcctgccttagcttgtattttgaataacaactctaaacagaatgccgtgatgtcaacatttcattttcacatcaaattttaattcaaacccaactttccaacctgtaaaatttgctggtaggctggccaataatatgtacataacctgaaatgcaaaatatgatgaaaagcatagtgttataaaatagaatattccagacattcataaatatggatttgatggcccatactatgaatgattcagcacgcagacctttgaaattgtgatagtcctctttatgtacagaatgaaaaccatccagaggcaacaaaatgtcgaattctctaatccatcatatcatgaagccatcacagccttgcacatgagatttggttggtgggaatagaaaaacatttgcaagtctctggatttctctggctctttactcagagatgtcacatgcatccatgggtttgagaataagtgtaattgaagtgaactgcaatgtgtctctaataagtggctttgagaacatatatttgtgtaggcatatagtacatatctgtactgaagcactcttatcctaagtgtcatcttgtagcacagacctgatcaaactccgggattcaaaatgataatttatttggtataaatgacacaagccaaagaagataaaatatgttaagtacttctcttgattttctcttctccaaacacacacagatattaaataaaccactcccctcccggttcttttcctttaaccatgagaatcactgacccactgtgctctcagtattatccatgtgaaatatctgccccctcatcgggtacaacagattaaatgatgattaagctgagtgttaaatttaggatgttgtttcacaaaacctccctaccttgtagtgacatttttttctaaagacattttcttgtaatactccaaaagttaatgactgaattttagatggaggcatgacgtgaatctcaaatgaccataatttctttataggcaaattatatacagagttttcaaagacgtgaagagagttatgcatcgttgattttataccctaagtgatgattagaagtaaaatttcttagcttaaaagtaaacagaaaaataaaggaggtatctgacatggggaaagaaaatctcaggaacatagaactgggcttgcatactgtatagtacttgaaaaaccgttaagtggaaatgtatgatctcagaatagtgtttttaggcttaactctctgcgataacaggttcagactgacctggtatctcataagacattttgatagcaattcaaataaatgagattttttaaacattgaagttaaagaaatttttaaaactcttcaaatgcttatttttttaggaaggataaaatggtcttattttcatctgtggaaacaatacacatgagcagctttattctgaaatgccattgcaaagatttgtaatgcttttctattgttttacgatcagagttgctgcttttgcagtgcagaacaatgctgcattatatagaatcggcagattgaaccaagaaaacaaaagggagcactgggcaaccatccgttccttttaggactcttgccctcgccacatatcaccagatctctttagttagtcagtcttcttgtggccataacaaccccgagggctgactcggggatgcttccatagaaaatctctcattcactttctctctctgaactaaaactgtagcccaacagctcccattccctattctaagatgaatactaagactcatctgtgaagtcctttcaaatatacacaatttagcttatacgtatatacattaaagccaactccatggtagttatattcatctgaaaatcctttagtttatatcctgcactgattcaggctgtcttggggagatacgtctgtgtgtgaaaacaaaaaaatggcaaatgaattgacttgaggttataaacaaagatccgattctatctaatccttgctaatttcccctccttcttttattttccaagtaagcctagttaacaaagaaattttacagaaaaaaaaatgccttggtaaatattatctgaataatcctctataagaaaagcaggctctatttcataaatggaataaaatgcctttgaatatgattagagattgcatcattatgtcatcctgttttgagcatcattccttttttattttctagtggtttctattttattgttactttgtgataacacactaacatgctatgtgttgtatgttagcagtaatattatgtgcttgtttttagattgttctggatttatcttttcaaggtcaaaacatttcagtctgcttaagaagctactctgtggagatttttttttcataacttctatttctttttaattcccagacatgtttaaaattctaatcagagtgtgaaagccacattcaaatatgatataacacagagaatcaaaatcaatcatctaccacaactttatccctattttatgatccatcaacaaaaagctatttttgtaatctcgttagatttgccagcaataatgacctaagattaaaaattggggagggcttttttttcattttctctttttccccttgggtagtatgattcactctgtgggtactgcacttaaacaagtattcacaccccctctgatctgttcttgtcagctttttcatgttagtacaacaggaaagcaccccatcaatcattgtttcttcatctatcagtcaaaatgttcattttgtgactattggtcctgcatcccaatctgtgacaatctatgagtgtatatttaatttaaaaagagcaatgtgggaagacacaacactttaagtgaagtttgtaaatgagaagagctaaattatcagttactgtgtcaatgttattgatgggtggactagaaaaatacctactggatgcaaagtcgagaaacttactgtaagccctaccccagtcccctaaacccattttgctgctgaatgctgacacttgaatagtttctgataggccaaggtttttcgtatcacaaggagaaagtagatttaaaaggcaaaaatccaaaggagagaatacaaaaggaaaaatatagatcctgtgggcagattttggtagagtaattaacagaaacagagtgcttaatgccaatatgctaaatactaaatgctaaccgaataactataggaggtagactgaggtgccaagattggagactggtgtggtaaaggccagctccacttgacagtaagagtcggatgttaaacaacttgccatagctgcctcctgacttcttggaggtgtttttttagaatataactgtggtcctttggtccactatacctagggacttttggacttcctcctgcctacaattgcgtgcaaaggtcaaataaactggcaaggaacaaaatgtgagaccacaaatgcaaaaatggcacaactgcactactgaaataaatacgttgaatcaatgaactctgatatttctgcattaaaatgcagcttgcaaccactaactgcaaaggaaaatatgaagggaaaataaagagatggtaactaggacctaatatctatattactaactcaacttcagaaagttggtatattttcaaaattgcagatatgtctgcaacctaaagtatacttcatagcatttaattaattaattaattttgaagtttattttagaggcagaatctcactctgttgtccaggctgaagtgcagtggtgcaaccgtagcttattgcagcctgaaactcctggcatcatgtcccccttttacctcagcctcctgagtatctggaactataggtatccactaccatggtcggctaattgtttttattttttgtagaaatagggtcttcctatgctgtccaggatggtctcaaactcccggcctcaagggattctcttgccttggcctgccaaagcactgggattataagtgtgagctaccacgtccagcccatagcattttattttgaggtttagggactaacgtgtgtatgatttagcaagtgatgtttaatggcattttaaaataatgggtaccaaatagaaacgtatgaattgttacttgaatataattaaactttgtaaattaatggattagactagaaagaaaagattccagaaatttgaggggaaaaggtaggttctagcactgtctcttacatttacatattctgtctgtttgggcatgttattttatctttttgcatcggtttccctcttaatgtatgggtgaatatataatagttggaattaaaccataaatcagtcaacttctaagctgtatactataaaaaacatttgatgtaaataataaaactccttggaatctgtccctctttgtgtctccataaccttctatatttgttagttgaaataattatttctaagtctgaggattgtccattcaaggttgaacactcaagaaaactgatttatctctgttcatctctacaaagtcagaatcgaagaagcatcatatcctttggttaaattcaaggtagggaaaagaaaatcaaaccaattctaccaaagaacaaatcaattgatttgattatgagtaggtggaggttacattctttatcttactgaatttgaggtaaaatcggttaatccttttatccccaatattcatatttaatccagaaaatgctctctggaacaaaagtaatcattacaaaataaaggctttattctacattttagcaatagtctttccttggcttataaaaaattaattgcggggtattctcttgattgggtactttagatcctggtgactgttctaactgatggggctgaaagacagttcccttatctcatagccaaatcacctccatgcaaattgatctgggagtgcctttagaataaacacagctggattctctgcagccatttatgggtccagtttcctaggcttaattttgatttataactactgaaattaaattagccatcttcactgcttaagggtggctttgatttcaccagtgcagtagggagactatttaccaacatattttatcagtaacatttcaacctgggtaagggggtggcggtggggggaaggcatcttatctttggtatttgtacttgagattccttcagaatattttaattgtattatttaccgacaaatgtgaggattagattgtcaaatcagactcacatgaattaaagatcttgcccagcatcaagctttgctaaataatttcaaggatataagctatcaagttcagataaggtgcatcatataacataaagtggtgtaccttatgtcatatgctccaggtagccctgcctcatagatcctgggttctattaactatgggtaatcccttagccagagacatcttgctagggacagagatatagtctcttattcatagtaagtaacattagtctatttccatttgacaaagagattagactaagtctttgctttcctctaggagcacaaattattgtacaaaacgagaaacaaaatttgagagattaaaatatgtgaaatatgttaatagttctaagaaggcttttatctagaacacggtaataaatgtcgacgtgctatagtaggaagagttgaagataaatggttagatatcgctttttatccatatgactttgtgcattagttttttgagcctcagttttactaatattccaaaggattagggaaataagcctaaccagagtgactctgatttttttttttttttttttgagatggagcttcgctctttcactcaggctggagtgcagtggcacaatcttggctcactgcaacctctgccctccagcttcaagcgattcttctgtctcagcctcccaagcagctgggattacaggcgcccaccaccatgcttggctaatttttgtatttttagcagagatggggtttcaccatgttgggcaggctggtcttgaactcctgacctcaggtgatccatccgcctcagcctccgaaagtgctaggattacaggcaagagccaccacacccagtcgactatggaaattttaaaagacagtacatatacgtgtgtgtgtgtgtgtgtgtgtgtgtgtgtgtgtgtgtatgtatacacatatgctatatacacacacacacacacgtatatcacagaactgaagaccataaaatgttctatacatatgaaaaaatgagaatttgaaatgtacataattcttcacacagatagctgacagtgttataaatctcctttcttataaataagaaaaacagtctcagaagtaagtaatattctgatggagagttagaaaagaaaacctgtcttacaactctttaaacatgcttctcctctaagctaaatcatagtttgctaaagaaggtcgtgataaggtagaagaaagacaagaaaagccaaggcaatggggtgaagcaggcggagaaaactgtttatgcctcttcttccaatgtctatttattttctttgtggttctgagcaactatttcttcttttatcttgcaactgtcaaagcagctctctgtagagaaaccagcaagcacacccattaaaaccaaagcatgaattttcgggtgaggatcagtgaggctctcttaagaatacctgaattttcacagagataaacatatttatttgatttaaatggtagaaagtgttaattactaagtttcatatactaccaggagtcatagagaagtcattttggagaccaagagtatattcctagaccatgtaatcacatcatttgagtagctgcttactgagtttattcacaatgaaagcctgatacataaattctttaaacagaaaccagtggcattgttaatttccacttttgtttccaaattgttgcttttgtctcattgagagcatattacttacttcaagcaccttaacaaacaaagctgggtcatacacaaacgtcctactgtaccagcaataagacaatatgaataccctgcaacctctcaacaaccagaagacaaagatgtatttggaaggggcagatgggaagtgaaaaagagaaataaaatatactttacagggaatattttgcacacgtaattctgagtgttatatttttagcttgtataaataaacttcattagtcttcattttgaatatacaggaaaagtttttttagaaaagactcattgtcacaagctgataaggtaagttaggacagtatatgattaatatgctacaatgatgtctaagagagaggatgctcattaaatttgtgtgtgacaaaagttggaaagagtgttaagaccttgaaatactggagcatctttcaaagtgaaacttgacaagttagagaaatggtcagatagagaaatggattttaatcagactgaaaggaaaattaatgtattggttttgtcagttgtaccttcatcttgaacgtaatgactgcctgttacttcctctgtggtttcatccgaacctaacgcgacactcccctgaaaggtctcctctctcccttccttgctcttctgtagcccatgcttcacttctcaactatggtgatgttttgaagatgtgaattagattacatcattcttttcttcaaatcctcaaataatatttagaatataattcaaatcctgggttgccatggtctacaaggcctcaaataaaataggttctgcccacatctttgtttcattttctttcttttctctgcctccaggttggcacttttgttcctttaactcttcaatttaccttggtgctttgtaccagctgttcccccaaagtagacagctctccatagctcttcacacggctgcacttcctgctactctcacttaaagtcactgccttgagccaatttcgttaatctggctctaaataacaacacaaccccatctacactacagttcatcctaataccagtctaattttcttcataacacctatcattatctgaaatcatcttagttgtttcactttagaatcctccttctctcatgagaaagtaaacattgtgcgggcagggtcatggtcttgtttgtcctgtacttcccacccgtacagcagtgctggcacttagtaggtgctcagtagatattcgttgacagtataagacagaagtcctcaaatgttgtccaaggacatttggtagtccctgagactttcgggagggccaagggccaaaatctttttcatcatctcacaaatatacaacggtgctgtctagaggccaaaggatatatgctatcacaaaagattgcctgcagaagtagttgtgagaatctagctctcttaagccaaacatcaaagagattgtcaataatgtaaaataagtcactcttctcacaaaattatcttagtgttggaatataattatttttcataaaagtacacaatttattttaacatgcaacatgcaatgtggtggctattttaaaatgaattaataaatatataaatgttttctcagtcaattctcaatagagtaaacactaatacatatacataacctatacaacaaacataaacttctcagaggttttcaatacatttaaaaagtaaaaagggatcttgaatccaaaaatgtgaaaaccactgaaacagaatctcatcaactagtctccattattccctagaaaacatccagtagaactttcttctccagttaaaattgccctcaaagaaggttttctctttcctgatatccatgcttttgctattcattgtttatgaaatgtctgtctgtttctctctttctcatttctccatgtttgaagtacactttaaagctgtccaaagtagtcttttccatgaaatttgactcatagctctaccacaaaaagttctctctatatatacctttagagcattaagaacctatactaccaattgacaatagtattgttaattatcttctcaaagtgcctgtaaatctctctaaaggcagaaacctctctaaagacagagactgtcagacagtcatggtgcagcctgtatgtaccatgcaggaaacacaaaatgatagcaggatctagcctccaacaaactcttttctcttaaaacctagtatgggatgataaagattaaatggaaacaaaagcattggttagctatccacccaaaaattaatattctggcaatattcacaccttataacttttgggattcaccacccaaggtagacagaatcctcaccaccaccagcaaagaagtccaaatcctaatttccagatcctgtgaatatgtccttaagacgtaattaatgttatagatctagaaacagaggaatgatccaggattatctgagtggatcaactcattgcatgagttcttcaaagcaggagctttgtttggagcaggagagaagtggcagaaggggaagtcagagacatctgaagcatgagagggacttcacttcccactgcttgaagacagaggaaggggcacctggaaagcatgaaatggaatgagggcagcctccaaccaaaatccaggccccctgctgacagccaacaaggaaactggaccttaggcccacaaccagaagggagtgaatttagtcaaaaaacccgaatggcttgaagcagacttagcctcagaacttccagaaaggaacatggccctgccaacaccttgcctttggcccaagcagaggacctaccctagacacatgatactcagacttctgacctacagaagtgtgaaataataaatgtagtctgttataagccattgttggctatttttacagcaaccataggaaagtaataaagcactcatggcatgttcaattccaatagcccttgcagcagacacacaaaaccaccaacttcctctaagctccaagtactgcactctgtccactcaccctgctgccttctttaacttacaaattatgcacacagtaggtatgtttgcataattaaaagataagtagaagaactaatagtctttaaaaaaaattgttcctttagttgttctgaatatatgtttgtcctttgataaaggactctttgcaaggtttccgtatgacactttattcttaaaatttttgagcagttaatttaaaagtgaatccaaatggatatccaaatctaaagtcatctaaactgttagtagtgtcaaatgagattgctccaccacaagctccatttggaaaagtaaccagcacctgacctacagctgagttccatgtaatttagttgtcaaagtgatggagcacaactcttccatttaatttctatgacatctgtatcaacttgactgtatcctttgctgggccaatggcaatttttctggacaagatatggtgtaaatggcagggccaaaacacaggagaaaaaaaatgtaggtgaaattttaaaaataagataaaagatcacatgtttcctaggcatccaaaatttaaaccatctatttgatgatattaaactcaaagttgctgtgaccttattgtattagtaataatagcaccaaggtaacaagtccttggaatctttctatagcatagactattaactaggctctaataaaataccctattttgttcccactgcatgtcacttttgtagggcatatcttggagttaagaaataaagattgaccatatttattgatttgctcattctctttagagaaaaatgtgaggataagttttttatttgatacctagaccaatagatttccaaagagctgggatcaagatttttttttttttttgagacgcccggctaatttttgtatttttagtagagacggggtttcaccgtgttagccaggatggtctcagtctcctgacctcgtgatctgcccgcctcggcctccgaaagtgctgggattacaggcgtgagcaactgcgcccggccagggatcaagatttttaaaatctcttaaattgtccgaagggtgcttcttccactacatcatagacagaaataaaatttagttctagttagacaccctgctctttgaaattaaaaaataactacattaaagtaggcctttccttccactgataaaatgttccaaagttatttatcacaccttgtctattacatttttgaacagataatatttctactatctaattttttaaagcataaaaatatacagagaaaagtttcaatctcatcatctctgtctcttatctgtccagttacctgcactcccacaaacccgtctaaaacaactattgtcattattattattatattgactcttccagagttgcttttggcatatacaaacagtattattattactgtattttatctcacacttttggtaacatactttacagacaattcttttcacagaaggctagcaagtcttacggccatttgacagattaaagcatcaaggctcaggaaaattaaaccttttgcctacatatatactgacacttgagagtcttgcatttttctgaatggtattctatttctatcataccttattacctctgttagcacatgattacctaccatcatttattattctctgtcagcgtcctgcatataaatccccatcacaagggactgaaaggatcttagaattcatttaatcttctactcattcagtatttgcatcacatggtaactcccattcctcttcaatgcttggatacctccagtaagttgtaagccctttaaggatgggagacattttctgctattgttttccctctgttataatttatcatctactcttttctctcttctatcaggataattataatggcataatcccttttatgtgacttcccagtcacagttagttttttactataagaataatttgtaaccagtccctcataggatctcagtgcttgtccattgttgctttttcgtatatttgataaatattcaatttagaataatcattggtaataacttctgtatctttacaaactaatgactgaaaataatcattataatgtaagactcctttaattgggtttccaaaaagattgtttcataggaaataagacctacaggtattcgaaggaaaaaataaaagcattacatggtcaggtaagtaggattattagatattcttagaaattcaccgtgtccattattatgtacaaagctcagagaagtggatataactttgtttaaaccagagttttctaaacatattttcacattgaactccttttccagataacatagatgagcatcctacaggccattttcatgaaccatactatggggaaaaacgttgcaaaagaccatttgtttttaaaaatgttgtaatgaaaaaaaaaaacaaaacaaaacctcatttgtattcagcatatgtaaaacacagaagagaaagcatatctgaaagaatgacaaatagctcagttctcttttccaagcttcacaaagctacatagttcatcttctcaatataactcaaagaagaacagagaaaattttctgtatgcacataaatgtattcatagcatttttttgaatttataatgccttggccgccacatctcagactgaagaattaaaaacaacagtatttcatacttttcttgatttttttaaacttctcttagccaaagaaatcatacattgctgtacttacattgtatgattatttgttattttagataactcctcagataaattcactaaattaaaacactgtatcgaatatgttttgcttttttgtctggacagtctttttattgcaacatataatgtaaaaagtaatatttattcattgtcactgttataattatttctctgattttaaaaacagtaacagacaagttttttttcccccaggattctccattatatctaactgaattcccctatcaggatgccctttttgttttgttctgcttccccctttataataggatataaacaagagacagaagttaaatctccagtgagagaaaagtaacacctaacgaacagacaaacaaacacaaaaactggtgacagtctcaacattctcaaatgttttgctcaagcactctattactgttagtattgctcatttcatttaattgtaaataaggtagattttgctgctaagcaaaatgatagaagctagatcttcctaaggacaaacagttataagaacatctgtacctgagggcaaaccaccagaaaaagcaagaaaaactcctaatagtgagacagaatgagggaaaggggagaaagactaaaatgtacctgccaagaaaatggcatatgtttaacagatccaggtaactcttttttgatgattgcagtaacagataaatgcagactgacctctgcaccaggtatttctagatatccagatggcactcaagggaagggagcaaccttagcttaaaagttttatttcagaaggtggtggagggttaagaagaaggaaaggtaaagatgtgtcaacatcatcttctacaaggcttgttcatatgttatagtccatttgagaaaggttcatttaaagtatgttttggtgatcaatggttgcccaaataggccctgcctcagtagagaaacccatggagtgccataaagggcatcaaggatagacccaacataaaagactacttacagtaatttaatagcaacttaattcagatcagagctgtgcaataatgaggaacggttaactatgaattgatgtttattgtatgttagaatttgagctaagaatttaacatggattatagattacccacttaattaatcctatagacaatcctgtgagattcattatactaactcattttccaggttagaaaattgaaacagactgaataagaaacttgcctaaagtcatatcgtttctacgtggtaaaggcaagattcatatccagagctgggcattttaagtttactgtagaataaaataaaataaaagcacaattcaaaatatattaaaatatatctaggggagccagctctgagtttaacttacatcacttctggtggattgaatggatttcagtggtcactcagctatattatatataagtaggaaattttctaggtatggaaatatataaactggatcagattctagaagacagctggtggccaatattatctttattattctctactgatagaatagtatgcatcctcttatatcaacagagaagaaagattataaaagattgatactaatccaaatatagtttttttaaattgtttccaagcttgtcctcttgctggttcacaattgggtcaagcacaatttttaaaaatatatattattcatctttaggcaaagtttccttacaattcttaaatcaaagggagtaggaagtttgcattacctaagaaaatagaaataaaagaaaaaatgaacatggaacagattactatttcaatatgctgcaggatatttgcaaaaatatttaaaagagagttacttttctaaagcattaatttagaagctaaaaatctgaaaattgaattgataaataatggtttcattttaagaaagatcttaaaatgttatatgagaaaattaggtcatatcactttttttttttaacattgttagtcttcaggatttttggcataatttatatgtgtaaatttatgtttttgtcttatattaatattttagggctctgtgtttcatttctttcattttactgctttccttgatctcattacttatgattaattagaatttttcaaaacctaacctggcacaaataaataccaatgaaagaaataagaaaatattggcccttctatcacaattaatgtagcatattaataatatataatattacaatttacaatagtttctaaatataaatttcctcatatttttctcacgaaaacctgtgagttaaataaggcaggaattattattgtcattttactgataaataaactgatctttcaagaagtaaaattacttgcctaaagttatgcagcttaataacttacgaataaaacatttgtttacaatatatacacagaaacacaaacacacacacacacacacacacacacacccatccccaggaactgccgatttctagcataaatctactgtaactcagaactgaattaataattatctagtttgctgataagttgacattttgacaaatgtgtctcagtataagaggaaaccatacaaagatgaatgtatttacaagtttatttgaatcataatacgaatgggcttaacttccaattctttattcaattggtccatattttatcaattttatttaaacaaataaatgggtacgattctattgctttcaatagataaaactgaatcagactgatggtatcaataattatgttaaacctatcaaagtatttgagggctttgtggtagaagttaaatgtgataatccacggaagcacttagcaagtgcctggtatacagtaagtgctccacaattatgtgagtaacatgctgctttataactaatcacaaagaagtgatctggcactatgaataagatatatcttgactttcataattttagattactggataatctcctgaccaatgcagttggattatttccaacctcccacatacaatgtttttcttgaataattcagtgggaaataaaggagataaatgaagtctcagaaaatcagttgcagcttcaacctcattttgacatttccttctaagtacttccatccacacaagtgaaatgctgttgctgcccccagagacaccgctgatgagcccatgcttgtcacctaattcaggaattgcccttatgttgattggcctatggcccatagtgcgaccacacataaaagatctgcacagacaggaatagtggtaataaacaaaaacaatcagaggctctcctacaaattctaattagagataaaggagtcagtaagtagtacaaagaaaagcacaaaaatcacatatggagaaaagaggcaaactgagtaaagttactcagcagtagactagtagaacagtgattcacaaactctgccatggatccccgtcaagcttccaagtgctaaacttcattctggtgtctactagacattgctatcatgaggttcttgttctctcttgagctcttaatcatgtagctattttacaaaaactatggttactgccttctttacatctttgtcaatccttcaaaagcatttccattatttaagtaatgtaagtgaactctcaacaaaacagtctactaactccagggtactttttgatacatatacctgctgggttatatagtcattgcctgttctgagtttgagaagacggttaagacaataatcacatcacgcatgagatacattctagtatattttatacaacaggttagcaaatacttctgttaatggcagggagactgttactttagtaaataacctgagcttattgataagggaaacttgatagcaattggagaattagaattagaattagaatctctaattctccaactggtaaatgactcctctaaatagtttattcaagatgaacattggctttacaagaaatcttcacagccaataaagtagacactagctgtggtttataaaagctgaaaacactattaaatatttcagttctctctgatagtgttatatttgactctacttagccaaacatgtcaatttcataagaaatctataaaatgttattgttaaatgggaatcttatcaatgaccggtgcatttttaatttcaatatgatagcagaaggcaaccaatataagtcatatgaaaagacatatttggattttttttttttttttgctacaaggcaagggtcatctgaaacatttcccatttcatattttgacaatttatccttcattgtttaacataaagccttctagttttccttgtttcataaaatttgaacaatcatgaggtggtagtagcccatttatctcatggtaaatttcaaatgaacttacacatggtttagatgggtttaaagtggcagctgtaatttttgttgggtatatgcagctgtctgtaatgattctggtcatacattttcattcaccttattgtctgaatattttctaaaggaaaataggtgtgtatgtatttgcttggcccaactttgatatgtcttgctggctttcatcacctttggaagaaattgcatttcccagtaagctgttccacagtggaatgataagtgatgaccatcctgtggattttcacagctgtacaaaagacattcaggtgcacttgtcttttgaatcagaacccagttagcccctcgcacatttacaaaattgcttttgggagagtcaaacctggatgacttccaagctagttaaaaataattctgaagaaaagtgcagtgctggttcttggcggtagaaatgtgagttatgttcagctgcagtagattcctttcaggcagttctgatacccatttcaacttccaaatttctggcagacgttatcttgtactttcagcttttttgtgataaacatattgaaaattcagtcaaacagctttttatcatttcaaaacttgagctcaaatttaatcctgctgccctgatgaagcctgggaagctgctagggcattttcattatatccagactggactgcagaactccttgccattcttcaggactctgacagcatcattcatttagaacaatgtgatcgatccagaagaagccagcagcaacaaactctgggtactcatacggaagagcatatcctatctagttgaaaaatgtttccgtcttcattcttagcctagagataaaatatcccatcatttggactttagatcctagaagatcttacagattttcctacagtatattaacagtgtttacatttaaatctcaatcgttagctacagatggataatctccaaccaacaatgttagagttgtctatcattaatacatttcctatttgtaaaaatgtggattgctaactgaacattttgtttcttataaagatttcaggtattatatagaagtaacctactaatctttgatatatgtaggaatagaatactcattagtgttttaggactaacctaagaaaattacgagttcctaagctggccaacactcaagattagaactgatataaatgaatctgaaagttaaagaacaatggagttgaaaaaagatttagaaattatctcatgtaacgattcctgatctaggttcttcaggcactcaaaaataaatggataagcaagtactagtggttcatgaactattttcaatacttataaaattatcatagaaactgtaactaaagagaatgcacaggttaactgaattgtcaattttagcagcatttgattggaattatatcacctctgtggcaaagcttggcatttcttcttattggccaattaactttctatgtaataagatttgttgttgctgctgggaacagggcttgagttttcactgctagagcctcgttagtaagataaaggacttaaagtacctggtaaaaggcaagctgcacagtttaagagaagtttcttgaccttgaattgttgtcctcaacaacaggcagggtacctaagttacacagagggaagacttattttcccataaaacagggtacccttacctaagacaacccaataaagtgtgatgggaaataggacctcacacaggaggagaaagcaaatctaaggtgtaaagtatcggtgggatctagtctgcttctctccattcctcattctagctgtgcatccttttcccactttttcttttcttgaaactactcatgtaaggagccagagcagggatccagggtgacagtgaagaaaccctaggctacagaagcctgaatcaagaccactgtgtgagcttccagccatagctcaatccaggcactcagatcaggaacaagcctgttggtgctttggccattggcattcactgaggagaacagggttctatgcagacatttgattgcctgctgatttctaacagggactgtcctctgttcatggctttccaagagccagcctttatgggagcctctcagaggtgacaaggtcagtatgggcccctcctcacagcactgatgcctcacagatggcatcagctcgtaccacaggcaaccacatgagcttacttgttgaggaatgagcttggtattggtggatggcacgtgatatttgcacacatttattcaacaaatacttattgaacacctgttatatgcttgctaggtactgagatgaaacccggaaccatacattgactctatctttatggggtttacattctagcaggaaaaatatattaagtgtacagttaccaaaaattaccaacaattatgataagtacagtgaaatagaaatacacagtgttatgagacattatagcaggaggatctaatctactctggagcatcagaaacggcttctcagaggaagtagcttgtgaagtttgacaagggtggccatataacctatcatccaaactgaatcacttcagagaaggtaccactttagaaagagggtgccattaacaagtacccacaggataacaggcaccaagaaggatttggttacctgagatatgacctgaaggaataaaatcaggaagaccaagaggaatctgaaaatacccgaaatctgcttctcatggctgggactgttgttttgaactgatcctggcagacttttggcccactgagtgaggactgttgttctatgcttaaggaatgaactattcattggttcaagtctaaaatgttagaactttggctcatattaaattacttgaccattcttagaaggaggccaacacttgacatatcagaacattcctctaagatcacaaggctatcaagaattcaattagaatgaaggtcctttattggcccagttccccagaaatgcattccagaagatatattttgagttgatacatgtaagactctactattactgctcaatgagtgagaaaagagatctagaggtatctgaattgttgactagaaagcatccaccagaacatgtgcaatgaataaacaagattttcctatataaagaaaggttgagagcagataaaattgttcgcttgcaactttacattgtgggtgaacagggagctttcaaaggagctgcagacttgtattaccactgaaggtaattcaactgtcgaccacacgccaggaaagaacctcttaaacagataataagtattcctgataactgccaaagggccttgatatttcagcaagctgcaaaagaaaataaatttaaaaactcacatcttactcaggtaatgcattaactccagatcactacagagaacatttcaattcccacttctataaatatacacctgttcttcatttgtgaggcacccctaacaacacacatacccacctctatgcacagagaggatcttataaacattattcttgctttccttgtacttgggtttgatttctctatttttcagcaagctattagatgtcattaatactccctataatttcaatagtttgttcttttggactaggttcaggcattgaagttaatgtcaaattgacattttttagcctaaacatacttttcccatctttgaataagttaagaataagcattaaaaagtgtcaaaaataaatgaactcgacatttagcttacatatagtaaaaaggtatatcaattatttgctggtaagtgagcacacagggcagagctgataaacatctaactttaagtttgcttctctgctttttttggcaaggaaagagaaaatctttatttgactacagttactttggttttcaacttttaaactagttttttgatatgccaaattcaacacatctttagaccttattaactacctttctgtttgcaactgtatctaacatgttaaattacaaccaggtgcagtaaaaccttaaaaaaatttacctctgtggcccccataatagaaaagaatatttactgactcttctgaacattggaataatgacaacaagcaaacagaattaatataaaatagaaacttctgtgtacttactggtcaagtcagcttaaaattaagctcttgcactcttaacccttaacccttaacaaccctgcgtagcaaacactagtctctactgcaaggctctatctaaaccagtggctgtcagttttggtaagtttaagcattggatggaatgtttattgaaaaaccacattcccaggacccacacccttaaggtctgaaacagccctcaggaatctgcactttcatctgtttaggtgactttgaaatgatagttcaggtactggactttttttttttttttttttttttgagacagagttttgctcttgttgtccaggctggagtgcaatggcacaatcttggctcactgcaacctccgcctcccaggttcaagtgattctcctgtctcagcctcctgagtagctgggattacaggcacatgttaccacacctgactaatttatgtatttttagtagagacaggttttcatcatattggtcagggtggtcttgaactcctgacctcagatgatccagtcacctcggcctcccaaagtgctgggattacaggcataagccaccgcacctgggctcaggtaatggactttgagtatcactgactgctatggttttaatatgtctccaaaactcatgcattagaaacttaaccccgaatgcaacagtgttgggaggtggggcatactgggaggtatttaggttatgaaggtggaactctcataaaggaattagtgcctctttataacgggcctctggaagtggtttctctcttttttgctcttctgccatgttgagtacataacattcatgcccttccactgccactgagtgaggcaagaagcccatcaccagacaccagacgccggcaccttgatcttggacgtgccagtccccagagctgtgagaaataattttctgttcatataaattacccagtttataatattttgtcacagcagcacaaaacagaccaggatcctgacctacattatttcaagtaggaaagataattgtattcttcttaatacttacatctagacacatgctaagtgctatatattatgttaaatcatttaatcttcacaaagatgccatttatgaaatattattgattacattttacagattcagagagtttaataaactgttcaacacattataaacatcaggttccaagtaagaggtgtcagttagattctaaagtcttccctttcctttccaatgctgtatctccgtatatcaaagcaacataattaattgctattttttaaaaaaaattgttcaagcacaaacttacattacaaaacctttcagattcttcagatttaataaataaaatcattcctttcaccaagctctcctgtatcagtgtaatagcagctcagactcttgcccagtggtcaacttctcagctaatcaaagatcttggtttaatgtaggccaaaccaggtcccctgtgtccttatatatccttttgcacttttcaggctttttagatacgttatctcattttattcttctaacggcactaatagatcacacaaaatagatgccatctttgtctgttaataccaaaaatcacaacagggttctcactttgctcctaattcagaagcatcatcatctcagccctttaactctcatatgcagaatttatttgagctgctcccctgccctgtgagcttggcagctttgtgtccctgtgtaacctcatgactgcagccttcatcccagggtgccaacctactcagccaaagatgacattaacagaggatctggctgaaatgccttgacattatttttctctgggaaaggtgtgtaattgcagaaaaactgctccccaattattcaaatttaaacattttatctgatggaaatgatatcatttacatattttgtttcccagtttaaaattgtggtttcatatcttttgtgcttgtatatctgagagttatattaaatttaaaatagctgagtgtattggctcactcctgtaatctcagcagtttgaaaggccaaggcaggaagatcacttgaggccaggattttgagaccagcctggtcaaaatgacaaaaccccatctctactaaaaatacaaaaaattattcaggcgtggtggcgcatgcctgtaatctcagctgcttgtgaggctgaagcactggaatgacttgaacctgggaagcagaggttgcagtgagccgagatagtacccctacactccagcctgagtgacagagtgagactctgtctcaaaaaaaaaaaagaaaaaaaaattacaatggctagccctggatccatttggtaacaatctcattctaatgtatatctttacacagggcaaattttaccagaagccttttaacgataacattttacgaattcaaaagagcctagatctggcaagtgcttggctggcagaagtgaaatgtatggtgtgttcaagaagcatcaattatggctgactgactggaccctgagttaaaagtcagcatggagagagaaaaaaataaatcatcctacgcctttcaaatacacattgtaatgtcccttctacttccacttgacaaatctataaggaaatataggttggggagcatgtgtatgtgtccaaatgtacttcgcaaacaaaaaaaaacagataaattattacatcattaattaacagtggtatttaccaaaacacataacatcttatgtcaatttaaagacctgttggtctattgaggagtagtttgtaactagctaagttcattgataagctaaaatcaaatgtcataggatcctggtcttctttgaaagattgcaatagaaatacaatgtgatgggatttttatatgtttattataacccagatgtacagtaaatcagagcattgctgaatttaaattataccatcacatcctcaacaacgatataaatattgaaggaacagagagataagcaagctatatgaccaatatctaacaataaataggtattaggcttttactttaaaaattaagggcaaattatttaaaatattagaaaaggtagcaagatacttgataaagaatagtgtgaactgacgtctgtcttccacatccctgcccattaccattcccagtagctaaatcaactttagtcaaggttaactaactcctttatatggccacacaggagtcccttggctatacaatttgcactttaatcctctggaagttgcaagaggccaaatgaaatcctcacattcagccagagggaggagagaagaaagccataattcagacctccctgtaatatattaagagaaatctgtcttttttttcagtgtcattgccttggaaggtaaccccttcttgaccctagcatttaaaagctaggttggtgcatgtccaacatcagggtcacagccatttttctgctactcagttcatcttggaactgaaagatagtttcttcccgccatcaatcattacccaaggtaagtgtcacagtatatgggtgcataaggtaaaaacagatgaatattaattggttcattttatagcaccaagtacaatgaacaaaaggcctggagctcagagttggaaactgaaagtttccaggaagaatcaaaatataccaaattctcaatagctatttccttatcttctgacgtgtgctaaattgtactaccaaatgtcaaatatgctgagtagccttggaaacaggctgcaattgtgaactgttagtctaccagagagtcaggatccctagctccatcaccagtatgagcaggataatgggcagatcattctgtttgctttcatctgttaaacataggtagtaacacctagtatatttacagcacagatacattagaataattcagtataaaaagtgtaaaatcagctggaaaaagttaaaagtgctatttaattataatgttatgatgacaaagaatgtgacccataacatccccaaagaaatttaggttaaatttaatatgtggactgtttactggtaaacatggtagaatcatgaataagccattattctatggaaaacaatgcaaaaatttatattaacttcttttactcaaagggtactctttctgtcatccactcaaatagtactgtctagccagaaatgagtttatttttaacactatacaggaaatagcacctcacatatatgtcagtttcagtcatgtggtcatgattaatagtcatcatctgataggcagggtggaatggtgatgtgaacatgggatttcgggttatccctggatccacatctgtattctggtgctttctagttgtgtgacattggggaaccttccactacttgaccttcagtttctattgcctgtgattgtaataaaaatgcttctcacagggttgctgtaaagattaaataagaaactggatgtaaaagtgatttgtaaactgtaaattgtttataaatattgttattatttctatatggatatagagggctcataaatatgccgtctatttctggaaatttaaataacttgtgtaagtttttgtctccaacctaatttcccagatatctttaaatacttctcacaatgaatttccattctactcactgaaagtgaagtcatcgtcccccatcttgtgcattcttgcctttttgcttagtttgcatgcaacactctctcttcctatatctacatgaaaaattcttgatgatcttctctatccatcctttaagtcccaactcaaatgccacttcctctctgaagccctcgctgattattagtttccatatattaatctccatatattgatctcttttctaatccttttgttgcttgaactctcaacgcacttctttttgctgccactcatttaccatttaccatatacacattctttttcacagttatcttttcaaacaaagtttatacatcttatctctaccattagaatacaaggtccttgagattaaagaacatgagttagacctttctagtcccaacaaatctagggaggtgtcttataagcagtagtaaatgtgtgtgatgactgatataaatgaagtaaatgaaaatgtaatgactaatataaaaattggcacaaacatctattccatgcaacaggaagatgttttcaaaaataatattacattccaaaatgattttccagtggcaatttgcatagtgtgccatttcagtgcacatgtttaacagaattagcagaagagagactgatataagacaacccattttaggatttagaaggctaccacagattaaaaactaaaccaatttctgttcacaggggagaaacatttaggaagccgcaatctacagtaactttgggaggaatctgtccattattgactaaattaaaacatgagtcattgaagaaaaagaataaactcaagcaactggctaagtaataatgaaaaataaaataataaaacttggctgaaaaaagataattacagtccacatttcaaataagaaattataaaataaaaacaaataaaacaaattaccttacataagcaagtgatccccatctgccagctcatttgctatgataatgagaacttgttgcattctagttacctaaattatcatatctacttccatctacatataaatatacatctcaatgtaatggaaaagaaatggtttattcaattactggatttccggagctaacaattgttacaatttagttaagtgtcagacaccatgctaggcatctttacaaacaatttatttttaatcctttcaatagtaatcttttgaactccttaactgcttatctcctttatcattaatttaacaataattcctataatattttatgatgtctcttctattagttgctagaactactattctgctctctttctgccatttgttcattcatttattcattatggctaaatacttatttattggctattacatgcaaagtaccatttttagctctaaacaaagagtagtggaaaaagtccattacccaatggagccttcatgttgttactcaattctgtgcactgtgtagtcaaactagattgttagtttcttggaagctatttatttaatttgatttctttgtatcctctggtgtctagtacagtaagtacttaattcaaattggcatgcaatacatatatgttacttcattttaacatgttttaaatattattggattaaatgacatttattcctctactttaaacattataataacactacatcaaattctaattatcaagggaggactcagaggaaagtctaataagccattattcatcacactacatgtacttcctggtaccccaaaagcttgtccccattgaaacacaattattaatgcagattgccaggttgggtttctgttctagttggaacaacatctgtgtttgtaatggccataatgtagctaactgtgaatttttaccatgattttcagtaacagaataaacattctcttgacatttctacacgacaagactatgaaggctatttttaaagtattttgataagatttggcatttgaaaatacgaactcaatttaatatgaaatggacgaatttcacttacaattatagttttaatctgagctgctataacaaaagtagctcaaactgggtgacttaaaccacaaacatttacttctcacagtacaggatgctgaagggtccaaggtcaaggtgccagcagatttcacatctggtgaaggcccacttccaggttcacaggtggcactctttttactgtgccattgcatggcagcagtgacaagggagacctctggggtctcttttgtaagagacccttttgtaaagggactcttttgtaagggaatcacattcatgagggtttcactctcatgatcgaatcacctactaaaggtctcacctgaatatacattgagggttaggatttccacaaatgaattgggaaggcggaataaacatttagtgcactacaacagtttatatgcccactgttctcttcacttttctcagccagacagaagctagggtaatatttttaattcctggtgtccataacgtcagcaattacccgatgttgttttcttcatcacgctttgaaaggcagcacagcataggttaaatgcatggtttttgagccatggtttcagataaaaaataggttcctctctttgggacttttatgagacttattttatacaaacacatataaacatgggtatgttgttatataaatcttgggcataagtgcatgagtatgggagcacaaaaaaaatttggcttagccacattaccgttaaagaaagttggatgtggatcgacacaaataacatgaaggctgggagctgggaagggaaggcatgtttgcagagtaaagaaagatgaagccattctgttctcaaaaatcaaacatgtaaactgtttacagttatatttaatcccccaaaacaacatagttattaatctgtatctgtttatatcacacataaagaaaccagaaacagaaagttttactaatgtactcaagttcatatgatgatttaattcaggatttgacaatgagtacaaagctagatggccaaccaaggacgctcactaattgcagtatgaggaaaataagagcccttctgcagagtttccagctcaaaagcttttaagagacaagccctttgtatgtgtataaagatgtgtgtttgcattcatgtgcctgcgtgtgtgtgaaataaaaatttcatacttgagagaactatggaaaatagcacagtaactcaacagagccattgacatttgatattcttccttccctcccttcctctctccctctcatcctccatctcttctcccttctttctttctttatcactaagctgattagataaaacagaccatttcaaacctctgctttaggatgcgttgcaaatatgttagtttgcatatataaaactaatatataaaagtaaatataaaaatatatttataaatatattcataaatacataatataaaagtaaatattaaaatcctacaacttccaccattgtgaatgcactaaaacacattcaaagaattaaaaatttggaggcttggaggtgtaagattagagacttgtaatctttatccttcaactatcacacatgtttgactatcatatttgagttgtcttcatccctcaactattattattttctgttcattaaacctcttaccataattccagtttaataatccatgcaatggtttgaatgtgggggaaaataatattgtttggtcagtatcatcagtatattcaagcaaaaaattaaaaaaaaaaacaagtatttctatttcaaaataaatatcttatttaaaataagtttcgttttccggctgggtgcggtggctcatggaacctgtaatcccagcactttgggaggccgaggcaagtggatcatgaggtcaggagttcgagaccagcctggccaacatagtgaaatcctgcctctactaaaaatacaaaaaattagccatgcatggtggcatacgcctgtaatcccagctacttgggaggctgaggcaggagaatcgcttgaaccggggaggcggaggttgcagtgagccaagatcacaccattgcactccagcccaggcgacagtgcaagactctgtctaaaaaaaacaaaaacaacaacaacaacaataacaacaatcatttttcattggatttattcttgattgggattattagcataaaagtatctgagaaattgcacataactcaatttctaggtctttatctctctcatcctgaaaggcttccttaggccaactttgcctacttaaatgctttccttatttcaagaccctgttcattcagtggctttcctgaagtctctctgtcatcccaaatacactgcttggagcaacagaaaaggtaaagctgagagagccatcaactatgcccacagtagccctcagacgtgtacaaatacacacagatacatgtttaaagaacaaattacaaaactggtcaatcattaaactcagggtaacacattttcagcctgcacaagatacctagatgtttggctcatgcctttgctgtagatctgtccagcaagtggtctgatttttggatcagaacatgcaatttctgtataactgacacacagatatatatattgtctttcaactttttttttttaaccacatcttgaaccttggaggagttacaatgggaaacttcattttcgaaactcccacaagtaaaatagtgcaaaattcatataaaaccagttacaacatgtctctttcagggtacctccctccctccaatgtaagctacaaatcagccacattaacaaaggtcgcgctgcatcttccagttaatttgaactctttccctatttgcttccatctgtgagcaaacaaaacatctccagtccttaaggggcgcctccccagcattagctgctacttttatgccatactgttggtatggtagctaggaaaaaaatgcagtgcctgaaacaggtatttgcattcctatctacatcaaagggctgaatttttctttcatgggacttagtgttttccagaacacaaaagatccatgcttagccacaatattacattttgcatttataaaccactcttcccagtttctctgagatctcctgcatgtccaaagacactcaagcacttcaccaaagagattctctgttcctgttatcaagtattttaatacaagataacaattacagtttagagaaatgctagaaaaatgcacggaaagctcccaggtgccacttaactctccttccttgctgcattccctctcccaccccatcactgaaacctgagccagccaattagatgaacagcttgtcactcctagatgcagtgcaatgtctgcatcttactgcagctgttaggactgacaattcaattccagtctgcaatcctacaacaaagactctctcgtctggttcctgggagtcagagattctccttgttcatctttgaacctcaaaaatatggatttatcctggagcactcagaaggcttaaatctgtataaatagatagaaacatggaaattgtgaccctagtttagccactagatgactcagctggagtggactcttcggcttccaaggacagctcacatagctgctctctcagaatataccttaaattcccaatcacagagcagggtgccctaagaaccattcaatttccctaggcctgtgaacagcagatttttgccttggcaggttggataatctacaacactctttcatatgtctgtcctgttataaaatcagctctagtttgtactgggctctagaaagcattagagctaagaacaggatcctgaagcatgtatttcagagataactaccctttactaacaacaaatatgtagcatacagattcctctgaggtgcagtaaccacttttgtatttatagttattaaaagaagggaaaacaagaaatcaagggccacctcatttctcatataatgtgttctcctttgtgcctgacagacagacgaggactacatgaagcatgaatcctcaggatacccagtcactaattttttaaagtggaatgagtcctaagtgtcaaggggttttaagtaaagtgaaaattaaagcagttaaaaggaagttatacttaccacttgctatttactggaccttgtggtatgttttttttcatacattattttattttacttcataaaacccaattaattttttcctcataaacatttgggatagatatttttactcatattttacaggtagagaaagttgatatacattaatatgggtgttagtatctgagagaggttaaacaacttcccgaaactagtgagtagcagagctgaaattaaaaacctcaactactacacaccagaattatttaacagagttgaattgtgatttttgcatttctcgggaaatgtcccttggtgaaaactctgagaagagaaaaatgtctgaatttcttctgcaggaggtctctaggctcccactgctctttaaaaatggtgatcataatataagggatatacgtccaatgaatctagtattccatagactctatcaatcttttgcccaatctttgctattcttcaaaattttctgaagctataatttgggcatctccctatcatttactgcattatttctaggctagatgttagtggcaaaataattaaaaaatatggaaccccaaaattgagggtcttcacagcaaaaggaggtgataaacatacaattccccataatacaattaattctgatatatcagcactatgagcagagtactaagagatcataaaggaagaagtaatagcaaattgaaaacaatctaaatcagcaataaaatattggtcaggttaattatgatatatccacacaatggaataccacatagccattaaaatcatattgcagcagaatatttaatgatttggggatacgtttcatatacattgtttagtagacaagcaggctgtaaaataaaagcaatataatttcatttaaaaatatattggaagagtgagaacactttagcaaatgttaataatggttatattaatataaaaaggttaccattattgcttctgctttttgcttttttatgttttgtatagtgaatatgcttttcttttgtaattagaaaaacattcaatacagtttaaaactcaaatcatgttaacaaagacttaacaacaacaaaaatcaatttgaaattctttcgaattggggaaagtaaaattcctaacacacttaagatttatttccacagatggcctcatgagctacaaatacctcactcataaatcgtcttgccttgaatttccactcagtgttctgatatcatgccagatgtgggatcttgccttggtccaactcctcctttgtaattttaaaggcctctcacacttgggatgctgagctagagtcattctcctgcttggtagcttttgagagtgaacagatcacttcgctgtgtattgtcattcagttagtagatgtttctggctgcttcttcaacccatacaatatacctttcctaccaagaaatgtgtgacttctattctctcagccttggtgtaaatccctgaaagtgttaaggagaaaaaaagagcaagaatcctccaagatctataattgcacaggccccaggaaagaagcataaagaaaacagtaactaaaaacaaatgcagaataagacctgaaatacaatatttgaccacagtctaaaagtaaaagcttagaaactggtcaaggatgtcatgtgtcttgtcggttttgaagaactattattcaaagctttccatttaattatggccaaaatgcccaggtctgtttttcttcaaaatccagtgttctgatgactagctacattacccatgcatcttgagatatgctactgggaaaagaggaagaacagtttaaattattgttatgtggaaagtcgggattattaacaaccaacgaatctaggaggaaagccaaaatctgtgaagaaggctttcaatgcctctgggccagctcatctgaattcaagaactggagaaagattttcacttataaagttacccagagggcctggggaagaggtgagtgtcttccagcagctgagcatagatcagtacctgagatcatttacaacctgcatggctgtggtcagaccctaatgcagcctgggctgcagacacaacgtggtcagggtaccaacaggagactcagtgaaaaaggagactgtttctggagaggcctctgaatgatcagctgcataccaaccactgtgttttcgggtttgtttgtgtgcgtgtgtgtgtttcctagtgtgcactgaaaaacatcctaatttatacatgctcatatatcaccagcttgttaattcaacactaaagcaaaaagatgacaggaatacaagttcttgcttcattttttctgttttctctctaatttgtttggtagatgaatggagcatgcacaacatttcagatgtttactcaaatacaagatccattgtgatgatctttattacttttgtaatactaaaacccacagttgtgcttaatcataagatcctctagggtgacactctctaaattaaactaccaagaatttatattttaagtcaagctgtctcctgggtcttaatagtatctgatccagaaaagaaaaaatgagtgttaatagcagggcatacagtactatataaggtgctttaatcatcctaatgaaggaaatgaagatgatgaaatattcctgggaaactttttcatatgcaatgaagcctgtgatgagaaggaacctttagaaatagttttattatttgggtaaatatttctagacttatattcccttattgatatactcaatatcagaaacttagatttattattagagatttttaatccatgattcaaaattgtaataattattttagttgtagctctttatataatgaaattaaactacctgatgcatattaatgaataaataaatgcacttagtcaatctgactagaaaaagatattaatcacgttgtatggctttatatggtaaaacattagctggctagctaaatattacatttttaacttggctgggagattatatataatatacaaaaaagaaaccaaaactatctagacagctaaagaagcaaacaatacacatgaacactattttaaaattgaggtaattaagaaaaaaagaatacatatgtgtgtgtgtgatgaggtattactcatccattcattcatttattaaaaaatatttattgggcaacctgcttgggtcccctttcatgccgtggaagctttcttcttttgctcttcacaataaatcttgctgctgctcactaaacaaaaaacaaacaaataaacaaaaaaactgttgaacacctgatacagggtaggcacgattctaggtggtaggattagaatagtgagcaaaaaagtcaaagtaactgcctttgtggagcttgcttcctgattatcaggttacgtaataattatccacacttggatttgcacattcagatttagattactgtaaatacaaagccaccatgtgtgtgaattagagtaatagaaagaaaatcagaaaatctggttttcaatattatctcgatgtgaccttggccttgtcatttaatctctgaaaaaccttttttttttaacctattaaatgtgttggttggtattatcaaaaataaagttctgtaattttgtgtttcctgatagaagaaaaatatgtttgggctcatgtttatagtgtttatatgtggaaagttttcaacaacttaaaaaaaaaaacccacaaaactctaattgcaatcaacagcaaactgagacaggtattgcagtacttaagtaaagtgatgggtagctcttggcaaagttcatgagaaaaatcaccacactgattacaggtattgtaaagggttgtcagaaacagcaagtaaattgcagagaaagagatccacaaatcctttccttaaaatcactactattatcacggtgttaactgggtaatttttccagcacaaggggcaaatgcatttttaaaaaacataatcagttaaatggtacacatagaaaatgcccttcttacaacagccaatctgaggttattctattaaataaaataagcaaaaacacaaaaataaaagcccacattacatataactacaaaagttatctgtttagaagatagactttattttttcagctttgtaaaacagacttaagaacagaatacagaaatctcagaaatcaagtctcatacagacctaagcaaacctcattaatattcaagataatatttgtaaaaataaactttgaattaatcatgtttgcattatctggtattttcattaaagaacaagagagcatggagttgactataaaatgaaatttgtttctagttgcttatgatttaaacaaaccagcgtcagattaaagagcttttactctcagtaccatagaagctttgtcttggggtgtcctgggcacagtttatgatctagagtcagtgtggatcatatttcccataaattacaatccatttgaggaaactgcttctttaacactgtgtcactgcttgtatacctagcgaggacctgttaatgtgattattctttgtactcttttactcgatcccttaacaacttttatttgtgctgtgattcatgttttcaaagtgctttgatttccattacgtggtttaatcctcaaacacttccttgaagtagataaggcagccatcaagttctctgagcctcagtttccttatttattatatggaaataatagtaataaccttagctgcgcgtggtggcgcccgcctgcaatcccagctacttggaggctgaggcacacataccttatcataaggtttttgtgaagattaaatgagataataatgataaggaggatgatagttacatttcttggtcatttgctatgtgctaaaaactattttaattgtgctacactgttaacttatttaattcttcattgtgaccctaaaaaacaggtgctattatttcctcattttatatttgagaaaactgagtcacagaaaggcaaaacaatttgcccaacgttacaaaaaagtgaccgatctagttaaataatgacagaagccacctagaattatattaacacttgaaataatattacttccctccattagtaaacacaatttcacatcaactaatgatttctacaagactccaatatagtcattttaaatccctaatggaaataagggtaacaaaaattattcagcatacattctatctattctaaataagttgctttgatcctgtacttaaagaaaaataaacaagtaactgaatcttaattcatcaatatcctatatatagtcataaatatcatttgttcaatttaaaagaaattagaatatggccagaaagagtcaggcaagaggactaaataaataagaagtattctaagtattttaaaatgccttttggagctcatggatttggaaggggttagaaaaagagagctgacatttgggaacctttataaaaaaaggtcttaaaaaaaatctatgaagcaagaattatcaagtatcttttaaaagatattgtttgtcaaaaacccttatacttaaagagatataattccttattggattatatttaattttttttccaaaagcaaaactgctacttatgaagtcatctgttaaacaatttatattttattctaagcaaaattccagttacaacatacatgctttgtgaagacacagtcaatgtgttaacactaaagtatcaatgcctaggctataattagtattcaataaatgcttcaattatgaaatatggaaacaagctcctgctagtctatcaacagttataaaatgcatcattacacacacacacacctacacatccttccgtatggctaaaaacaaattttaagttgtttttcttctgccaaaaactatcaaaaaatagatcatgatgatccccaaaagatcaatcactctttatattttaaaaatacatcttaaaaaaacctaacacctagatagtgattttcaagtacagggtacacatattgattaacataatgggaaaattaaagcatttataaagtgctctaaggactaatctactaagaagatttatgtttttaattaaacattttaccatggcaatatataagaagaagatcttggctccactgtcagacttaataaagctagcattgcatgaatcagaagaggagacaggggttttgaatagagaaaggtgggtagatgaggggaaagaatattgagttgggctgaaatcctcatcctgttaacaagtccctgaattactgtcagcgttattgttaagccacagggtatctctttacaaattagagaaaggttacactttatcaagacccattatttctatctgtggaaaactgtcacaacatacttattatggaaacagaatctgtatcattatttaactcccttaaacttaataatcaacagatcaacaatatccatgatgcaaatagcatactgttagatgtagtgacattgtgcactgtacaaacaagcatgcatgcctgattgtcatgtttgagacagagacttcttcatcttattatagacacttatatgactcataatgtccttctgctactaaaaaagagcctgaaaatttggcctacattgtttcagaaaactgagtcccagtcttctcagcatttccacttatcctaataagttaacttataataaggtaataatttgctttacctacttataagatagtctacttctgaggatgacaaaatttaaggactggctttctgagtttgaattgcacacaaagtattcaattgcttttccctacagatgcagaaaaccatcaaccatgtctatgtgtgtgtatgtgtatgtaaataaatttatggcttgttttcccttccatcttttcttgaaataatgttttgacattagtgtaccttaatacatcaatatgtttttggtttgattatgtttttcctgttactgaatgtcctttttggatatatgttagttcttagaaaggctggctatcacctagtgtctataacgttaagaaaatgcctgcctgttaaatatagagacataaagcaaaacaacagctgagcacttgcatcattgttctggagggcaacactgattacccactttagttctgactccaataatacaacttctatctattaactaaataagcagtattttatttaaatgaagactggtatgttttagaaaagtcatctcaggattatagagctagtgtatttaccaaattatccttttctctgacccaaagagtcttgagtgcatggtttatgacagtttgttgaacacactgtgctggaagtaattattatccattatttttagaagggtctaatatgctactgtgaaacctttttttcccctgcatcaaaagaataatattattttactactagtcatatattaaatttcaaaacttgataaagcattatgatccctctaaaatataatgatttataacttgttttcccctcaattttaagttgcattcttatattctatttcttttaatttctaataatcatattttcattgaaacgatctttgttttgattataaattctctaagaactggatgatctctataattgaattattatttccgaaattaggttgaatagctagagtttattctgtgtccctcaataaggtatacactttacaaagtttttctcatttgatccacagagcattttagtttgggtaaaataattatgctcattttgcagatgcaaagttaaaatctgcatagtaagttgtgcagtttcttaaaagatgagggaagtgtcacaatctgtagagctaggatgtgaacccaggaagcctaacttcagacctggggtcttagccacagtgcaagactatgctaaacggcttcagcaagggagcttttacgcatggtcttctgagggtagttgatatggcaattccaaatgatatgaaaaataatgaatcagtgctttccagctgtcctcaatgatttgctccacctgtcttcaggcctttcttttatccatcagcactcttcaccctctcagcacaaagaacagcctccctcggggactgggtagagttgctatctgacacccaaaattcacaccttgcttctttgcattctccctgacatctctattcatcagctcatctgtctgcttcagagtcacaattctcttcaggtttggtttcgaaagcgaggctcaaaatttctgttgttctctgaggctgtggatccctcacactcacaggatgcctcttttcgcatgacagagatgcctaagttcattatccacaggctgcttctgagtgagagagatttcatcctttctaaagaccttcttgactaaagtagttctctttacctttgtcatcttgcagccactctctcgacagatgaggcacccagcatgttctatttccatagcatttacatattattaatagaagcaggccagtatctaaaggatgacattgaagaagagttttttttcacattttaccacagggctctacaagaagatgatcttgccagtgttctcttgaaacaagtttcctttttctcaactcagagaaatgctttttatgtaacatttgtgaaagattcttatggtctactatttttttaaatttcctattgtcggcctgactggcactgtgaaatgacatcaatattgtcagattcaaccaagagtcattatagccacaataaaataccatgtctccagaaactatttatttaagtataaaaaggaatcaagcataactttaatgagatttctcagactgtgtgtctgcctgaaagaaatgtgttccctctgtccagtcaatgagaggatcagagctctttccagctttctctcattacctgcttgttgactagtgcagccttcaaaaagataaccaaagactccctacatctctcagatgctatgtaatttattgtgatgtaatgtattggtctataattatgtcttcattttttcgtccactttgactacaaaatcttcctttatctttcttgttttcttttttttttttttttttgagacggagtcttgctctgtcgcacaggctggagtgcagtggcgcgatctgggctaactgcaagctccgcctcccgggttcacgccattctcctgcctcagcctcccaagtagctgggactacaggcgcccgccaccacacccagctaatttttttgtatttttagtagagacagggtttcaccgcgttagccaggatggtctggatctcctgaccttgtcatccgcctgcctccgcctcccaaagtgctgggattacaggcgtgagccaccgcgcccggccttcccttatctttcttactgtgattgcatttactctgagacttttagctttatccttgactgtaactcaggcaaattactaattacaatcttctttaaacttctgatattgatttctggctttatttttctaatccatgctgtactctgatttaatagaaatttttaagaaacaccaatgaaattaaagtttggctattactttcacataatacatattattcttcttctataaaaacaaacataacaactcataaaaaatgacaagaaatggaaataaaacatagggatcaaactggaatgacttctaaaaatagctagagttactgatttactataaaaactaaacagaaagtttgcaagtcaaaaataagtttattctgattattcttttgtaagttcgctgttcgaaattttaaatgcacttatattcactaccacataccaggaaacatcttggtaaacagagatttttaaatcagagtcagaaaaaaatgttatccggcagatacagaaataaagtgagggatggagaggttgagttaccttattgagaccttggcaagaccaaaagcaccaatgatctagaatggtggctggtggttctcaaggtatagttaagggataatgtgcattagcatcaccataaatgtttattaaaactgcacaccctagaactcatctctgatctattgtgtcagactaagagtgaaacctggaaacctgcatttcaaagatacttcccaggtgactgtgcaacaaaattagagaatttttcatagctatcaatttatagataagcaatacagaattagaaagtgaaaataaagacgcaacccagtttgtacatttaaaattcttctcatccagttgcatgatttgcattaggcatgccttgttttcgtttggctgttgggataacgggcccagttatcttatatcttgtctatattctgttactgtcagagaaaaggcaaatttaagtcttatttgaaatgtgtgccttcatctgggtcataaaagttaggtgtgacctttaagtacttcatagagtcttaaaaatatgtcagtttcacatatatatgtacgtgaccaatgaacttaatatatatcacctttcaggctgaacataaaagcacatgtactttcttagtgtaaaatgaggtagaaaggtaaatattttaaaacataatttgttccccatatttttacatgcatgtgcctatacatatgaaaaaaattgtgtgttttcttcctagaataaagaaaaaaactaagtaaaaaggaaagaagtcatcaactgaatgaagggagagaaaataaattcctgggaatgtactgttcccaactcaatgttctcagccaacaattgagaatcataattactattaggataaaaatacttcaggccaggcctgaagttagtgatcagctgctaagaggaatagtagttatcaacatcatgagaataacagtagtaaccaagcaaagcaatgcggtctgtacttttcactgaatgaaacatcaggtatttagatcatgttttctttctataattttgcacttgttttcaattacagataattatgtacttacaatattgttttatatgttttatggaaggaaagaactcctcctagctttaaagtaaaatagagcaaaactgacttgaccccgattttcctttaaatccgtatctcaaagtattttaaatctgaagtaaagactacttgtgtcaatgcaacatatatttttgtagacctttgttccttgttgtccaccacttctatgtactatatccctctcacatctgcttttatatctatagcatccggcttgcttaagatccatgatatctcaaattaaactaagaaatagaggcagtgaagctgaatgtacaaaacagaaagtttgatcttagtagactttcttccagtacactgtgttctgttttgtgattcacacccaatgatttgtgtattgtaacaactagctcagattccaatgtggccaatactttcaaaccagacactattcctaaccaaaaatatggcaagtatcccaagaacagaattattaatgtaactgtcttgtcattcactgactgaaatatctaatgaggaaaaggcttctattaaatatactataaataagcatttaacatttggagctttaaatgacacaacagggaaacatttgtgtagactgaaatctatttttattgttgattgaatcagcagtttgtaaggctgccaggcaatggatcagtacacttatagaaaaattaaatttaattgtatttattcactgatgaatagaaaccaacccaagacaagtaaaaattgggaaatattttttttattgctcacatcatagcctgagccaaaactgtgttaaattatttaatttgtgtttctcttatattatagcaaatgggagaaaacaaaaaacaaccttcctaaggagtgctgcgtttgggatggcaaataagcattaagtgattaatgcccaatagtgaccaataaataatttagttatctctgcagactttctgttttcttgtaatattttgtttctttagatacataatacacttgcccttaataatgaaaaagtaaatacaaccataatttattatttttattgggctaccagaagtaactgttgtataaggacaccaatgtgggtggataattggcatgatcttccaaatttgcagattttagagaagattaatatttgataatacagtcttaataatggtcgaccattgaaaatgaggttaaaagcaatcaattttcaaaaagtttactcaatggtttataaagatatttctaagaaattgaacttaactagcaaagattatagttttaatctgtacgtaaaatgtattttttaaatcttctaactacctaaaaactctatttttttcacattcgtatattagcatgtatatgtgtgggaggtatagttctgagatgtttatgtttcatagttcatttgccttaactattagaagttattcttaaagtacttgaagccagaaggtctaaaccaggggtgattttgccccccaagggacatttgacaacatgtaaagacaattttggttgtcacaactaagggagggctattggcatccagtgagtagacgccaaggatactactaaccatcctataagacaaaggacaggcccctatgtcaaagaattctgaggccccacatgtctaccatgccaatcttcagaaaccccgtcctaaccttttaaatttgaccttattttcaagcaaatttcttagttcagaggaagcactcttttaaggtagcaacagaatggtgcatgctagtagtgcctctcttgcccagtgctgctggattggtactgaatttaaactagttaatgtgaatccaggaaaaacaagggcaggtcatcatttcaagataaaatgactaacatgaaactttaatagccctcagtgttgcaccgctttctttgtctttctatgacaataaacatcatatttatgattactttgtttttgttaggtgtgaagatagaattctaatgaaccatcaaatatcataaaaaggcagtgagaacaagcacctggctcaaaggtccactgcctgctcatataaggtcctaaattcactctggtagtctatataaaacaaatgagctgtagaaaaatgctttttctggcagtgtacctatgtaccttaaaacatttctcactaggaaaaaaaaaaaataaagcaaacatatacacataacccccccaaaacaacaaaaaaactctgtgttggctaaaatggcagacacattttaaagtatgcagagcatacatttcagtactaaattattgcaaataaataaatccagagaatgtaaaatgaaatatacaggacttcaacatatccaaatgtcaacgaacaacaagtagttgaaagaccagccttttaatatgcaccaagaccaattcttgggctacaatatacctgttcaaataaaacaaaatcaacttaatgtgaagcatgtgttgaaggtactctatccctttaactatctccacttggctgttagagtgaaatggtgttagactattctcattaacttttaaaagcttaaagaaaagccagaattttacacttctcagagctaataggcctttcgtttattgccaatcttaagtaaaaattcacaagtagaaagatgccaaaacatatttgtctctctggatacctttataatttttttttaatttcaccaaatcaatatttacatattttatattttaatttatacttttcatatgctaaaattatttttataatgcacttaatggcttacaaagattaacacaaatagcaaataaaaaataaatctaaaaatgtaatgaaacgtaccaagaacacaagaaaaagagaaaataagaacaatgagatggagacagaaagagaggcacacaatttacagtcctagagactcacttgtagaagccactgggaattttgaaaatgtcagattgtatctcaataaataactataaaatatgagctcagaatataccatatcccatatcctaagacactgcagtccctcattttggtaaaactattgtttgtcttttctttgccatgtcctgtctttaaaaataaatatcctattgtaatttaataactctctttatctcagctatgctacgtccctcaattagtcccatacccaaatggctcacaaacacacaacactcttttcttaggtccagatccacatattcacctacctatttgacatcttttgttatataacctcaagatatctccactgttattgatagctccctctgcttcattctataacctatacatctgccgtactgccaactttccatttttactaccttcatccaggtccaagacattatgatagcaactactgcaatagctttttaatgggctctcagacattcactccaaaatcccctaatctgtgaaagcaaatctggtcatattagctcttcataaaatattaaacagtttccctttgcaattttaaaataaaaacaaactctttaatatgaccaaaaagtattgacttggtcttgaaacaaaacaccatttcaatcacatttcaacccccctgcttcccgtatttcagctactatggaacttcatttccattctcccagctccattctaccataggacctttgaacatgctgtgtttcctctacataacatccttttttcctttacattaaacatcttgtcatctggttcaccccattcctctttctgaattcatcacaaatgtcatttctttagaaaagttttctcagatcccttcactaggcccaacctgcctaagggagtctcatagagctctgtggtcctccctcttcttcctgacatagatgcaattttgtgtgtgtttgtggaacgccctagtgagtgtctttacgcttcacaaggatagtgatatggcttggctgtgtccccacccaaatcttatcttgaattgcagctcccataattcccatctgttatagggcggacctggtgagagataattgaatcacgagggcggtttccaccatggaaactggttcttgtggtagtgaataagtctcacaagatctgatggttttataaggggagaaaccccttttgcttggttctcattctctcttgtctgctgccatgtaagacatgcctttcgccttctgccatgattgtgaggcctctccagacatgtggaactgttagtttgttaaactttttctttataaattacccagtcctgggtatgcctttatcaggagcgtgaaaacgaacaaatacagatatcaaagagggcagaaaccatgactttatttttgctcattactagaccctcaagtctaatgcccgttcttgacacttaatgcctgtccaacaaatacttgccaaatgaataaatggatattatagtggtatcttgaattaagaatgataaaagtcaaccaggcatggtggtgcatgcctgtaatcccagcactttgggaggctgaggtgggtgggtcacctgaggtaaggagtttgagaccaacctggccaacatgatgaaaccccatccctactaaaaatacaaaaaattagctgggcatggcagtgcgtgcctgtaatcccagctacttgggaggctgaggcagcctggacaacaagagcaaaactccatttcaaaaaaaaagataaataaaagttaactatttgagatgttggtgctaatttctgaaccagtgatatacactgtgtagaaaggcacataatggcataaaaggtcagtgtttgaaaattattaaaaggataacataatgccccaagaccaataataaattcttacatatagaactcttatggtactgtttatacacattgttttattactccagatactctatgggacagaggatattattctcctttttatcaagagaaaactgagcttaaaaaagttaagtaactttctcaaagtgttttaaaatgtaaatgatagagctgggatgtgaacccaggttgtagtcatttcaaagtccgtgacctctatgctgcatagcattagtagtgtctaaatttaggtgactatttgggggaggaggtcatgaattttttttaatgttaataatcttcattcatttaataattttggatgatcgccctctataacagagacttctacatttcatgtaaatataccagggtaaaactttgcaatttttaaaatcacagcattaactatacaatggggtcactcaatgaaaatcgtttatgaatatgaccgaagatttcattataaaaacacccaccaccagtagcccaaaaacattacaacaaggctcttgtgtggaaaaaaaagtatttctctttaagaaagacttttcttctttttttttaatcactggcacaaaaattttctcagaaaacactaaggaatatcaaccaatcaaagacacaaaggtttatcaaggaaggtttatggaaagcaaatgttctccaaatatgcaaatccaaaaaggaaggacaaggctgggtgaaccctgtctgcagatagcacagagtaactgagtaatcacagagtaattgtgactgtttcaagaactgtgtttcagatcatgttaacttgaggaacaataaataaatcttgctaattcagtgaaactgctggttttatgaagaacctattgtgggccaatattttataattcaatattagtgatacactgggcaaattttctcattaatgacactgcatcatcaaactgcataaatgctccactgaccctaactatttgctactgacctccacagtttgctggaagtagcagttgtgtatgtattccaaatttaaaaagcaaatttctatttcaaaggacagatctgtgactgcctttaaacaatacagactcatttaatatctaatttattcagaactgaaataatgtcacacaaaaagctctacttttgtttttcagtaacagtatggaagctgtgatttctgagcaataatagaagaatacttcagcctctcagccattacagtaagcagagaatgcaagagaatgcatgagttcttttgtggaaattggcagataatggcagcttttctgaaatctcccacttttttaaattggcaatccgataaaacctttaaatttggggagtgggaggaggaaatgtttcaataaccacatattaaaaataacttgctaaagaaaggccttgaggctctcggatatactaagaacaaacaatcaaatgtatcctgtacctgggaagacaaaagcctcacaatcacgatgttaaaaggcaagaaccttgggctccagaggttaaagggtagcatcctgatgccataattaggcaactggatgcatagcaagaagagttctggaggggcaattagaattgtcaccagatccatcctggatacatcactaagtgtctctaagccttagttttctgtctttggaacacttggtttggctcagtgctctattaggcctagcctggaattcaagattctaaactctcagcaggaattttacctacaaagaaatataaaactagactccacatttttgagtcctaattcagagacaatgttgataatttttatatcattgtatgtcacaaatctgtagatgtcaaaaattcttacaaatccttatgattatggattttctgacagtacagtagaaatcgaccaagggcactgggttcattgaggatattttattaatgagacttactttttgattaaaaagtatgtattaatattgatttcaacatacctccattatgcaatgtgactgaaaacagaaaatactagtcacaaagtgaaatgtaattctatttcttttaaatacttctgcacctatccatttaaaaatatttggatgaaccacaaaaaatgtctattatgcatcaattttttacctaagcaaacctgcaattttatacgttttaaactgaatgaacttgtttgtatgtgtgtataacatgaattaaaatgctaggtaattccaataatcaacaggatatcctgcattatcagaccttactaaataaaacaagcttttatcggctacttactctattgcattggtcttaactctattccataatggcacagtttaaatcaatgttttatttttatattatcattttcctaaatgcacatagcaggaggggaattttaacattgtcttcattattttataggaagtatcacagattatgtaagtatcttgtccaatggggataatatgaagataggctaaagtcttttggggcttaaaaacttagtacatcaaaaggaaatatgtggagttattcaggcatatgtcttttattgtcattgaaacataatagaatttggttacctttatggttattcaaatgctgaaaaaattatctgtgatttaaaaaaatcaactggcagcataagcactgtcatcagttgatgctgatttctctaagctccttagcctttatatcacttctactcgtacaagggatgctttgtatatttctcaggcaagtttctcattttattttgttttgtttttaaattctaagtagctttaaaaattgtgctattgttccatctattcttctttccaattttgttaggcatttagtgacagtgggctttggtggaaacttatccattgctcagaccagggacatgagtcttgattagccaagacattcctggtagaacccttctaatgcctgtgactggctcagaaaagggccaatgacactggaggaaaactgctggggaacttatgggaaaggttctcatttgaaacatacacccacccagcatcctagtttatctaaggatgcagttatatgaggatgcaatgaatgaaactactgcacccattttgtgatcacagtgcgacataactaagggcaaaagccaatatgctgaagatggcagagtgaagatgtccaggttctaaagaacctggagttgtcaaactacctgagctttggattttttgttgtgtgacctaataaactggtgtattttctccttaaagagaaagatcacatttctgtatgtgtgtttgactgtgtgaatatgtgtgcctgtgtacgtatataaaatggtcaataaaatgttaatgctgattttttaaatgagtttttttccagtatttctttactggcagaattaaagttggttataatctcccccactttttatgcatgttcctatatttagtgtaggagagttaaaaggacaaggaggaaggatgaggcaaaaagatggaataaaattttattttggaatcagaaattgattactaagaacagtgacttgaagcaattcacttttggagtatctgtcataatcaataactacccacagcttggttaatgaacgttatttttagttgaattactaacaaaggaaacaattagatatgatcaccaacattttcatgcattaatgccagtgcaaattaactcctaccactaaaattactccttctgtctgtcaaaatctgtgacggctatgacttactgcacgcagagcataattgtgtctccctgcctgcataaagctgacacataaaatcaatattaattaaaaaaagatcaaaattgtcctcattatcttatttggctgtctctccaaaatagggttaccatttatgacagaataaaacagagtctggacttaaatgattcctcctgccaaataataaatgatccttttattggttggatctattaataaatatctatttctctatggatgaagttatgcatagtgtaactttgaaaaaggacccaatgtctaactataaattcatctagactatctatgacactttgccatggatatatttttgttctacacatctgtattctctattctctcctctgcccaaatgctcctaatacaagaaaagaataatcatttatatcagaagttgaggatcactgtgccctgcagaatgtatataatttatttgacattttatcttttctattataatgaatacaattttaagttttattattattacacatttattttaatgaaaaatttgtgggttcctaaaatactgagagaaatatgtgagctcaggagatttctcatgttcatcaggaggttttgcaaatttgtgcctcagtttatgaggtttcatgatacttcttttcctttccactccattttcttcatgctggctttccacacagcaccttaatgaataaaatgacaattccagagaatgttaccatcactaggatgacttagtatggaaccctaaccctaatcatctcaaatcgattgacccccagaaacaaaaatcacagggttagtttcttctgttctttcctgctcccagtgatgccttacagacatctctgagaactgggagtctacatgatgtgagatattttcttattaccatcaaaactcattcaaacaatattcgctttaataagttggtgtttacttgccaacaaatatcaataactcacaaccacaaaaaataattaaaaaggaaaagaaaataaaagaaatataggtggtttatgaatattcaatcaatcactttaaaccacaggtaattttatcacttattttgtcccattttaacaatttatgctcaagatatagtaaaatgaagtaaagcttaaacctttgactaaatgtttcaaagagaaagaaatttaactttgagaattgcaatatttacatatatataaatgcaatatttacatatatatatatatactcttttttcttttctgcccttaaattgccacttatacatagagtacatcacttctgctatccaaatgatttggtttgctttacagaaacccaagtttggcactttgggaggccgaggcaggtggatcacaaagtcaggggctcaagaccatcaccctgtctctactaaaaataacaaaaattagcggggcatggtggcgggtgcctgtaattccagctacttgggaggctgaggcaggagaatcgtttgagcccgggaggcggaggttgcagtgagccaagatcacgccactacacttcagcctgggtgacagacggagactccgtctcaaaaaaaaaaaaaaaagaaaaaagaaacccaagtctatatgattataggcaaattatttaatttccatatctcaacgttctaattcatgaaataagcatcataatactactcacctaataggtcccttgagaggattgagtcctcaataaatggtaactgctactattaataaataataacatcggcagattctaacactcagtcatatagacaataacttcaggaaatattctccacaacattacttacttccacattttcacattaaaggtgaggaaaattgatttctgaagttcagtagatagacccaaaatcatcctccaattagctggtggcatagactgaacaagtgaagagacaatgttcaaggtcactagaacttgctgtagcacatgtgaaaattgtagcagaaataaaagtataagaaaagacagtggtttccaaaataacactgacattttcactatagagagatgacaacaaaattagaacatttaaatatttttaaaggatttgttttctcttctatgacaaaaatttgattttacttttgcattagtgaagcgatatgctttttgaacttgaggttaggtgggtccctacctcgtgtctttgttgctatcagtttgtacaactaaaatctaaatgcctcggtttccttctaggaattatgagctatgcacttaaaattcactgaaattttaaagtgggtatgctctactaacaaaattaataagaagatgttaattgagggtggcaaactaaatacaggaaactgctcagcatttttttgtcagaaaatatttcaaatgagacaattttgtgcctcaagagtttatgttagctgggaaatggagaagggaagttgggagaatatctgaagaaagggaacatttaatgaacattaaataataagacttaatgttaagcacttcccacatcaattttgttttccagaaatccaatgagaaaggtaatttgcagatgaaaagaaaatggaatgtcagttaatttgacaaatgtcaaagacatgtttaaaactttgaaacttatctaacagatttaaccatcacgtgatcttttaaaccctcactacagtcccatcttctccttttccttacttataaaacaaccctagatttccttttcagtgttaaatagtattctaccttgaaaagaagtaagacatgactactttatactgaatttattcaataaagaaagaatttgatcacacatttctgaataattactgctttgtgacaaaatgaaaattaatggaaacagaaagtttcctccttcatagaatcaccatttactcactagctttgaaactaattctagcccaagattgccctcaaaccaggtccaaacacaaactgtaatccttataaacaccataactatgcagggtggaattatcacccacactgagccttttctttcaagtgttatttctgatttcacatgtgttgagaacatttatatacaagacctgagctacacaattttaaatgttattacttgtaaaatataagctgtgtctttatagtcacatatctttataatgttacaagaaggaataataatataaacaccatcacagttaatttataataatttggtaaaaacaataatattttaataatgaagctaaggtaatatttgtaagcaaaggaaatccccaatgtggaacaaaaaagaatgaacagcaaagaggccatcaagacctcacaagtgctcatctccccagatataagtacttggtcaatatatgtaagaaaatattttctctctaatgataagaataaaaacattaattataacaagatataattaataatcagttactacttatcgagaatctattaaatctgaattattccattcatatttttaaagggcttgtatatatacatagtttttcatatgcgggtatatggacccatatacatataaatggtccttcatttattctattgaccttcggaaacttgttttccccattttatagatgatcaaattgaggtccaggctacttaagtgacttcactgaagcaaaatccaagtagagagatattacctgtttaattagttgacatgcactgagctttagattgtgaatatgtatattcataataataagattatggttacatgaaactgtaaaaaatgctgttcttttctagggaaataaacacatgtttagcacagaatgttaaaagtagcatggagtagtatgagataaaattaaacatttgctttcaaggttatggcaacaaatgaccacaaagagaaaaaatgataactgaatcataattttctgacaatctcttggtgtttctgtattcctcctttgtgcttcacatgctgccctctcagtgaaaagcaactataagcacatagtctccaactgagcatgcggctggaaggcatgcaccatcatggttaattaggcaggcttcagaattcagcaagtagggtgaatcttagctatatcacttcctagctaggcaaccttgggcaagcatttaatctctccaaatctctgttactcatctatacaataaagttgataatagtatctacatgaaatgactatagctagaattaaataaggccagggctatcacaatacttggtccatagtaagtgctcagtaaatcatgcttatttttatatttatatctgcccccccccaggactgaaaaaaaaccactttaactttttcctctagaggtattactgctaataagtgcctcccctcccctcccttcccttcctctcccttcccctcccctccccttccctccctttttctctttccattgagaaaaccaaatctaacatgaacatggcattttcctttctgtcttggtatagcctatcatttctggattcaccatatggttaatagatggtggtgagacatagtgtggtatattagttcattcccatgctgctgataaagacataagcaagactgggtaatttataaaggaaagaggtttaattgattcacagatcagcatgcctggggaggcctcagaaaacttacaatcatggtcgaaggggaagcaaacatgtccttcctcacatggcagcaggagacagaagaacgagaaccgattaaagggggaagccccttgtaaaatcatcagatctcatgagaacttactcaccatcatgagaatagcatgggggaactacccccatgattcaattacatcccactgggtccctttcatcacacgtggggattatgggaactacaattcaagatgaaatttgggtggggacatagctaaaccatatcaggtggaaattttaaaacagtaatcaagaagacagaacccttcctctcactgccaatgggacaactagcccagcctcttctgtgttcagatcatagcagcatctagcagtgacttgaagctagggaagctccatttcaatttctgagctaaaactttttctcctggcacccaaatttatatttctgaatcagttttgccgtagaaaaattgttatgcatggtggggaagttctaaagttgttgtacattattacctacctcaagaacattaaggattaaggaggcttccaagagctcactggtgtgaggggctggtgagcaagcgtactactgtatcaatgaaaagatgagggatgggcacaggggctcatgcctgtaatcctaaaactttgggagactcaggcaggaggactgcttgaggtcaggagtttgagaccagcctgggcaacataatgaaacctcatatctacaaaaaattttaaaaattggccaggcatagtggtgtctgcctgtggtcccagctacatggaagctgaggcagaaggatggcttaagcccaggagcttgaggctgcagtgagccatgattatgatactacactgcagcctgggcaacagagcaagaccctgtctcaaaacaacaacaacaacaacaacaacaacaacaacaacaaaaatgtggtctgattttcaagtacaattcacaaaggcacatttgaaacacaatccactcagagactgggggctgcttttccctttcttttcattggccactggccactagagggctgctgtgagtcatcccccttgtcagaggctcttaaggctcatagttctgaaattaggatgcatttcaagggcgggaccaaattctcctccacttctacagtatctgcagagtgtctagaaatgagaaggaccgtttcaagagctcataaatatcctgttgtggaagacagatgaatgctctgggttggaagcaaatttttttttaacacatacctagggaacttatgaacactctagttagcttcttcaatgtgtctgaagactgctcacactcctgttgacaagtaaagagggtgaactctaagaagtatatttaaatgcaaaaatgaacccagttcatgtgcttttcttgtactctctgtgttttagggtagattatcatgagtggtaaagaagatagagaccggcattagagggtggggcttagatacacactcatatacaacgggtcatttaggttgcacaaaaatcagaaagatggccacagatcagaagtggttttccactcaaaccactgacctctgggttgtctttctgaagaacttctttcctgttggttagagtttacttggtatgttcttgacccgtgagacaggaatgaggagatcagacaaatgggaggtcagaaaggaggaagagattattcccatgtggaatgaggtttcctaatttatagattcctctgtggatgtttggtggaaacaaacctctccccatttgcttaattttctcttgctcttcacacaacacagtcaaccatatgttagactcttgaaggttccatctctttccctggttttcttttaattctatttcctctcaccccaagccaatccagagggtggaattccaacttcgattcagacatcaaagccagtgtggccacacttgatctatctcatcttctttaatagacttaattcttctcaaggcaggtcaagattctattatctttggtaattttatctaattcattaatcaagaacaggattttctacatgagtaatatgagtaataataatatccatctatgtgctaatcttctaattattttacacatattacttcgtttcttctatgaacagcctatcaggaaaattgctggcaacattttagagatgaagatactgaagcacactgtggttgagcaacttgcccaaggctcgcaaccaggagaaggtgtatatgggatgtgatcaccaaaagtctgttttccatatcatcaacactgtcctagctgtggctaaacacctctacctctgctatgaccagcagtctctatttttgagctgcacctagcatgcaccagacatgataatgataatctcacaagcatcacttcccttagtattcaaaacaacatcatcagctgggtactgtccccacgtatagacgaagaaacagaggcttggcagagtttagtgcgatatcagaggtcacacctctagtaataacccaaccaagactgctgaatgtttctctgactgcaaaggctgtacttttacccagcaaatcatgttgctcctatagaaagactgcacccaaccgtccctggaaataccataggcctgttttagcacactgcgcagcactgataaggttaaatagaaactgtgattatgcatcactgcattgctaatatctctatgaataaaatgtcgatttgattttcatttaacctcaaaagaatctgattaccaaataaccattgaagaattattggcaattatgttctgtaattatggtgcctgttaatgtcattagcgtacagcctttcatatttagtactattaattaatccccataagcatagaaatttataatcaatataacaaaggctccatggtaaattataaatactcccgaaatccctccaacagtttacagggctccgtgggcttccttggttgggacacatttagtttgggggctgcaagaatctgtggtaattgatagcttttcacccggaatcggctatctcactaatgtgcctaattaggcaaatgcttaaaactggagtcccaactgccactgacaactataaattcctgtagggcaatcaaaataattaactgcttgagtcaagagacccacaaatcagatatacaacttttcaattctctgagcaatatactgcttcagataacaactactgtcagtgagtgtctggtttcggttttggaggagttgaatacagtaagtatgtctaatgttaaaagtccaaaaaagattcatgatagctctatctcacagatatgcaagataaacatgcatgctcacagtgatgctaggaatggatgctttgtaaagcactggtctaagaatatcatgtttttcaaaatctcccaatccatcctcagattttcttttacacattttctcaaactgaaacgtataagtctgttttatagaaaacctattttgtttttgtaattttaaacatctacattaatatacatcagattttttaaatggttacattcacatattttatctgaaacaactactgctataattgtctaaagatgcagcaagctgcctcagaagtggtacattctaataagatgtggcatgataatctattctgcattgttcagaattggactagttggtttctgaggccctgctctatgttagaatctaaaagtccgtgaatcccattcttttttcccacagagaaaagggattagaacttgctccctgttggcatcccacgccctttcctgattccattcttgttctggacaatttcccaggaattagtgcataaccctctacagctgctgggcctcagaaacaatttgggaggagaaaatagaggctcagaataaagaaaatatctattaaagcattattgcatcaaatataatggagaacatgttcatcttttaaaaattcaaaaggaagaatatgacacatttaggaggcatccaaaaatcacctttttcagataaataactgttagtggagaaataaaattaacttgcaatttggaagaattagtaggcagaattataatatttaagatctgaaaataacctcaaaggtcatttgaatccaatattccattttacaaatgagtaaggtgaaattcagaaagggtaaataacttatccaaggtcccaagtacattgatggctgaaatggaactggaaatggagatatcttaactaccccatcttccaccacccctaaactaaatggttaattaaatttaaaagcttattacagggtatgcttaaaggcacaacttcagattcgtggttttaaaataaaagattgtatcctaacatcgctgacaaccacagttagcatggattctcagtcttgtcaagatgcagaagtaagatatgcatagacattgggatgggagatcttatcaggtcctgtagttctattctacgagctttcagtaagttttatacaaactaaaacaataataataataatggatgataacgacaggagcctatactattttgaggctgaaacaactacatctcacataatttgtcacatagcattcagagccctcatctgacctgtagtcatttttttcatttctgttttggtggcttctatagctttttatttatttgtgtttgtatttttttgaattagttgtcagtagtcaaaaattaaaaaatgtcacagaaaacctgactacaattttcttacatgtagctcactagttgttaaaaagcagagaaataaaaaaggaagagaagagaaaagaagagaagaggaaagaaagaaaaccaaagaaagaacctaatgcaaatgatgagataatggatgcagcaaaccaacatgacacatgtatacatatgtaacaaacctgcatgttgtgcgcatgtaccctagagctgaaagtataataataataaaaaaagaaaaccaaagaattccttctgtgcttggctcagcagcgttggagttcctgactccactttaatgtttccttagtctagcaccaccaccaaagttcttatacaaatcattttaaccaccaccgaagtactgacacaagcattactagccgaagtggttgtagatttccttgaaattaaaaatatgtttcacctttgtagtttcaatgagaataagaaatgaatgtgcagaacgtcattcttaataactatgcttattataagaaaacataaagaatgcataatggagaatgcatatttcttcatgcatgatggttatgggaccagcccttctctgttttatttcctcttccttaataggtagctatgcaataagaacaaattttgaaaaaataagacaaaagaagatattctgatttaaaaggaggtggaggaagaggaggtagtgtcagtggcacaggtagtacctaaagtctacctgaagattctctccaggacatgggttacatgcataaattgggcctctgaaagccttaaactttatctagagatggcatataggctttggatttaacactttctgtgctctatttcatcacatttatagaactgttttcatagctttgaataagtatgagcttattacatgaatatttagtttattacatactactatatacagctgtgattgtgaacagatacacttctgctttttgttgaagataggactgagttagcaatgtctactgtattaaacagaaaaataattctctctggccacttccatattctcccagatcaggacctatacaaacactggggaaaacaaacttccaagtgatggcagcacaatcaagctgttttgtggaaggtataactgctttgcatggttataagcctgccagaaaacatgcaggaattcccaattcccagagcagaaacattgccagcatgtaactctggattccaccccatatgccatatttccagcccatcttcggtcagcacatagtctgtgctcctggggcgtgcaagactgtgaaaaggcctgcataactagctttcatgatgattcctgcattaaagagtaaaagcatctctgttcagctttcaaacagcctacttacccatggccaggaagaaggggaaattaatcatttaattaaattagtcattttccagactaaagataaacttggaatatgactcacttaagcaaaactttccacaggtgtcacttctccaggaagattaagagaagggcccaggtctcctattccagaaaactatttgagggttgaaacctcctccactgtgtatcacctagcacagtgcctagtgaacagtaagaatcaggaaagagttattggattgagtagctattgaattgaaatggaacccagtctgcccactctaaaacagtcactttgaacacagaatgtattaaggtgttatttcacgtgcaggctgttacaaatgttgactcaggctcaaacaaaccttttagcatttttacttttaatccaattgaatgattttacaaaatagggcaaggatataaattcaaataaattaacagtgggtaaaagagcatctagtcctcaaaaaaaaattctttggcctgcctatcatttatatttgtacaattattcctcttctctaaggttcacaacacttaggcttctgaagatggaaatacactgcacagggtattaacttctgccaatggaaataaaactgtaaatgatttggttttgtgattatttaacatataaacatgtgctcattgagaaaaatgatgtctggacaactgacattgtatttctgccaagtaccaagctaatgttcataaaattttactggagggaacccaatgctaactataggatttcaaactgctgatctggagagatgaatcgtgaagcaatctacgttgtatggctaatcagaattcccatccttacccatgctctgaaaagaacctaaaatttctatttggaggcaacttcagaaagctttcattaatttaaattttaaagcagatttcttcccattatgtgtattcaactgaaagcctatttaacacaacaccatgataaaagtgaaaaaaaaaaaaatgtcaggtttttccaaggcatccattttactttattccagaatccagaggcattgaaaatccagggctttctgcatttcttaggatgttttgaaaactaaaaagaactggtgataatttggtgatttcccgttctctgcaatttattttaaacatgtgaaatgaatgactctatgttccttaaagctgcccccaaattaagcaatgtaatagttgataattagatgcatttaattctaatttaatagccatctttatttggcatgctctttatataaatactactcaactgaatcctattaacacttacatggtttattacatttcatctgaggaaaaatgtacatattctaaaagctgcattatttaatcttggtgttaatttactggtatgcttaatgagtttacaggtttagtattatttaaactttgtgaaatatatgtaacttttctttattttacctttaatatttggagaaaaaaaggttctattagggttttcaatatggttataattgtagaatgaaaataagataaaattaaaattaaaaagcagaagtggtacagttctcataattttctacatgcactggagaggaacaggttttcaggaaatctcaaatgggaagtagatgtgttgagcatgttgaactaggaaggctcctagcaaaaacaaatgagatgctgtactgcctctccattacggccaacacagaaggagaaaagaaaatggcatcgtcatggcagtctacaaataactaatcactcccatgcacggttgattttcagtatggagtctggcaggaaaacctcagggactctgtcacccacttgcaggccagcttcacatgacacagtattattattagcagcaatattttgaccatttctagttatcttttctcttcttatctctcccctgaagttgatacaagaaaagattatctgaaaataaagaaaataaataccagaaaaggtttaagtaggaaaaactgcatgtttttaggaaatattctgagtgattagataggggaataaaaagtatgaaacgattatatcatgttctatgtagcctgacaaggtaatccctaagtgagagaattttttactgctgcaaatttgtgtgtgtaaagtgtgactgacaagccacaaacataaattggtaaaaccaaaaggaagtcatttagcagctcattattttacaattttctacatttcaataaattcatcatgacgatttttttttgggggggggcggaattcccaatggcattaatgtactagtttaatagaacaataaaataatattgcaggaaaacatatggctctgccaaaaatattaaactaatataccataaaaggaaaatgaataggtgattcattcactatccatttacaattatttaaattataaaaatgaaagcagcctcttcattttaaaagacaaaagaaaagtcatttagtagtttagtaatcaaacctatgtgagagatcagttatctggttagatattgatctcacttataaatgattttatattacactatgctcctagttcatgatacatatacacacatcctcttattatttattgaacataaatttatatcaaactggctttaagactcttgtaaatttgtgggagctccagttttactaaggcaaagtgagatgcagaatcaactccattttttccaaacaattgattccttatcttctaaaatgccacaattttcattatgccatacaaaatattacggaatgtaaattatcagtaaaatttccttagttatctatttcactgtgaaatatgaacacagcctgtattaataaccatgaattcaaagagaaaatgctttaaatatatatcaggctagcttaatctaagcatattgtttgctgtggttctttttcagaactgaatatcaagctacagtccactctgccgaaagcttccagctttccaaaaactgaaaaccttcgccagtaaatcacaactgttttaccatatgcctctctgttctgccaagcattaccagcttgttctacttttaagcaaatttcattatattatagctcagagcaatgctcattaaaaagtattactgaaaaatgtcaagttgtttttatatagaaactagaatttattttctactgaaaagtcagatatttattgaacacaagacatttttaaaacatagctttcatttcacaagttggttcaacttaatgattatctgaagtactttgggtcttgcaccagttaatgttcactagtatctcccattgatgtagattaaccattgcctttctagaatcaacttagactcagattagtggaaaattctcggtttcttcacctatattcatattctcattgatctgcctattctcctggctccccgccagagccttcttgagaactgctccactggacatactttaggggactgtaaacttcattatagcctattcattatagtataaatacagttcaaagaacactagcttagaaatctcaaccccaccgcttctaattgtgtgattctcaattaagtcagtaacctctcagagtcttcatttccttatttgtaaaatggaatgaaaacagcctgctctgctttttgaacctaattattgtgagcaaaaaagtcagcaatgcatgttccaacattatgtatcccatttaccatatgccaaacacaaaaccagaaagcttcattttaaagcaccaagctccttcccaaggaacagtttttccttctcttcagatagtaaaactcactggccataagagcctgtgatccacaaaagacaggatagatttttattacctgctgtaattaagtttagccttggattccaggcccaaagatttataaaatgttaggctttaaaccacaaaaccaaaaaatcaagccattcttgattcctctcaggagaaagaatgttttctaatcccatgaggaaatcccaatcagacatactcaaattggatcacactttacatttaaactaacaataagaacaacaatagaaataacaatcatcactaatccagatccagttgttctttaattgtaggccaaatcattctctgcagatcctgaagcttttcaaaaatgaagaccaatcctgaaggtgagctgaaaagtgttgtgagggttccttcactttaatctactgcatttttatgcagtgaaatcgggataatgtggaaatcaaggtcgcttttgatggaagagaggtgacaaaaagatatctagagggacagaaggaaagggaacaggagtaggatggccaagaacaggcctacttaatttgacttgctaatttcataaagagactctgagcagaattgcaggtggattatccacatacaatcctcaggcctttctctgcactttcctatgctacatggtctttccttcccacagggatctttctctggtattgtctatctccttagcaatgagagaatggaggctgttcaaatcacctgtcatgagactgtcaccctactctctaggtatggcttcacctaaaatacaattataaacatagaaacttccacctcacaagtatagtggtgatagcaaaactcagagcatagcaaagtgcattctagatgccaacatagaaattatgttcattcagtacattaaacagcatttgtttccaaagaactcaaacagaatgacaaagaaaccactaacacttcactagataagcaaatatagcactttcaatattatattaagagatgcttatcaagaacttgcaaatttccttaccctttgttctagcaatttgcatcagggaatctattctgcaaaaagcagcgactgcatttttttgcataaacgtgtgcattgcagaattatttagatggacagagctttagaaacaacctaaatatccaacaatagtaaaagagtaagtatattaagatatttacatacggaataggtggttgatttacaaagggctagtggaatagaaaaaatttctcatgttaagatccacatcaaaattttttttgtttacaatatgcacataaaagattaagttataaaatcaagatttaccaaagttgaaagcatacattttttcactctcttataagagcatatttgcatgttcctaaaagaatcaataaatatactcttataatccatacatgttgggtatttacgtgttaaaactgaaagtctaatcttgtgctgtctttgaaaaacggctgtgttgctgtggctaaagaatgctttacagaaaagaagcatggtatactaatgtgagaaaacgtgctttgtttttaaatgtgatggttttcttggtgacattttgaagtcaatcttttctctcttgaatgacagaatttctatattaagagagtatgtggagacaaatagtgcctctcagttgcgcaaagaagcatatttagtatccaactacagaattccacggaaattatagaatcttcagtccagatttaggtaccagagttaagtagaaatggttatagaaccagtcagtaagagtatagcatatacgcagaccgccacacagagagtgaggcatgtgcaagagaaaaaaagtaagagtgtaggaaacaaagagtgcaggaggaagaagagagcaaattggtaatgattctgtaaccagagaagcactggcatgagtgaataactcaactgtaaagaagtacagaatggatgatagatatcccaattaccctgacttaataattacacattctaatactcatatgaaaatatcccatggatccccaaaatatgtacaactatgatatatgaatacaaattaaaagtaagtacagaataagtcatatctatcatcacacatgcagtatctccctttttaaaaagttctcaataaaataccttaatcaaatgtggctcagtaatagtaacactgaatttagacaactttatcaattatcttatcactagaatggtgtacaagcgtgatagtctttgattgggcatgaccaggaaaaagttgagggttacaagactggtgaccctcaagagaggaggtaacatttgtcggccttacaattctcaatattgatgcatgctgtgaaagtgcaagacataagttattctcaatattgtgagaccatcaaatgttacctcctctcttgagggccaccagtcttgaggctctcttgagaacttccttccaatattagtccataggacctcctgacacattcacaagagaaacagagagcaagctgagtgacattatttttattctcttacttgagggaatatatgtaatttagaatggattagatagctctcctgcattgctttattgaagatatgtctggagtctgcagtcagaaattagtgaagtccttccttatccatctgaaaatttcaagtttctctaaaattaaaacaagaaatagaaatagtttaaccaacgcagagaccagacccaacacactaatgcaaatacccctttcctagactctactatggtcgattcacttttccttatggttcacttcatggcaaagctgtaattataatgcttagaaatgttgacctttacttaatgactgactctctcatgaccaagattaatgatttgaaagcccaaatgcagatgctaacaaaagataaaggtgtatctatcacttaatgcaatgaaattttattcattaaagaacaagaaacaaaggctgattatatcttccttcttataagctatttaaaaacaaacaaacaaacaaacaaacaaaatgatgtttcgctgtgttacgcaggctggacttaaactcctgggctcaagcaatccttctgcttcagcctcccaagtagctgggactaaaagtgcccaccaccattcccagcttataaactacttttaaatagcagtcattctggcttgttttcttgcatccagaaatgaattcgactggtggctcattgtttctttttccagagtaacatggtctcttttcctttggtccacacagatcctgtggatcaacttcatgtcagaaagcaaaaagtaaaaataacaccttggagagctctcactcatctattcgcaccaacctaatcacaatgctactgcttccaggatgaccaggtaatgagtgtggtctatccaacacgaggattctttccaaggcaatttggagcaaatcaactaggctaattggtaattcaagtttttatcccataaaatgactgtggcccaagggaatgtatcagaaacctgtgcacaagagtttgtattagagttgtttattaacatggggattatcttcaaaccaataataaaaagctataattgactctttgcaaatgcataaatatgggagcaacagtgtgcacaggttattactaaactggaaaagaattttaaacatttcttgtaataaataaatcacctttaatagtgacaaattgtagataaattgcataatgccaatgtatatttcaaggtaagaactaataatacatcaattcttttttgttcctttaagattagaactcataaaccccacagtgcactgggtacaaaatcccattgaaaactcagaaatgggactgatgggagaactgaactcagagacttccacaactcggaaatatgttcttaaaaagccatgtatctttttatcttgggcttctaggcaactagcacaggtcaagataactagcataaaaggaatcgggcactaattctgctaccatcttggtgtacgatctgacgcaagtcaatgaatcactatgcatctcaactcttagatctaaaagacagaataatcaagaattttataagactccaatgagacaatttataagaaaaagcattgaaaataatgcatgctgtgagagcgcaagacataagttattaaagggctgatatgtcaggaatatcagtaagtttcagaataaactgttacggtctattcttgatttggttaaggacatgagggtaaatatgcttatgctattccattttatggatagcagtggtgagaaccactgtggccaagaattttgtcaattaatctgcaaacttttctgaccaatgcttagcactatcaatctaactaagctgtgtgtgtgtgtgtgtgtgtgtgtgtgtgtgtgtgtgtgtgtgacttaatcaatacctaacaaagatccctggggtgaagatcactcctatattatacctagtaccaccagttatttggagggacaggtgttatccactgatcaaatcttaggaagctgcccctcggagaattacagctctggcacaagcagatcatagactcagtttacacttcaagaaactctatttagtggtgactgcacatagttcattttttaaaatctcgctgcacacagcctgatcctgtactactcaaacatgtcaattgttatgattcattattcttcaaaggcctcaagttggtactcaatattccactgggagcttggaaaacggatctgtcccttcactgagttattaggcaagtttcaacacatcttttcatcagtataagagtctacagaacctagcctctgtaaattcagagaaggggccttgtattttatggcacatggaaaggcgttagtcacacacaacttgttcccagtcataggcctctgttcaggctcctctcttctctaggttcccttagccttaccagcaaaatccctagacaaatcttatttcttctcagacccagacagagcctcagatcctgtatgaagactcctgcaatgaggggaaccatcttctccactggaatttgtacagctgttgtgaggctcctcttctctctcaatatcgccttttctactgccactcctttcttgttaaggtactagccactctaaccacaccttctctcattcctataaccaatcatttttaaaagtctggcagaatctctgatcccaacaccttcacagaaaaaaaaaagtaaaaacaaacaaagaaacaaacctgttatgcattataggagtgattttcaattgtgtgtatgtggggtgggtgtgtcttgatgggaacatgaaaactccgaggcagatgtggtaagcagatgggcggggcatgtgtaatgtgatgagtccttccagggtggccttatctaccttgcttatagccagcaccacaatctattcacattgtttgtgcctcagctcaggagcttcttattgctcactcaatacctcccaaatgattttctcacctacagtcttgttctctttaaccatgacccaaaccaaccaattaattctctaccttgcttgctgaatgacctgtgtaaatgcaggcctaattctgtcaagcccttcttaaatccttcagtgtctctctatcgccttgaaggctaagtcaaacttcccaacaaggttgagtaggctaccattcccgtttgggctttctagcccctttttgggtttattttattttttatatgcatttttttagagactgggtcttgctatattgtccagtgcagtggctattcacaggtgttatgatttggctgtgttcccacccaaatatcatcttgaattatacctcccataatcctcatgagtggtgggagggaccaggtgggaggtaattgaatcatgggggcgagtttttcctggccgttctcatgatagggaataagtctcatgagatgtgatggttttataaagggcagttcccctgcacacactctcttgcctgctgccatgtaagatgcgcctttgctcctcctttgtcttctgccatgattgtgaggcctcccagccatgtggaattgtgagttcattaagcctctttctctttataaattacccagacttgggtatttcttcatagcagtatgaaaacagactaatcaattttttgtgatggttaatattgagtgtcaacttgactggattgaaggatgtaaagtattgttcctgggtgtgtctgtgaggatgttgccaaaagagattaacatttgagtcagtggactgggaaaggcagactcaccctcaatctggaagggtaccatccagctaatcagctgccagcacagccaggataaaagcaggaagaggaacatgaaagaattagactggctgagtcttctggcctccatctttctcccatgctggatgcttcctgccctcaaacatcaaactccaaattcttcagcttttggactcttggacctacatcattggtttgccaagggctctcaggtcttcagccacagaatgaacgttgcactgttggcttccctgcttttgaggttttgggactcggactggcttccttgctcctcatcttgcagaaggcctattgagggagttcatcttgtgatcatgtgaatcaatactccttaataaactcatatatatatatatgtgtatacacacacacacacacacacacacacacacatctatcctattagtcctgtccatttagagaaccctaatacaacaggcatgatcatagcatgctacacagccttgaacttctggactcaagtgatcctcccatgtcagtctcttgagtagctgagactacaggctcatgccaccatgtccagctctaagaggtcatgtacttttttaaatttttttttcaacttttaatttttaattcaggggtcacatgtaaaggtttgttacttgggtatactttgtgatgctgaggtttagggtatgattgatcctgtcactcaggtagtaagcatagtgcccagtagataattttttcaactcttgccccattccctccctctccctctaatagtgccctgtgtctaccgttgtcatctttatgtccataggtacccaatgtttagcttccacttatgagtgggaacatacggtatttggttcactgttgctgcatttattcacttaggataatggcatccagctgtatcaatgttgctgcaaaaaacatgatttcattcattttcatggctgtgtagtaatccatgatatatatgcaccagattttctttaccaaagatactcttgatgggcacctaggttgcttccctgtctttgcaattgtgaatactgctgtgataaacatgccagttcatatgtctttttggtagaataatttattttcttttggatatatatcctttcctagcccagttttctaagtgtcagccagccctgcacgattacttgaagttctcaaagtggtgcaagcttcttgctttagagcatctatacagttgttgctcctggctgattcctgttgtcccttttataactaaataggctacttaccttttgttctttaagaccctcttcacgtatcacctcctcctccagggctctcttcatctctgaaggctttttaggagcctcccttcattttctttgaacattaatgataccacagtcctatctcaatctctcacacctgtctactctcccaagtttctgtaagaatcgactagttcctgtaattgacagctatatggtgttactattaattagtcccatttgattatatcatttcctgacagtcccaaacactctttggactgtggattttcaacatttgtatcagacagctggtcaggtctacctgctattttaccattgcttgcctgtaatttaatttatcttggcctcaattcctccatctgtaaaacaacaatgactattctactggtttatatggtgactaagtaagataatgcatatacaaaatacagcttaattaatgcctaatactagtaagagcttaattaatagtttctcttcttccccctccttcaaattattattattattattattatgctaggcacttaataaatacttgacacattgaattaattagctgagagctttttatatctaggaaccaaatttccacttctgctctccagccaacttgtggaaggtgaaaggaagatggtcagcatcaaaagattcctctttctagcacgtggcagagtattccacttttgccttgtaactgccattgaaggtgatatttcacctgataaagtcagttatgagatctcccatacagagtaatgaaaaagcctgtaacagctagtgatctgcctcccctgctgttgcctccaccgaataattttgccataaaaaataaaggggacatctccttttagtgaattatgacaaattttaactgacttatccctcttggaacttaggagtgtcctactttctcctccaatgacactcccactgagctgacatgtgacacatcctgggaatgcattagaactaaagagaaagttaagactgtgacacatccgttggccctttttttttttttgctaaaggaggaacatccctcctcccttgtctcctcagtccatagctctctgttctcaggatctttttaattctactggccgggaagacatttataggcaaaagcccctgtagagcaacatatccccctctctatcatatatacttctcaaatacctactacatgccagacactgtggctctggggacacactgatcagcaaacaaagcccctgcccttatatgattatagtggggcatgacataaagcaaatgtgttcctaaaaaattccaagttgaacaaatgacattcataccatactttgcgtatggtgcaaaccatatgtaccaataatacatgacatctaaggctgaattttaaaaataagtattcttgttagaggccagtcatcccttagcaactgactatttcagctctggctacagggaaggtgataatgagtaacacatattgaatacttaatatgtaccagatattctgctatctttttcaggtatttttacttgattatcacacatctaaattccccatgtggttatatgcttatcgttatacccattttgtagatgaggaaacagagcagttaaacaatttgctcagccatattgttagtaagtggccttgaaccctggcaatagagcacacgtgcacagacagagagattatgacacattgtctccaaaggtgcttcagaaaatcctaaggagggagtgaatgagtgaggatcatgaatgtgaaaatcaaatctacccacgcaacaaaggaccactaaattgccaaaatgctcaagagcatgatttactgtattcttcatttctgtgtaaataatgaaaataaatctctcggctcccaagaggagcacatctgtaatagttcctgctgaagatgttaaagatgtgtttatggaatttgcagaatcacttccttcaaagttcaatggtctataagttgctagtgttattgttgttaaaagaaactgaacgcttagtactttctgcttcaatctcaggttgagatttgtaaggaaaaccagatatcagaccagctcctatggaaactactctgtccaatcaaaagatatcctctttccatgaaactaacttaactacctcacaggatattcgaagcacaatacataatgtgaagggggaaaaccttactttccttctcctgttctagtacgctttaccagatgctcctgtggccaaaccctaattgttcacttcaaaacaaaaactacttaagcttctggaatgtaacacatctctaccaggttaaccattaagagacggagaggcagaggcagaggggaaacaggagctcctctcagacatcaggaagacaaatgcgaattgtccctacaaaagaaaaaagatcaccacctacgtgtttctctatcttctctcacttttctctgtttccttgtcatccctctttctgcccaggtaaagtggtggtggagaaggagaggaattccagctaaacagtgcgttggtatgaaccgtaggctagtgagccatgtgcatgctccagggacagggaaactgaagagagtgcactataggacaccaaatgcagatataatcaaggcttctttctacatgccgcaacatagtcaatttgaaaataagcatatccagaatggtaaagcacttgcgcagtaattcagccatgctccttctaagtatgaaaatctgaatatcaaagcacggtaaggagggaagcaggtgaaaaacaataataaaaacagtgagtcagcattttttgaagctatcagaagctcaacagagctgaatctattatgggataagaatggaaagatacaggtggaagaattgacatacagcagcaatatcttaaattaactccttgctattgaacacatgagaaactatagtgaaaagtctcagtgactgattggtttttatgcctagaagagaaagcaaattttgaaagtcctggccctttgcatttaggtccataattagacaattagagctcatgtactacaacaaagctctcaaacaatcatgaaacacagccacactcattttaaaagaagattcttaagagttaaagaagaccttttaaaaaatacattgctttcacatttcttccaagtagcatagaaatcagggaggaagaggaaaaggaggttttctatccatcagaggaacaggaatggattttggcatgcttggctaagcattctccccatgatttatggtctgaggtgtcacttacatggatgggatggggtgggagtggaaaaactgataacatgatctgataaacacctgtatcaaaagcacctgaattgcttgcaaaaatgtgtatttctcactgaattctgaaatactgaatctcagcagaaaactcaaagaatcttctaacaagctcctcagtgattggcaggagctttgagagaggcaagggctgagtaggtaggtggggaggtttgaggctgttgggcaaaacagggttgcatccctttccttagacaacaaacagggctgcaggatttaataaaattccacaatacttccagtgttaacaatggtgtatgctgggattaatcccacatgaaataatcacaaaatgataccagttagtatgatgcactgctatcctaccacagccgtgcaaattttaaggacagtcttttttggataaggtcccaccagtagataaactccacaaagtctggccaccagggagggtcaattaccaggactacattgtttctctagttcagatgtgcagaatataagggcagtgtgaagttcagcattacaaaaacagaaagcaatttagtaattagtgaaagtattacatggacaaaacaatagctgggagatttgtttaaaggaataaactaataactttgttcataccaacccatttcaaatatgggaaaataatttttaaacatttaaataaaactagaattaacgaaataccttggatacactggctagacaaaagattcctggtcctgactaacttgagaatttcggcaaataagtcagttaattacaaggagccccgtatgctgaatgcagttgcccaggaaatttgcttaggtcttgcttagtcaaatttgagagacagctcaactaccatacccatggggaaaattgtggacattcttggagtatatgccttaaataccatagttgaaaatgccttaggttgtgcagtggtagatgttttttaatgtactaatttaattgatttatacaataatatatctttattattgcacttagcaccttatattgcaattaataagttgtatattttctcccccttattgtctataaggtataaatttgactacaattgaattcattaattttaaaatctaaaaatgcccagtattttgtgtgatattatatatatcttttgtaaatgcttaccaaatcaatccgtccttctagatttttatttggtgaaaggaacttgtatcagacagtgaacactaatgtagtgaatcctagatttccgacagtgtgctaagggactgaggatgcaaatatgaatagaaaacagttcctgtccttgagaaggtcatagtcaagttgacctggaaatctctgtaagtattataatgcaatggtaaatacatttgctaaacaatagttctttaaagtacctaatttgctgaatacattcatatttccacatgttgagtttgttcaaattcacctaggcaatttatgttaccaatgcattttaatcctgggttatatagctaataaaaataaggacattattaattattttttaaattacattttaatatttaagtaatcctaattaagggcattaaacatgtaattaatgtttgtttcattataaacttgtctaagcatatagctgtacgctaaaaacaaatacaaattcagatttaccactgtgaatgctaaactttatcaaatagtacaactctggccgataatttatcatattctgcatttgttgatataaagacaaactgcaaaaacactaagtgtatttctaattataaataggatttctactcaggcctagggacagtgagtttttataaatgtgcaaccaaccccttttcccatgagtctgactgcagttctttctccatggctgataccaaggaagaaatgttgagactactctttgggattctctgcagtgtatttgctaaccatgtggaagaagtatgtgggatattttaatgaaaagggcagtaaagttagggataaagagacacaccttggtcaaaccaggtaataactaatatgactttagaaaagaaagcaacttgctctattgtgcaggctggagcgcagtggcatgatcacgactcactggagcctccatcacctgagctctagccatctttaaacctcaacctcctgagtagctaggactacaggtgtgcaccctgatgatttttttttttttaattttagtagagatgaggtctcactatgttgcagaggctggtcctgaactcctgagctcaagtgatctgcccatgtcggcctcccaaagcgctgggattataggctaattagggtttctatttcttttcttacaaaaggaaaacatttgactaggaagtctctcaagtcatttcttgctttaagtctatgattcagtggtcagcagtaatctcagagaagatgctatgtggaagggatagctggttgcagctgggtcaccgaaaatcaccacgaagttcatacccttagtaaaattattttacatattgatagctcacaactccctcaacctcacactctacatccactccccccatcaatttccatacatgcttttgggttatggagtatcagcaggcagtgacaaccaccacgaacaacaacaacaacaacaacacacacacacacacacacatacacacacacactctgaacttgaaaacgaaaacttcttgggattttcagggcatggtctcagctacccagcttcctgggaaataaagaaagtagcaagtgttaacacctcatttttacctatcaacagttacagaaaaacatgtaaattgttccttatacatcaatgtatgagtttttgacaatgctgggggataaagctattatttctgggttctgcttaagacacgctcctttgtcctccctaccactcagatatctatagttcatacagtaccaaaaacacctctttccacctagagggctcttaaaacctgcagttaagcaagagcaagccaaaacaagtctatagcatcacagatgggttatccaactcaatcacagacattcccctaatctccagcaaagaaacctgctgtctctctaatgcactaacatcatttccctagggcaaggtctgatttctctgagtatattattcatagaaatattatacattttgataaatgtaaatagaggataaactcagtcaaaaacaattcacaggttagaggaggtttaaaagagatgggagcgagaaatcactttttcctgtatttgttttcccaaggtttctcacccctctgcagaatgagattctaggtttagagacattaggaaaccagtaaccacgggacccgttgcctggaaacggcctgattacaacgaactcactaggctacaaggaaattctacctgatcctttaggaccatttgccaagcctcattatgatgataaagaaaatttatactttcataaagccttcaaaaattattgccatgaggttctgaaaaatctgagcatctgctttggggaagaaatgggaaattaacatgaccatctagtgtcaaaaactgacagcctagacaaaataaagaaaaattcgttcagcatcaggcgtagaattcagaaatcaaaaatccaaattcaatgctgaacaaataatgtttgggaattgtactgtctgccatgggggtgagaagccaaggcagccggaaaatcactaataaggggcatttgtattctgcagcagtagaacttcacttgtgcttccctgtacatctaagaagaactttcaatccaatgctgccattaacagctgctttgaaacatacgccatttggttttgttgcccttgacaggtgaacaagatttgtcagggaaataacattataataatattgcagaagtttaacaaattctaagaatgtctataaatgtttaagacaattagtaatcactctgagaaaacagagtctattttacactttagtgaaagaaatttttatagctaaatgactgtaggtatatatatttgtgtgtatatttgtacacgtacataattttatattttatatatatatatatgatagatgatagatagattttttcccctttcaagaacaacaggagttaccaaatgcatcagtgaattctggctccattaaaagttttcgttgttgttgttaatgatctacttacagttacattggactaaggtgcgtctcacagggagctcaaatgtgactttggacccatcttaatatggactttgccattaattaggtctatgattaatttttagatcatttatcataatttgctggagcataaaatgcaaatttcagtgaaatctaaccataattgcttacaattaaattttttatatctattgtaggaaataaattcagcatattcttttaaattttttattactatttttcaaacacttttttgaggcatgattcatgagtccattcttcatagataaatgctcaacattccagggccacagggattaatagagactggtagagagagagtaaagtaattagcttaaattttgccatagatgctatgggaagcaagccattttcactttaaagggactatttttccatacttcagatattcaatacatatccacagtactctcaaatatgattccagggtaaaatgtaaggcctctaagccctaggtttcaaggaatgtatcttaattacgtttgaaccctcagtacttatttcaggcctagcacacagtggatactcccaaatctctgctgaactgaaccaggccatagtatcatcagaggaagtgatattctactttagagctaactgagacagacagggaaataaaaaacggactgcagattgtactgaagagagtgcctggaaggatgatggtcatagattacatggagaaacaactaatgtcagaacaagaaatcttatgatcatcatttgacctctaccacccattccccatgccagtcactctatatattaccgtcaggattattctcccaaaacgcaaaatcataacactattcaactgcttgagaacttacaataaaaaaaaataaattattcattgcaattatctttgtcttcaagcaacttaacaatttggttgcctagatagaaataacacatgatactttttataaaataggaattgagagaaaagtcaggacagtgtgagctaaactgtcagtagaagctgcctaatgaaggagggactggaaccaggtctatttatttgaaagaataaatagtagaggaggaccattccaggacaggtaagaaacaagcaaaaacacagaggtgagaatttgaatagtacattagaatagatacaaagatacatttggagatgggttgcgggtaagaataccagttttggctggaatcttggaagtctgaggcattttccgtgaaggaagtatttaaaaggatgctacgagtttccaggaatattcatgaagtgctactggtgaaatagatagcatttgtgatgaacctagggacacactgattcattcatttggtaagtgtttttggaacacctgctatgtcctaaccactagagataaagcagtagacagaattcctgccctaataaaacttatcaggggtgagagtacacaaatgataacaaaacagataagttagtatataataaaaggtcaagtgccatagcaggtaagggtctaaagaatgggagaatgtattctaaaatattaaaactttaccgtctcccaaaatatctagtacagacatgggcatgcaatagaaataccaggtgactggagtactgcctgctgaatacaagtcctggggttatgggatacagattttctcctaataaaacctgaaacaatcaatcagaactctatgaggtctccgatgtgcttgcctaacacataaaaatgcctgggcgcaacccaacctcacctaaaatgggaggatatctgggataggctcctgcagcatacaaagttggatatattgcagggttttcgaaattctttccacattatctaggatgagctgctgataataaacaaaaagttttcattaaatatttgttagataatatgcctatgactgctaggtgctataaagattaaaataataaaagatggtcatggcattgcctttcttaaaaaaaaatcaaacataaaagtaaacttaaaagtcaggaaaagataagtacagtaatgacatcaaaatgagcttggttttacaaaaaaaaaattgtacaaaggagttcaggagctcctgtgatatatgaaacttgaaaaaaggaaggccacttatataaatgcttgtgttttcttgagtctttgagatatttaaattctatgggagcaagcattatgaatgtgattttcaaattacaacacctaatttgttctgacccatccttggtcactggttgaattttttatatctcaaatgccatcctcaaatatgggccaatgtccacacagaggtaactttccatgtaaaaaattggcaggaacaagtgagaaagggaggtgcttacactgccctttctgtaggacgtatttgcactgactgagttaatgtttatgggctgtagatattcattgagacatagtatggggtggctaaactcaatgccctacaaagagaaacaaaaggaggagcctcgtccatcatattgccaataaagagcagtaaaattacttgacaatataaagataatactttgctttcccactgtgcttggttcttgctaaaatgttattaatgaaaggaactattagatcccagtaacaagctgtcatacaactactttacctacctaatttcctttcccactcacccataatatttcctgtttctatacagcagtcatttggactctacaatatttcaatctgtctcatctccattattggtagcactactccccaatccacactcctgctctgtgcaaaactcctgtctcctcattaattctatttattcaactccttcaacctttgtccagagggtctcttttcagatcagacattctgttttgtttgttaatttatagcttttgacatttattattatcttccaatgagacacagaaagaatataagaagttaaatgttttcacaagcaaccctagattcctgtgtccctttgcgggggaggaaaatagaaagaaataaaagctgccagatagaaggcctgaaataaatgacctgcaccacccataggcaaattctacctctttgtaaagaatgtttcataggagggaatcaataagagctgaatatgaaacattggtgcagtgcactagctaagttcagtgaactcccaagctaatcctgtgttctcagaagctataagcgccaatctcttcacctttgctcagggggatgagctcaccacagaaactggcctgttttttgacctcaaaatccagttgggacagggttgggggatggcagaagcaatgaaagggaaggtttccaggccatttgttctaaactgaggtgtgctggcagaagcgaaggacaaggttgagtctccatggccctgagctgggtcacacagctggaatcacactttgctcaacacaaacgtctttcactttttcattcacccacaagcaacacaaggactgcaacagaacactgatgagaagaaacaggcccagcgccactggtcactgtcagtatctaggctacctagtaaagcaacccccacacgacccggatgctaaataaacgtttacatcagctcatgtttccctatgactagctgatcagtatatcgaattgaaatataataaacaccaaaaggaatgctggcaggaggctcagtattttcagtttttgtacaggttttttgaaaatcacatcacatttgttccctttaatgatactgttgtcttacagaaaaatactcattcacgtattaaaatttcatcaccatatctaaagcgacattcctttttaaaacaacaacaacaaaaactaaaccaaacttactaaaaagccccaaatgtctacactgaagcaactcaaatgaaatggtctaatcataaaattaaacacattacagatgagttgatttgagggcatttagtacatttgagtatactcgatatttcagtttctttaacctacattccctaaaagtaacactaaacagtggttctgtgtatatgacacagtaaaaatgcatatatttatttctgaggctgtatattagctgattgtgaatcacccttgaaagtatgttttataaaataatgttcatgcaaattctactaaatgtatggtatactttatacaaatattaaatatgaagggaactggtatataaataatcaattgactagactatgcatttaatatgtatttcatgacataatattagcttttataggaatcactacttgaaaaagcagaccattaaactgaatttgagtttcaatgactcaagttctagttccttttaaatgtgtctggacaatctggttgtatcacttgcttctcatccataaattttttcttaccatttatgaaatgcttgttatgataaaaattattataccacatatacatttctattcccatcccaatcaccaatcgaatttctaaactatatccctatgatctaaaataaaccaattaaacaataacaaacaaaactttatgcatctacttattcatactgattacatatattatttttcttgccttgtctttaccactagtatattaattcttaagcccaagaactttgcattcctactgctctactccatcctttgctttaagcacaaattagaaagaatgtaaaccaacactataatttgtctcatgatagctccaagatggtctgatttactgtgtggtaagaatatctcctatcctgcatttcaatctccatccaggccttcaaataatactgtctatcagttaatatacagcattcccagttgaatatgattctctaacagtagcagacagaattgttctctcggtatcctgtggggcctaagaggacagtcaaaatctcagcaacactgtattttccttgcttctgtgccattctaacaatttcttcccctgggaaagcctcatcttttccttagatttgtgtttctggactcactgatgaatttagattctattcaaatgtgctcgcactgctatgttctattatgatctggaaaataactattattgttagcaagcaaatgttagagtttttattccactaacacatgctttgagaatccctaagttcctgtttatgactttgcagataacaaacaaaactataaagagtgtaactacttattgggcctttaaagacacgagagataatttattagaggacacgctcagtgttctgtccaggtggttgctatcaattacaaacagaagtcttcccaaatattcacttaatgaataaattgaaaggaagatcaaaatgtttttcatccacagaaagacctttgccacagcattgatatgctggtacttttgtcttaacattttggtctcttataatctcttgtttaaaagtcaacttttttatgtaaatgtctctcagtttatccagggtgattcttttctgttggaatgagaagcattatctctaagcatgcatttatgtgttgtttaattgggtgtggtgtggttgttggctctgtgataagaaagcgtcacagtctccgacctctagatgcttaaaatctaagatgaagtaaatatcccaatatattactgtggacccaaagcataatgggccatttaaaatcattctatgaacaaatcgactgtcattttgacagtactgagaacaacatatatcccttcacatttcagcttgtgttggatcattaggcacaagtttgaacaattccagggaaaacttacaaacacattttgaaataaaatttggatgtaaaatatcaagacttaacagaaacattttacagaatgatttacttcacaaaattatgtggtccgtacttctttcaaataacatattttctgctggatttaagtaagcttaattgacatgttatcatttatatagaaaattaacatgtccctgatttgtcaggtacaacaagaatgtacaaaggaagggccacatatactgcaggaattttaagctattctcttatcttttatttcagagcattcataatttttaaatgttgcaataaccttttgaggcaatactggtgacttcttcatttgactaaaacatccttgcatatcaacaattgaacaattgaaacactttaacaaaatctaatgtgtatatatataatattatatgtattatatatgaaaagtatgcatgtcataccatacatatagtgagatatatatatatatatacacatacacacacacacacacacacacatacatacttatgccatcagagaacatttcatttagattagtatgaaaattcaaaaaggagttaagtctcatttttatggagctacacccacaaatcccccaggctacacttagttaaaactctgaaagaaattttattctgagattgagctcctgccacatcacactgtcaatatccaatattctgaagctacaagggccagtgcccaccgatcctagtcccatttaaggaaatgcaatgcaatctaatgccagttctcaaagcacgtaagtacatgctgaaatcaaagatttaagtgaccatttattttgtcttgtatctgcctgagaaaaccctttgccagccaattttctcctattagaattagctttcaaagttagaatgtcatttgcatgcttgcagacaaagctaacaatttcaaatcatgaaaatgtgtattctcagatggtgaatatttgcttttttaagtacagagagtagaaaccgagctagtcttactagattttatatattgcttaaattaacggccaaaaaaagcctccaaggggtaaattgcctttttgtaatattacctttaatttcttttagcaaatgggatatgaggtttaagtgggttgaagaaaatcaagtaaaatatttatggtatacaattttctatggtcatatgcctaaaagcaaacattttgtggttagtttactatgaatgtaccagggctagcaagggagtcttttgcaagacagttgatttttagaaacgcttacaggttgaaactacaagctcctaataacatttaacaatcagaattgctttggagaccagcctatgttggctaacgctggctacttaggctctgcaaagtttttgtaactattttggcaaccaagtaccataaaaccaagcattccattttacatccaatgtgtctgtgctggcattaagtaataccaggagagtattttaaaggttcaaggtcaaatacttgatattccattgagtaaaatataaaagaaaatactgcacatcatctaaatatcctaaaaggctaagttctaaccagtataagtccacaagggacagaaaagtagcatgatgaaataaaaaagaacactggactgagaattaggccttgggcaaatcaaatccattctgagtctagcttctccacttcttcaaagagggtaataatactggcttcactgacctctttggataaaagcctgcatgtagaaatgcttaaaaatgtagacaatttaatacaaatattagataatactatcatttccatttctcctgataatcatgcagcaggtctctgaacaagacctgtgtactgtgttattcataacataacttgagaagaggtggtagtttttacacacctcctcccccccttttttctttacacttgatcagcttcagagatacagtcagttactaaactcctcagacacttttagcagcatcagaagcagctgccacttgcaaacctgtcagattccacagggactaaggatgtaaaaacaatgagtcattacaggtgtgtctgcctttttcattaaaagacaaaatgaaaagaagatgaaattcacccaactcagtgtttttaaggcagaaagtaaagagatcaaccaggaaatactttattcctttaattcatatgacagacattcaaatataacatagtaattgtttttaaatagactgttactgtgctgggtgctcccccagactacgaaaaagagtgctatctaacttcaaggaacacactgttcgagaataacaatatggggcataatggtagcatacaattaattctaattccaggtagaaccttggtgagacaagaggtagtaagaaggccactggaatgaacaaaaggaaggtggcaggatccttaaaaggtttaatgaaagagacagagatgacatttgagataattttgaatgattcctgggatcctggtaggagaaatatcaatgaagacagaaactagaaagagggatatgttcaaaattgagaagtctaagttgtttcaagaatatcctgctacagtttccctgtctacccaaatgtgcatatgtttgtgcaagctgctgatgttcgtttgttacaaaggtgacatgaataacctaaatttataaaacatctttaaaactggcaaataatacagaatctctatggattacaaataaaacatttactatacatgtaatcatgttttagaaattaaaaataaattaaaatatgcaaaacaaagattacatataatcccaccacccagggctattttgatttatgccttgccaagactatgtctctgtacctatatacatctacattttttttcttcttcttttaattatactttaagttctgggatacatgtgcagaacatgcaggtgtgttacctaggcatacttgtgccacagtggtttgctgcacccattaccctgtcatctatattaggtatttctcctaatggtatccctcccctagcacccctcaccctgacaggttctagtgtgtgatgttcccctccctgtgtccatgtgttctcactgtgcaactcccacttatgagaacatgaagtgtctggttttctgttcatgtgttagtttgctgagaatgatggtttttcagtttaatccatgtccctgcaaaatacatgaactcatcttttttatggctgcatagtattccatggtatatatgtgccacattttctttatccagtctaccactgatgggcatttgggttggttacaagtctttgccattgtgaacagtgcagcaataaaaatatgtgtggcagggcgtggtggctcacgcctgtaatcctagcactttgggaggccaaggcgggtggatcaccaggtcaggagaccgagaccatcctggttaacatggtgaaaccccatctctactaaaaatacaaaaaattagctgggcgtggtggcgggtgcctgtagtcccagctacttgggaggctgaggcaggagaatggcgtgaacctgggaggtggagcttgcagtgagctgagatcgcgccactgcactccagcctgggtgacagagccggactccgtcgcaaaaataaaataaaataaaataaaacaaaacaaaataaaataaaataaaataaaataaacatgtgtgcatatgtctttacagtagaatgatttataaacccttgggtatatacccagtaatgggattgctggatcaaatggtatttctgattctagatccctgaggaaccaccacactgtcttccacaatgtttaaaataatttacactcccaccaacagtgtaaaagtgttcctatttctccacatcctctccagcatctgttgtttcctgactttttaatgatctccattctaactggcgtgagatggtatctcattgtggttttgatttgtatttctctaatgaccagcgatgattagctttttttcatatgtttgttggccatataaatgtcttcttttgataagtgtccgtttatatcctacacccacttttcttgtaaatttgtttaagttccttgtagattctaggtattagccctttgtcagatggatagacggcaaaaattttctcctttctatacagattgctttgtaatgtggttttttcacttactagtatgtttgaataacttttcatgacattaaatatacaaaatacaacataaaatttacaatataattttaatggttccctgatgtactattgtatatgttgcccatcagtttattttatgagtctatattatttcttatccagtttacctttattttcttgtataaacaataatggcatggtcatccttttaaattaatcattatttcagctctgaatatttatttaattctaggattccagttactgggctcttctaaactgtcttccaaagagttatactgattttcattcttcactaatgggttagccttggtctactcatgttctttttaatgttgaatatttaagttctaatttttcttactactaatatttgaaaatatttttctttgaatattaattatgttgaacatttaaaaatttgtttattaaccacttttttatatgatatgaaatgactaatctccattaaaatgttacaagtctgttttgtgtgttttgttcatctttgcttttccggtaaccatcctctgggtatctttctcttaattaattgtaacctcctatgcatactacactaggacacattcttaggtttaggtgtttatccacacttagtgccatagactataaagggtctgagattttatactacttaaaaggtaacaagttaacctgctgcagttttatgaatgctagcacaaaattccagaatcctaggccagagatgaagttcattacttgtagcaaaagcagcagccagagtatcagcaattttttgtgctggttccataaacctcattttcctcaaggaaatgcaaagacagccatttggtaactgcacttacactgggttgtgttataagagaactctgagctcagagaacccaaatattttataatgggcagtaaatctgactgccctttgcttcagagagaaacattatatttattatactgaagaatatatgcatggagggaaaccctatatctgtgttccaaggccattcaggatacaaacattccttgaaatgaaagtctggggaaaaaaaaaaaaggacgtcaatgtcttgccaggcaaacatgcagaaatgcaaatgacacataggaaattatctccaagcgcttagccctgaacatgtagaagagaataaaagattttgtgaaggaaggaaggagagtgattcaaaggcattcagcactcaaacttggttccaaacttagccttacctgtgaaacctcacgacaacagtaacacaccagccaaataaaaacgtagcttctggtcaagctgatttctaaaaaccagactttctaaagaggttatataaatagtgacttttcactttataaagcaattctctacagaatctttaaatatcaagttattctggtatgattggaaagtaaattcatctaaaaatatttatgcctttttattcagcatattagttaatagagtatgctcaggatgaaactgcctcaattcggatctggctctgtgtgctggttgagttattcagcatgcttcagttccctctgctgtaaactggggatactgatggctattaactccatcctcacagaactagtaaaaggtgcttttgtcactgcatgatacataggaaacattcaacaaatgttagttgttattaattgtattactatcaccgaaaaataagtcattcagttgatatattttcttctgctcttttcctctatgtttacaattaactacaaaatgttttcttttcttgaatgacagggtagatgctaaacaaaagatttaccaaaatctaactctaataataaatgggttaaggtttcactcaaattataggttatttccaaaattaggagaagggaaaatatttttttaaaaaaaggatgatacactttgggaggccgaggaaggcggatcacttgaggtcaggagtttgagaccatcctggccaacctggtgaaatcccatctctactaaaaatacaaaaaattagccaggtgtggtggctcatgcttgtagtcccagctactcgggaggctgaggcaggagaatcacttgaacctgggaaaaggggttgcagtgagccgagatcatgccactgcactccagcctgggtgacacaacgagactctgtctcaaacaaacaaacaaacaaacagcaaaagaaaaggatgatgaattcctaaagctggattgtagcacctgcgataacttctttatttctatacttttgtatagtgtgctaacaaagaacccaaaaataagaaaaaagaaaaaagttgtataacatttaaaggtctgtaacatactattcacttaacacaaacaacctatgaagctcagggatagagtattcaaatatttgtggggggcagcagagggctgcatggcattcctctccagaatgtaatcattatttctgggttatggctggttctaaacctaacagtagtgactcatccttttccagagattctgaagtagatggaaaatgcatacttgaagaaaaggtggtgaacaaagagagagaaagactaataaatggtggctctattgcaaaggcaaagctgttgaacaaagtgggggaaatgagagaactctgtgcaaactaactcatagcattttttaaagcttcattatgtttctgagacttgcgctctgataatgtgtaaagaaccattttttcccctttcaccaccgccccattctgttatctgttacgtctatttcatatttgagacagatgaattttggaaaagttatgtaatttggtcaagatcatgcatgtagtaaacaatacatttaggattgaattctagtttaaaaaatcagtttttgtgttattttcactgtagtaatatagcatcagctgaacttgaattccagccaagtgcttgttctcctaaagcctacatcgcaatctactgaaataattcttggccaacccaagcatcaaataaagaataacctcaccttctggtgctcagccagcatggggattctgttaaattgtgggtgtagctgatattcttggttacctggggatccttctgctaattttggaacatatttggcttttcttaagctctcggtctgtgactttttaaactattcagctgtatcctggctatgtccatgtcctcagagaataaaacaaaatcatagatcagggtattctttttattttgtcctggacactctcattccccagataaatcacaggcacagtcataaatctatggaaaagaacagtacaatttccactggaaaggcattctctatcttttccacattgtatccactattcacagtgaattgctactaagaacatttttctctctagtactctagctacataaaacacttggtaatatacatactagtttattgttcttcacaggcaaacatagtgctacttttccaagtgtgggaataactcattctgaaccactggtcccccaaaggcatatccatatcccttaccttggctttgacaggaattataggagtaatgtaactattatttggtaagaaagctgatagtaaaccgtgtcttctccttattcctgaccctgcgcttatactttgcctagcctcatatttaaagaataccttccacttttctcaaagctacaagtaacaaatattcaacacttcacagagtcaggtccagcaatcttctgctgaggtctaaaaccttgcaaaattctggaaaatggtatccaggtaatattgtggttttgttagttaaaagtatatctgagtatatgtgtgaatgtgtatgggtgggtatgtatgtgtgagacagattggaagtttcttcaataaatatattactttgagtaatatcaggaattgtgctaggcactagggttataaaatatatcataaatgaatcgagtccttaaggaactttgcttgttacacttttatcaaagggtcagatggagaaaaaatgcttttactatgccatcctgagtactcggatataaatgtgcacagggtcctgtgggagcagagagaagggtgatttggtttccagggacaagttgtcttgaaggagatggcagtagaagcaatgaatgcataggagtgaccctggagaagaagaatgtggaggatgttgcaggtagaggaaaagaaaagcatgaaaaaacatggtgagtatgaaaaaacatgaaaattcattattattaattaaagtttgggaagggagtggtagagttaaggctcgacagatattatgatgaagacattatgtaagaccatatggacataatcggaagcttaaaatttaacctgtaggtaatgaggaatcatcaaaaggctttatggctaagtgtggcaaaacagtttgccattgaggcaagctggtcaaggatgaaatggggttaagatcctaggcagggaacaaattagggagctaatgaaagagacagtttccagaagatatgatgaggacctggacaagggtgatggtaatagtgaggacaggaagatccatagtgggggcactgtatacacaatgagatcctctctccaggggcgtctgaaagggatatccatgtgagggttatagatacgaattggaataaactgtatcctccccaaaactcacttattgaagccctaactcccaatgtgactgtttttggagactgggactttaaagttgtaattagagttaaatgaggttataattatgacaccctaatcccacagaatgtgcctttccaagaagaggaagagacactggagctttctctctctgaggacatacagagaaaagaccatgtgaggacacagtgagaaggtggacatcagtaagccaggaaaagcggcctagccagaaactgaccatgctggtacctcgatcgtggattccaccctctagaactctgagaaaatacactttttttttttttttttttttttgagacggagtctcattctgtcgcccccgctggagtgcagtggcacaatctcagctcactgcaagctccgtctcccaagttcacgccattctcctgcctcagcctcccgagtagctgggactacaggcacctgccaccacgcctgggtaattttttgtattttcagtagagacggggtttcaccctgttagccagaatggtcttgattccctgacctcatggtccgcccgccttggcctcccaaagtgctgggattacaggcatgagccaccgtgcccagccccacacttctgtattttaagccactcagttggtgatactttgttatggcagacccggctgactaatacagagggttttgttgatagaagtaaaccctaaaaaacacataaagagaagcaaaagcactgagagaaagtctgaagaagcagaaagccaggagcagacaggtgagtagagcaggagcttctgcttggtagttttgcaggatgaagcagaagtcacgtgggttccctgtagaagggagttctaaagcatgtaatgatggatttctgtttctgaggaggctattctagagttgtgattggatcagccaaactgttgtccaactactattatatcctgaatctattttcattcctgaagtctgtgtggtagccaagtttgtttcttgtttgccttgcttgccaatgtggtataacagccacgcccccaccctcctctggcatcaactggaataggccttttcacttgcactctaaaactgccaaacatcaagagtgggaggaagagatgtcaggatgagcagaatgcaaataatgactgcagactccagaaatcttgggatgagatgttaactatccaagattttatttaaaaaatatgaactgtaatacatatataaaatatgaatattttagccatccacattataataccagaaaacctcttgtgcacataatgagggccatctatgtacgacaggaagtgtggcatgatgccgtctctaaatgaagaggggctctttttaaaaaggcaccaaaaaatctgtttttattcctctttatagcaaattggcttagtttaaatgccagtctataaaaggcttcatccacactctcagtacctaccagttgtgaagaaaagaatgaaggaaaccactgcgtgcactttttttctcagcacctgccaacacagggcttgggttttcggacggaatttcataaatggaacaaatgaagactaatgatcctttctttatctctaagccattatagcgccatcaagtggaagacaagattataggatttagacagtccttgcagaggaactggtaagtagattattcttctacctgcttaaggatagtttcaattttgatccgagacacatctgtgtgtgtctgtgtgtgacacagagagaaaccgtgtggcagttcctcccttttgtcttctacattaatgcattccacctgtgcttttaacatccagatgctatcatattttaattatactgattaatgcccgcataagaattacaaatggtaaaccaaccttccctcaaattagcttagtcaatctgtttaaaggcagcacagtgaaatagaacaccaagctaataacatataaaaaaatggaaaattcttcatttgtttctgtttgagttcttttaattaaaggtgacaaaacagccctttactatcagtgcagcaaatgcaatatgcaaagatgaatgcatttacagctgtagcttgcattgctgttttagcattactaacactgttgggaaaacatctgtgaaaaataagatgacagggaattctcatgataaaactggaaagagatgtcaaaagaaatattgccatctccatctttggagagcttcgtgaagaggatcattgtgtgctctagttgctctgaccggagattccaactctaccctgaaatatcttacagcatctttaaatatctctctgatgggtctctggcaaaacaaaacaaaacaagaaaacaggcagggcgctgtggctcatgcctgtaatcccaacactttgggaggccgaggtgagtggatcacctgatgtcaggagttcgagaccagccttgactatgtggtgaaacccccatctctactaaaaatacaataaattagccaagcatgttggcgggcgcctgtaatcccagctattcgggatggtgggacaggagaatcgcttgaacccaggaggtagaggttgcagtgagccgagatcacaccattgaagcctgggcaacaagaccgaaactccatctaaaaaaagacaaaaaacaaaacaaaacaacaacaacaacaacaacaacaaaaacaagaaaacagaaaatcctttaacctaagttaccaagtaatttaaggtgaaataattttctccttggccacttcttgaagaaaagaaatatgaaacatgtattaaaaaaaaaaaaaaatcagggctttataacaaccctgaaaagaccaggaaccatgagttagttgtttttcctgagtaaggacattgtgcagccgagaggtaaggactgcttttggcactggtgacctgccctgaggctttttcagtccatgattgccaattcttccatctaaaaatggagatctcaccacttctcagcatgtcataaggattaaatggcataatataaatgaaagcatcttgaaaatttttgtatattgacctattgtgagtctgcagagataaatatcccaaaatatttttgtgctccaaaatatgagaaggtaaatacggctttacaattccagttttctatcttgcctgctttattatcttcccctcgccaccttttttttttttgagacttgctctgtcgcccaggctggagtgtagtggcgcgatcttggctcactgtgagctccgcctcctgggttcacgccattctcctgcttctgcctcctgagcagctgggactacaggcacccgccaccatgcctggttaattttttttgtatttttagtagagatggggtttcaccatgttagccaagatggtctcaatctcctgacctcgtgatccgccgcctcggcctcctaaagtgctgggattacaggcatgagccaccgcgcccggcctccccactggttttaagcactttaccaagagctttctgttgagactgcatcaatgtcatgtaacaattccacacaaaacttgtttccatgagtctgacgcttctggacaaggacaaggtcatcagttttgggtgataacttctgtaatatcataagactattgtttctaaggtacctactagtggcaaatgtgtgcatgtgcgtgtgagagagagagacagagagagagagagagaaagagagagacagaaaccctttcgagaaggcctccttaaatcagggataaggttatttctgagaataagataaaaacctaaagataccagtgatggcaagcttaactgtgtgcctaatatgcaccagaactaaaccttagaaaacaaaactgaataaagcatatccctacctataaggagattacaatgtcaaagggtaaaatggataattaaacacagtaattatcacataagcactatgataagggtaaccgaggcattgagtgatcatggaaggtttctcaataaaggtgctacctcgtgtaactccttgatggatgacagggagatggaaaaacatgaggagtaggacagtaagaatgcaaggagcaggaaatggattgggggagaaaagggagaccaggaaaagggatggctaatgtaaggcccgtaggtccaaacaaaccaaaacaaaggcatattaaggaatttcatatattccagaatggccaaggattttaagtgtaattttacattgtgtatacattttcatatttctactatatgcatatagacagctacatctttatatacctactgcttggacccaaaacctgattcatggctgtcagttcttccacatataggcaacaagaaaagggcaaatacaacatgcctgcaatgctcaaacggcttccttctgttaaatgcaatcatgaaatgatacggcttaacataaactcattgaagcttcatctttcaagcacaatgtaaagattctagctctattcaatctcagctacagggcaatcacaactgtaactaactcctacgtctttcatcttttgacaatgaaattaaaatattgcttcatgctatagtaggaaagaacactctaaaataaataatcccaaagttgaaataaaactgaaaataacagcagtgtctttctgagacagtggggcagcaatgttaatgaacggaagctttgctacaaactgaacaaacacgcattgattttgaaggtatacggaaagacgactcagataagctatagacatcagaaatttaagaatcaaagccaaaatgagacaatttagacaaggggcataactatttttttttaaaggtgggggatatgcagagaaagtaaagatgaaagttagcattcacttgagatactcaattacagaaaagtcatggaaatcaaacatgcaagatgtttaatgcacagagtgagatgaagaaggatcatttttaaaccttaaattctccctgctcttagtttggataaagaggaattcctcaagtcctacgttttcaaaattatgtctcttaaagaattagtagctttgcaaatcaaagcaggattggctcttatcatctcagtttatctctgtcagtgctcctggtggtggtgacatgctggcctctcatatttctgtaagcctggccctttggattttcccacagtatcagcctaaaaggccaaggagttgtaaacctgcttttaactctccttattccctcccaccacacacacacacacacacacacacacaaacagggtctacctgtcccatggcttccgaattatgaaatgtgccccattcagttcttgcaactcttcccacttatccactctgttcatcctctctggggaatccaatcttgacccaaagagaccaagtaatctttaaaatcagaaactgctttaataactcattagagatagatgaccatctcttatatcacttgagtctttcctttcctcaggcatttctagattttgggtcaccaaaacaacccaacagccatccactcactcctctctacataaacataaataaaatcaaaaccaaaaataaaagcagccaggtgtggtggcaggtacctgtaaccccagctactcaggaggctgaggcaggagaattgcttgaacctgggagagagaggttgcagagatattatttctagagattactatattatcctctgagaaaacacacctgcttgtcctttggaagcaaaaccatagtgtaaaatgcaggttgagtattccttatctgaaattcttgggataagaagtgtttcaaatttttggtttttttggatttcagaatatttgcctatacataatgttcacatgggaaatctgggcatgagcagaaaagatatatcacaaatgaggatgactgggagggttttcttccccctaaagaatgctgaataaactgtgtattgtgtgcttgtattttgaccgcaactcatcacattaggtcaagtgtgggattttccacttttggcatcaagtgggtgctcaaatctttggattttggagcacttcagatttcagattttcagattagggatgctcaacctgtactagtagctgatttttaaggtttcctttgttggtaatttttatggaaagaagaaaatctcaacagatgaaataaacagcaactaaaagtggatttatgttgtttttttttttcagcaataagtaaatgcaatcaaaatgttttttttttttaaaaaaaaagactgtcaaaagtaacacatgtaactaagagtgaaatctttggagagttagactttatagctccaagtgaatgtaaatgctttactaacagtggaattggaaattggataagttcccttgagatagaaatagtcaaaatgctacaggagattccaaactgcttgctacaaaaaaaaaaaaaaaaaaatccttagctttgactataagtagatctctagttcttctccatacaggagatatgtggtcttccatcccagggagaataatggttaggtttctcaactctcataacagaatgtcaacatcaccatctgctcatctggctttcaaaggatgcatatgggctcatcttctcgcccagaatctcctcttgctttggggcttttcccttcagtttggtctttagtatgtactcctaagtttgccaaatgcacactggagatcacagaagactttgctgaagaacagcccagtaatgagttgaattcttatctattcagaggtttccgtgaaaaaattcctctgcagcgtattcaaattgtatagccgcaattatactccctggctgtggtaatttaaacgttattttaaaattaaggcctttgttaataaatactgtttgcttaaaggttaaaaggtagaattatacccttcacaccaaattgcagtctccatgggtccttatctgcttgtattaattcaaagagaagattctgggtgtcatctgccacttagagcctgaagtaaacctctaaaagcatacatttctgttgttgtttccattctacatgggcttaaagtatgctttagaaacatacatcacaactgagatgtgcgtgggcattatgaatagttaagcaggagtgcagaaagcaatatggacagaagaaacaaaataatttcctaacatataaataaattcaaaacctacttgaaatgtagtatatcggaagaacattagtcagggtctctataactaattagctttgcgactttgggtaagacataatctctctggatatttatgtaaagctagaattatgtacgagaaaactacagtttagaaggaaagaaagtaattacaaagtaaagacattgaacataaatcttgaattttaccattaattgaataatggaaagaaaatacagactatattattaacttttatttgtctattttctctataaaattttcaatccatgatttagagatcatgtccatcttgatcaccactttatctctggtgtctagtacagtgcagactgaccatttaatatattttgaaggaaagaccaaatgagttttaaacatattatctaatactataatactcttatggtctcattcttcagttatttgctaatataatagatgcatttgtatcctctgtaatataaaaataggaagggatggtattggttgtagttgaatatttaatgggagaaagttaagcctcaaataagaaatttcctgaaatattaccaatgagaaaatgggtataaaaccttccattttaccaaaaacagaactttttttttatcacaagagaagggtaaacggttaattaaaagcaaattagatgaaataagatgatacaaagaaggtatcccatttaatgaacatgttagatactttagagaatttatttaaatttctgaacaactctaaaaaataaatccaatattagttttaaataagaataaattaaaacatagaaaagttaagtgacttatccaaagtaacataagctgtaagcagaagaattgagatttgagcactgatattactggttctaatgtcagttctttttacagtatccatttcacattaattgatagtctaccaactaccagatgtttcactgagcactctttaggaaggaagggaaattaaatattggcattagttaacgagagacatttctttccaccgagtgtaagtaataggatgaagatacattttgagatgatatgatttatccagaagaaaaagcaaagtttgttagaggtctccaatctatgataaaagcattgtgtaaaatacaagaaaagtaaatttcttaagagtaatgttagatgaaagcccatcatagttaatggtataagtaaaactgcattaattgtcaatggtatgaaaatgttcagataaatcatgccaggataaaacagagggcttataaacaagtcttccagttgggtggtcatcaaaaatgtatgaatatccactgagttaaaactacttactctttggctttgccatcttcatgtttagtgaagggaagcagggcgatttttggtgtaacgttccgcttaaccttcactaaagggttaatcaagaaccattactctaaaaactcaaaacaattctgcaagcctttataatgcctagtttatcccttaattttattatcatgggaattaacagaaaatcctcccaatacaaaataaagtgtgttctttcaaagatatacagaaagaggcagctgaagagatgtttcttcctcacattagccttgggcagggtaaacagaagataaaaatccaaagggacatactgagtaagaatagccattgaatgataggaagaaaacctaaattccttggtcttgtggacaaaatagaaacaggaatgcaaaaagagcctggaacccccagaggaccctcagcatgagcagcagaattatccacaatgattctcatgcatttgtactttttttaatcagcaaaatttagcagcttatatttcaatgagagacagcaatgttttcactggggggcaattctgaaccacaggggacatttgacaatgtttgtagacatttttgtttgttacaagtggagtggtggttgctttgggtatctattaaaaataggtagaagcagggaagccgttaaacaccctaaaattcacaggacattccaccacagcaaagaattaactagcccagaatgccaatagttctgaggctgtgaaaccttggagtagaaggagaatcagcatcaaaccctttttcataggcatttttcaggtttctttgttacatccgactgaaacaggcttgactagcaaatttcaagagtgaccttgtttcaaggtgcatcatttgtcggcatcaaattcacatcctctttcttatttaaaatctaccattagttatttctccctcaaaaggcttctacaatttaacagtgaggacatgttatggctgtgaaatagatgtccctatcatactgctttagatgggaaaagaaacattctgcagtgtttataagtcataaagaattctaaatatctcccactcaacacattcaggcaaaatgatggtataatttctgtgctgggtagcactctttcataccattatgtgtcgtgtgaaccaactgtaggtaatgcactatcttcctttaatcaaatctgcattgtaatttctataaaaaaaatcaattaaacacaaggagcaattacttattttttatcacagcataatttactttcccagaacagcagcatgaaaatgtgaagaaagatctcatctacctcagtgtatttaaagtatgcatatttttaaataaatgcgaatggaacactgtcaaataagcaatatattatctctatataattccccatttacatcaactttatggatgggtaatatggcttaatagcaaaagcttaagatatctttttgaaacacaattttttcatagtcaatattatggctgaaaacatttttcagactcttacagtgaaaatataattagacaacaatttgctcatcaacctcatcaaatcactttcataaatgacctacttaggtgtcaaataaacctaaaagaactatattttttccaagccttacaaatccatccttgtttacatttccctacctatctctgtgcattactatcaaggaattttgttaactacatgcttagtagttagtaggagatcatggagctaatctagcatccttacatctgggacctgtagtcttttcagtgaaatctattttacactgagcatcaggagttttttaactttatgtagataagatttacctggagggtttggtaagtaggtttggagagcccccacatttacattttaacaaggtctcatgtgatgctgacgcttgacccataggtctggaaactacccaagaatttaaaagacccaattttcttcatgattcagtaatctgtatgtgctcttaaccactgtgtcagcggcatcagtttattttttctcccttacttttatgttatcaacctctgtgctcatcagttaaactaaaagatcaatccactccaacctggaagattgcattttctttccttcttttcttgcctcttcctgctcctccctttcctttctttctcctcctctttcttctctccctctttctctctctttcacccccttcctcactccccaattccctccctcccatataattctgtaactctgatctctttcaaatccagatgtaaatctcactttggctgtgaaatcatctctgatttaccccagttgatacacaattctcctccatgtggaactgctcagtacttatgaactcacttttattagacttgtttgtactccttgcttcattaattagtaaattaaagcctttgtgtatccctatggtgcatggtcttaattatattattatactatttgttacatgcattttttttttcctttttataacaatgcctgctggaatgattggctcacaatcagtgcataataaatattattagcccaataatgtactgagtcaggggctgcaaagcagtatttcatcacgcaatgacccaaggttcacaagaaatctaattagtgcttcaactaaagccaccagtcaagtctgggggaaactggctccaaatcacaatgctgctttagtttcctcagtagctgctgatattatcctattaatgggggaactttatggaagaattattaaataggcttggtctggttgctaggctgtctgcgtgactataacagggattctcagaagccatgttaagcatgttcaaatactcctaaaatggctgctggtgatagagaaagtagaattctccaaagttaatttttatacttctttaaaagcctggtttgctctaaaggaactcataaatgagacatattttaaccacttcatcatatttgttggatcactctgttctgaacataagcaattttggaatgaaggccttctggccacacgggtaatatatgtgttgcaaaaagtgggacaccatgagaggtatggaatgaatgaacccgctctctctctctccttctctctacttcaccactcccaccccaacggccccatctaagatctggatgactaatggaaggttaattctctgaggcctaaaggaaaatttcacactttctcagtagttcaaaagtttggctttcccctaagtgataacatacaaatggagtaacagcagaactctcaacattaaggagtttctgtgaaggtgccaaggcatttatttaaaagttgctaatcagatttcaaggcccaaagtcccggctccctcacattagtgatcagatttgttaactttaatttttcataacaatcccataaatttatgtgtttatgagttttttagtattttagtccatttgggctgctacagcaaaacaccttcagttggataatttataaacaagagaaatttattgttctcagttttggaaactaggaaatccaagatcaaggcaccagcaaagtttggggtctggtaagagtccagtctctccttcaaagatggtgccttgttgctgcattcccagaagggaggacactgtgtcctcacatggcagaagggcaagacagctcccttcttttataagagcacgaatcctattttataagtgcagagccctcatgacttaataactttccgaaagtccccatctcttaatactatcacattaggtattaggttccagtatatgaattttggaacaatattcagatcatagcaattagtttatttttaaatttttttcctgattggttcataattagatttattgttatatggaagctgaggctacagacttttttcctctgtatcatagacaagatattagaaatgcagcaacggcatttgcaaccaatatccaggtgtagacagtagttctcaatcactggagatattgctccccaggagacatttgaaaatgtcttatgacacacttgattgtcacaaagatggaggggaggaggaactctacagcatctagtgagtacaggccaagcatgatctcaaacattttaaaaacacagaacagcattcccaaacaaaaaatcatccagcccaaaacgtaaatcatgccaatactgaaaaacacggagctagatcatgggtagactttggagacaggttaatgtagactcttctacatattatctatgcaaactcgggaacactaattaaccctaacacctcaatatcctatccataaccagggtttagaaattattccagcgcaatctctggaaaggaccgaatgatgtaatttatgcaaggtacctatttcaatgtcagatacagagcaagcactcaataaatggtagccctggcatatcacaggcactccataaatgttagcttcccattagttcaaatatattttgaccagaagcttctcctagagaaactgtcattctaagacaaactaacttcagtgaaaatgtccagaagttcccagtgtaagctaaaagaacagttgtcttgtacacaaatatttaggtgatcaggcttctctgctcacataactcaactatttaaatatatatttgatatttgttatttgaggcgggctggtagaaattgtatgctaaaagtagatatttcctatgattctgtagaatatttaccaggagaaggaaagagaatgcttaattattaggaataatcatccaataaactgttcacttgaaagaaaggaataaggagaatatgggggaaattctagttatatataatcacttaggaaactccaatagcagtaaaagcattggttaatatagttgttatgatctcgaaaatgcagaccctcaaaatcccaaatcaatattttcctcaatagtcaaaaagcagaatttgtttaaaaattattttgtataattagaaaaagcttctacctttcttaaccagaaattgctttttaagtctgctttttcaagtattagagtactcataaatatttcagaaaagccattcagtttcagcaccacatgaaaaaggaatgataactttatatgtgtatctctgattcaggacacattttctgaaccacccatcatattccatggacccttaaaattctctggttcagcaagttaacactgcccacttcaccttaacaaagaaaataagaaagctttaggaggcaaatttaaagaaggagaacattctccctgcaatataaagaccatggaggctatacgctgattgatatttctgtacaaatgggtaaagaaatatcagaaatgggtacagaaatatcagctactctactaaagtcaatgccgtgtctcaaatgctgcaaaattacagcagtctgtatcaattctcttttgagcaatagtttacaaagccattcaaaaactgtttaaatttttattaaattcaaattttaacctttaatatcagcagattagaagatcttgctaaaaaataatttgagaagcattttctacataggcacttgagttattggcagcaattgctgaaaagttagcatttttatttctctgttgttataatgtgtctaaatattaggttggtgcaaaagtaattgcagtttttaccattgaaagtaatgacaaaaaattcaactacttttgcaccagcctaataatttggtataagctgtctatctatatgtgtatctaccatctatctcagtatcctctttcttgttggacatgaaaaaaataatataagctaaatttcctctgttcatttatatatgccgtgggatgatactgcattggtaaatgaattcatcggtcaatggatgagttatttgtgtactttgttccatgaagacatattaagtttcacctaaatctttcactatgtttggattccagtacaaagtagtttttgagatttgagaaaggacaacaatttaattcctatacagatggtgaaattgaaaggcagaagaaacacctgcattttggagagatggagatgagccacaaagtagagagtcagagtgtgtgagaactgtccaataaagccacccaaaatctgaggtgggctgggggatgtgttcagcacatagtacagacaatcccctaattacagttgttcagcttaggattctgcgaccttatgatggtaagaaagtgatacatattcactagaaaccgtacgtcgagtacccacataaccattctgtttctcactttcagtacagtattcaataaattacatgagacagtcaacactttattattataaaataggctttgtattagatgaatttgctcaactgtagcctaatgtgcgtgctctgatcatgtttagtctaggccaagctatgatgttcagtaagttaggtgtattaaatgcatttttcactgggctgtaactccatggtaagtcaagaagcatctgtatttgtttagaaaatacttggattcaatttccaactctaatcttgtgacactttaagacatcctcaattacaaacacacatacacacacacacacgagagagacagagacagagaaacacacatgataatttttttaaaaattaaatgtacttaaatttaaaagatgctgtgcacataatttgtggaaataaatgagagaaatggtttcacaaaacaaatgttgaagaactgtagttatgcaaaaagccaaaagtcagtatttcgtgacatactctttggcctctaagcaggaataacgcactgttttaatcttgtcattttatccattttattttgacccattgcttatactgagttcaaaggtattttgactttataatttttctattttcaatttcattgctgatttgtcaggaaatctctgaggagcccagttttctcctttaactaatagagataagaggatcactcttcccgtctcaaatcatcctctattcacaccaggttaagcctcactatctatatttacattgcactttgcatttttttctatggtacgtttcataatttgaaaacattatttttgtactaatttatctatgagcgattataggacatgttgtaggaaccatgggtgttttgctaacagatgtaggccaagtcaatgagttgctactgcctaactcagtgtagtcacctatggaatagctataaaatgaataaattaataatgaattttttttttaagacaaagtttcactcttgttgcccagaatggagcacaatggcgcgatctcggctcactgcaacctccacctcccgggttcaggcaattctcctgcctcagcctcctgagtagttggaattacaggcatgcaccaccacgcctagctaatttttgcatttttagtagagacggggtttcaccatgttggtcagcctgttctcgaactcctgactttaggtgatccatccgccccagcctcacaaagtgctgggattacaggcgtgagccagcatgcctggccaataatgggattttaatagcacttgttacaaaaatcttcatttttaatgacatttggaactattttttaattcttaaattgtctaacattttatagtaaactttattttacgtcactttctaatgtacgcaagcataacttcagaatttactgagattttttgaatgacttctattaaactaatttaattgcataattttctacgtagcaaagttatttttttccaatttttaaatttctctgattctttaaaattagcattatcaattattttttatgcaagtttataagaagcaactgattcactaatcaggcttatttatgtcaaagtttctaattatttccaatatagtgaggtttttagcttaatttttattagcatttctacaaaactcaatttttctgagtcaaatcactcagattctatttttttgttcaggataaaaatgtacctatgacaagtagtattgggttttataaaaccataatttatatctgatgattatgtcaatctgcaatatgtattgtgaatcactttatttcttggagaaaggaacagggtaaaagtttcagactctgtgaatatctcttagagaaaaaaatatcatagttacataatgatgcaggatctgtggatataataaggtctaaatggcaggactaaatgcgaggactaaagcattctatgcttccacattatacctatgacacaagctttgatatttaaaaataaacaaaaacaaacccagatactcccaaaatatgcacaaaaaacttcagcttttataagaaaaaaagcaaatatcagtttatataataggtttcctaaatgttttgtgagaatctagtttttgtataatatttatatttgtattttcattatttcaaggctgggtttgatgtattggaagcaagggcacagatttggtaaagcagtgaatgcttccaaagacaaaaatttatttctgatataacttttgaagcaatgtgaattttcttctatcaagtttccttaaatcgaaatcaaactataacaatatcttggtttctatgggttctctgtcatgtgcatcctcaagtatatgtgaccaaaggtttttaagccataatatcactattatatcatcacctacctaccataagaatgctaaaaattgtcctctttgagattttgatagtttaatatttctgtgtggaaaaaaaatcaaacccaacaaaagaaaataatatatgataaagaattacaaggccttctatcccaccacttgttataggtttaatggtgtggccctcaaaaggatacactgatgtcctaaccctcagtgcctcagaatgtgaacttatttgaaaatagggtcttggctgggtgcagtggctcatgcatgcaatcccagcactttgggaggccgaggcagggggatcacctgaggtcaggagtttaagatcagcctagcaaatacggtgaaaccacgtctcaactaaaaatacaaaaattagtggagcatggtggtgggtgcctgtaatcccagctacttgggaggctgaggcaggagaatcacttgcaccctggaggcagaggttgcagtgagctgagatcgcaccattgtactccagcctgggcaacaagagtgaatctctgagaaagagaaatggaaggaaggaaggaaggaaggaaggaaggaaggaaggaaggaaggaaggaaggaaggaaggaaggaaggagagagacagagagaaagagagagagaaaagaaggaaagaaagaggaaagaaaagaaagaagggagggaggagggagggaaggaaggaaagaaaatagaaaatagggtctttttagaggtaaaatcaagttaaaatgaggtcattcatgtgggccctaatccaatatgattttttgctctgactaaaagaagaaattgggacaaagagatagacacacacagagggaggaggatgtgaaaatacgcagagaaaccatgtgaagacagagaactggagaaatgcatctgtaagtcaagaaatgcggaagactgcctgcacaccaccagatactaggaagacacaaggaacgatttctctgcagatttcagaagcagagtgaccctgccaacatcttgatttcagatttttagcctctacaactatgaaatgatagtttcttttgctgtaagtcacccagcttttggtactttttgtggtagccctaaacaacaaattcaactctttttccagtattaacagtagtaaaattaaaacaaggataataagaaaagaaaatctacttttctgcttactcttataaaatctgcctagcactcatttctgctgatttgattacatttacatacaattttaattaaagaactactaataaatgtttcaattacaggaaaaaatacacttaatgaagaaattgtctatgatgatgatctgagaagccttttcagaaaatgttgttgatatatttatttttcttttctactattacagagaagactggaggagaaactaattccaagcccccatacatgatcaactgagtcataaatccttccccagtgtaggtgagagttcacagatactactctcataatctctctagtaagtctttccatttctcaatcatttaagcagtagaggacactgtttttatttctttgcattttcaatgtataaatcgtgcaataacacattgttcaattttttctaagttggtttaaatgctgagaattctcctgagttctcttccttggcagaaaaaataaatttctggaatattttcaaaagcatatccttgcaaatggaaatggtaagcttaataaaccatgctgtttgaggtcagccttgctgaatattgctcctcatatcatctttagttatataaggtcataagggatacttacgttcaagatcataaacaaaatgttggtgtagctcagcaatttcttttctatgcttaagaattattttcaaaaacaatatcacttttaacatacttctgattctcttgatgataaccccaggctttgatagtttgtttttcttttcagcttttgcactgggcctttgacatatgaatatacctgtatcactctcataaacttcagaagctttgttgcattttccttcaaattctctctgggtcaacacttaaagtataatccattaaccaagcccttgcaatatccacagtagaaaatgaagataagtaaatattgctgtgattcttttactgacattttttccaattcttacccctttcaaacagcgaatcagttctcgaaatgaaatcaatcttgtagacatgattaccaattataaaaagatgaaattttcaaattttattaattggatcaatttttagtatcattaagattaccttgctttcatttacattaggtgaagttatggtatacaatgacactaataagcaaaggcgagtttaaaataacaagagctaccatttattcaatgtggtattatgtggaaagaaacagtacctgatgctttgcaagcattatcttgcttaatttgcttcataaaactatgaaaaacatattatttcagttttataggtgagggatgtaatcgctagtacaatataggaaacacatgtcagagccaagatttgaagttgagtctctcagactccaaaatctgaaactttttcaaatatgccgtcttgttttccacactgatgcttttgacccttgccataaagtcagcatgacctctttgacaatgtgaatacagttaacactgtgcactttgaacaaaagaaaaggaagtaaaaggacaagaccattttcaggcaaaatgaagaatatgcaaaatgtcccctttttttctttctttttgctgatttccttcctaattccctcctcactactcccacctctaagtcaaaagctttttcttctaccttcaaacatctgcagctatgctatttcttaatttacctatcaaaaccacttttctctccaaccactcttcccttctcccaatatacttttatatcagtagttgttatccaatgactatgaatttaagtcttttgtttctttgggaacagtgtgtgcatgtaagaagaagcagtacagtataataaagaaggcaggtttgggagccaggctcttggctgcatcactaggtgacctttttgtagcctctttgtgcctcagtttcatcatttgtcaagtagtgcctatcccagcacttactgtgggaattaagtgaagtgattagaacaatgcctgccacatagttggtaatatatgtgttagctgttatccaaatgtatctttcattgaattaaaaatgtaaataaaatatgtcttctactaaaggaattgcacaaattaccatgaaaaagtaaaaaaaaaagtattgggattttgttttattacacctctaaaaacatattacgtgaggactttagacatataaggttacttctatgaagaaacagaatggaaaatgtcaagtcatttaagatgctcacttattacattaaaatattttccaggcaggtgtggtggctcaagcctgtaatcccagcactgtgggaggccgaggtgggcagatcacttgaggccaggaattcgagaccagcctggccgacatggcaaaccccatcattactaaaaaaatacaaaaattagctagatgtgatcccagctgcttgggaggctaagtcacgagaactgcttgagcccaggaggcagaggttgcagtgagccaagatcacgccaccacactccagcctgggtgacagagtgagactctgtcaaaaggacggaaggaaggaaggaaataaaatattttccattgattacccatgctttttattttgaattaatagtgttcgatgcattattaaaaaatagaatttaaaataaattgtagaaaatatggagagaaatatttatgtttcaaatttcccaagagtagggctttggtgcattataatcccctgatagctggcatgatccactttgttggttacttttacagggtccttctactctcttccttagtctccaggcttttaataatcacacagaatattcttttcactacagaacatacctacctatattttggctgtttctcaagctgacttatttcccagacatattcatcctttaagtacgcaaaaatgactttcataatatttccattgataggcaatacacaaatatgtttaaatgaaggaataatttattgcattgtactttaaaatccacattccttgctatacataatctgaaaccactgtaaaagtacacttttttaatgcaacagcaggcatacattttttccagtttgatgtaggcaggacctcaaataatgtcaaagtaaagatggtcaatctattcactattggaggaaaacattcactgtgtatcagcttgagttggagaaattacagttaagaaatgttttgtaactaatgatggcttccacgtttgtaaatcaatgactcataatgtatacatgtaaacctatatttcattattttgttagtaaaccccattataacatatactttaaccctattattcaatataaaatggcaaatgcatttttatgattcatttgtcgtattgttattttactcaagatttgttcaaatgttttactttttgtaagttaaactttctatgcttaaggagtatatagctacaagaaacagataaacactaaaaattacagttctaagacttagttgaatatctttcagtaatttcccttagagatatggtcacactgaccaagctacataaatatattttttaaaatttagtataccaatgtgtctattcatgataggttgtgtttttctccttgtacctaaaagtttgatggtttcttttccactctgtctctctctctctcttattgagctacctcgtactagtcctgcctaaagttttatattgtttctattctaactatactcagaaatacataatttgaaacttgaatataacctcttttgtatttctaatttttggtgagcattattctggttgttagccccttgaaggcaggtactttgtgttacattcccaatttatctgacaaaatatttagttcagcataaataatatgcttagcattcaagatataatttgtgattaatttattttgctttataagaggaattctgggggtagcatacacgccaatcatccttgaaatatatataaactacagtgcctctagagtgttatagaaaagccagtggattaaacatcaaaacctcttagagtctctgaatcatattattctattacttctcttattttctttatctatctttgtctcctattataagaaagaagacataaagatataaaaaacttttcctacctctgccttgaagaaagtttaactataaccttcataattatgaccagggacaagttaatgacagattccagctttggtatggctaaggtagaccactcaagggatcaactaactaatatcaaggacagtaaggttcttaccccattcatgagcttcaagtgttctatctcaccccaaaagagattataactctttttttacaatttcattttataatataaaccactatttaacctatatttctgaatcactggactgaataattttatatcaatttattccaactgctatgaatactgaaagtgcatgaatggaagatggcggcccatgaggcaggccttgttaacagtgtttccccagcagaagggtaaaacacaaataatccctccagagaatcaatttgcaaaaggagctcttcaaggttctgaactcctttccttgctctgctgtactaattagatctgacctaacaatgattctgcttatcttggcgttgtgtcactacccttagctatactttaaattaagaaactaacataatttattttgagttactagtacaaaagaaagtaatcttcttgatgggattcagtttgaggcagtaggttctgtataaaaatttttatcgtagatacaattgtcacctgttttctagaaaaaatatattaaatataacctaatgaatatgccaaacttactaggtctgtatttttgctttatataaaatgtcatcaaatttaaatataattcccaataaagtccacatctctgaattatctattacttgcattttggggtgtgtttatactacctagaatgttaacccttattgtgccttaaatgtgcatttgtaaaatgtaggcacttttataactatgagtgaggctggtaaggtagtgtttaggattctccatgtcagttagtgaaagtaagaagtacagtgttaaaactattgtaaatagtttccggggcaagtatagactgagtccatccagaatgactgtaaccaatttgacatcatgttatggataaagaagcaatgaaaaataaaccaaatagctacattatatcatattcttaactttcataagccatgttttatggaaaactttttagttttctcaaaaggctaatatatttcaatattttgaatacatcattgttaattttgagttggcagaggtaaattaaccaactaccattacgttttaggattaagagatatagcttttaataaagttactgaaatgcaaaaaaaaagagaaactaacataagttaaaattgattgtacatagtgtcaagacagcaaactcaaatgtctaaaaggaccagggagaaaatgtcaataaataaatgtttgtgttcaaggaaacccaaaactagagcaattgagggcccacacaatctaagcatagtgttttctgactcttgatgcatcaataaaatacttggcctctgataattttattttataagataaaccagtatataacctatagttcaagatcactggacttcacacttttataacgatttactcaggtaactaaaatatttcttcgctgagaagatcaccctactgcctcactttcaacacattaattaaagatcttagaaccataacaagctttaaggacttactaaacaattaggcaagaaattacaattttgccagtcatcccaggtaatcataccatcctgactcataaaatttccttatgaacatattgacaacttttaggaaaaaatctttctaacagactgcttgggaaaattcataatgtctctggcctggtcacacagcttaagtactttccgtagaaaatattcatgggatttatagaaagtcagtctacagtgtttacagattaagaatcagacaatcagggtcctcttcatggaaaatgaggatctatttacagtttatcaataatcagagatgctacgaagttgttagaatgagctaggtgtagccttgaggacttagtaaaagtcctcaaaggaaacttaagcataagcagagtaacttctctctgaagaataaatcaggatacttcctgatgtctaccgaaggtcccttgaagccataagcccaaacatttttaaattatttctgtcccaaatcctctcgctaaggaattaatgtcatcctttaaagatttagcatcatatgaatggagaagagccaggtaggtgctttcctagagagaaaaaataaatcaaacacaattcatactttattccagaaattaagtgttaacatgtcaaatgcttttgtctttaatttgaatgtctttcccttcataattatgtagagcagaggtttagtatttttgaggctattaaaattcctgagataaacttgatttttctctatgccgtcacgctccagaaaacataagaagaatgttaattctaacctaaaagaacccaactacttctgtggataatcagtttaaacatccatgggtcagaggaggggatgacagtttattgtgataaacacatgtctaagagaaccagatcaaggtcactgacatgtttaatattaattgctaaacaactgtcagatggcaatggtttgagttcaccacctctcatgagttgaatccaaattgctctctgaaggagaaatcatctactaaattctgttctttcaacaatgaaaacaggcatacctgtcaattttctatataaaaaataccattgtgtttattcactcacgtggattttcagctctgccaattcaatttcttcactgaacctactagtatacgcctcttcaatatagtcacgttcaaataaataagagtaatattctcattgagaaagggatatatacctcagataaattcattgttccctcttaccctctgttgttgataaatttagtttccaaacattctaaagcaatcttttgaaatcatctgttggcttgagtacaaagaacatgaggtccaactaattccaagcatttctttaatatggtaaaggtgttgctttgattgttactctcagccacgaactaccattggatcatttaattccttcaaaagcaattgaaggactggcttcaaacctttcaaaatctgttttcatatctacatatactgagaggaatagagagaagtttctgaataaaataataatactttgcagttctctgaaacttgagagggaaccagagaatgtttattactgagttttaatgtcttttaaagagccaacacctgatacttcaaaaacgttaatcactccaataaacattttactcccagaaattcatcttaaatccatcttataacataaacaagcctagtaagtagcattattaggagaaatttctggctgagttccacacatatattcaacttcctgaacaccctctaaaagcaattttaccttacttgacacaatacagaaattaatcagcataataagtaagctaaaacttcaataaaagtgtttgcatcttgtccaggcaggtggctcatgcctgtaatcccagcactttgggaggactaggcaggtggatcaagaggtcaggagatgaagaccatcctggccaacatggtgaaaccctgtctctaccaaaatacaaaaaatgagccagatgtggtggtgcacacctgtagtcccagctactcgggaggctgaggcaggggaatcagttgaactcgagaggcggtgattgcagtgagctgagatcacaccactgcactccagcctggtgaaaaagtgagactccgtctcaaaaaaaaaaaagtgtatcttaatttgaaaatattcataaagaaaagtgtaccctggtaagggggacagataacctaaaagaattatagggggaagagttttacatatataatgatcacattttaaaaattatagttgacctgcagataaataaagtatggtgtttttgcctttattccttaaatataatacatatcctttctctcaatgaccggctaatccaacactgatgattccttgaaacatccctgtgacttaaagtttacaatttctaagaacttttcctaactcaccatctctcagttattcacacacttaaattttcttttatcctattgaaatcatgcaagtattgtctgcaaccaagataggtaaacatatcttctagaccactagaacacatggctgttttccagatatacaataagtgatgtcacagacaaagaatcaagatacacacttctctttaccactgaaaatgttcacctcacatttttatctcaacttaggtgggtgtgtttttgttttttgattttgtttttcctacttatgaaaatagtgccaaagatcttcagttggcactccaaagcacagacaattgcaaccaatgttctagagttacttctgaatattatcctagacaagtagcaggagcactgacatgttttcataagagaataaaagacatacaaagatttattatctggcttcataaatttaaagcaactgtagtgccttgaatgtctttgtataaacttttatatgactctaaaagaagataaaaatctaatagagactttcagaaggtcaaatatgaaagatgatcatgtctaatgaataaattgatttctgctggagtaaataggtcacaattccaaaaagaatctgtattattttttgacagtgcacctaaagtaaaaatgtggctccatattatgtaagattttggtacaatatttaaaattctaaaatcattaagcaattccaacctatacagaagtatgacaccttgggattatctagactatatggctaactcttttaattgtatacagatgttaagtcttacctctgcatgtgtgcattgagaaaccagatgaaaaaaaaaacttaactgtacttttcaaaaaacttggttagatatttttatttaaacatttggttttgtacagtatacatttaaattacattgcttaatgaatccatctgaaaacagtcactggttgcttctgtgatttgtgaataggagaacatataaatatagcagaatgactttgtctagcaacatgttcttgccaagataattgggaattaaatatttaaatacatggaaataatatctttgcggttacatatgtgacttccaaatcagaccaaactaattccttaggaaggccaagagatagtgaagccatagcatcagagtgacacccagaaattacagacgacaagcattatgcaaaggcatagaaaatttgagattttggttttaagaaattttcctctttgtaagtcaatgtcttagtaaacaggaactatgtattcattacaaacatattgatagatgtgtatgtgtgggcattcatgtgtgtgtatacatgactataattcacaatttaatttgggtagataaatagatattgtatagatccacatatactttcatttggctatatataaaatatatatacataatatatagaatttcatctggttattatattaatataccataaataataagagtgtgtgtgtgtgtgtgtgagcgcatgtgtgtgtgtgtgaaatttagctataaactttgagaggggaaagagaaagcaaaaaaaaaaagaaaaggaaaagttaaacctcagaagagaatacactgatctagtgagtttttttaaatcttgaaaaaatggttttaaatttttgtttgatacttttgtaatctcaaagctgtcgcaataacatatagtggttttgaattgaaaaataaaaagataattgcctgcgctcagaagctggagatcagtttgggcaacacagtgagatctcacctgtacaataacatattttaaaaaattagccattggagcagtgcatgcctgtagtcccagctacatgggaggctgagtcgggaggatggcttgagcctgggggactgaagctggagtgagccatcactgcctcattgcaactcaagccagggtgacagcaacaccttgtctcaaaaaaaaaaagatattaatggcttaaatatgcataatctcatgtttgttaaatgatgcacagccatgaatttactatcaataaatatttttaccattttcttttttgttatcttttagatctccatcaaaataaacataagtaaattaattctttatctttacttttgcactatcttctctcgtttatagctttatcttttcaatcagtttctagcttcctttggttttattagtaatgtattacatttgcatagcattatgtattatattgaacaatataaaagtgccttttataagtaaaaatcgttgattattagcaatttcatatggcttaaacttaactcttctcaaagtgcatttttatgaattccctcatttgatcatcaaccttgttataagattaatactcaggttacacaaaagaaaataaggtttcaaagagttattactaagtctgaatcagctagatatgttaaagtactggtgcattgattgtagattaaagatgtgaacatgcatatacaaaggcattgtcctgaaattggttttaattaaaagctcaaaatccacatttccatcttcccgccacaatctcttaccccactaaaaagttatcatgatgattaacatggggccttacttcactgaactactaattattcttttcagtgcttcttttattattatgactttaacaatacatcttctgatcttactaatatattttttattaagaagcttagttgtttctaccaagattaaagaggagatcatagccaagtttcttttaaaaatgaagactgcttattcttagcaagaggagaaaaaattgagggcaaaattttgtggaaatttaatttgcctcatttgtccacagtaggtaagtatggcaactgtatgcaaaatgcagcagccacgcatttcatcagtgataatatgtgactagactttctaccctctctgtttgtttttgtttttgtttggtagaggtagcacctcccagtgttgctcaggctgttcttgaactcctggcctcaaggaatcctcctgccttgtcctcccaaagtgctgggattacagatgtgagctgccacacctgcctttcttctcaattttttaatcaatataaattataaaatgtggttcacaactaaggttgaaaaatatctagtccttcaccccttaccccttctcattccccaaaccctgtgaatctactgtaaaatgaattcataaaccaagagtcattgcttttttattctactgcttacattttacttggcaaacacagaaagaagttgggtagtacctcatggaagaacaaaaaagaagaaccctggggaacaatttctgggagtatatcataccacatgaaatctggaaaactccttcattctcatctgtcttttttccattctaaatcaacacactaattggataaaattttgcccagttaacttatacttcctgcaaatattacttcaaggatctcacttaaaaatgtaaaataattaaatccccccacaaaaagaaataatttaaaaatatacaaaggtatttgatacattttattcttattctctcaaaattattatattttgagcagaattattatattgaaattctgtattttccttacttagcattgcactgggaataagctggacaccatctgtttgattcaattgtttacctcaaaggggaagtaagttctagaaaacaactctgaaaaactgtgtagatgaactttctgattctacgacatagaataaggagctatatagagaattcttagaactatgtcatagaatcagaaaatgtataaggcagaattcttagaattatgttgcaatcagatgaactgacatactcttttttttttcctttttgcctcttcgctttacaatcaagttaaaccaatttaccttgactgtgtttgcactattcctacttcatctttattgagtaattatgttccttctcatgacaacaaaactacattttgaaaccttctcatttaaagcaggtacacaagacaagacagacaccgatctccagtgcagaggtgcattggacaatgtgacaagggacgcagtggtaattataaaagatctgttgacattatgtcttttctaaatcccattagaatgatgcattttaaacttattatttgatcaggatgaggagagtaagataattaaaatctttacagtacctatatttcatatactaaaacacagtaacaatatgtgagaattatatttcaagcattgggtcatttctgtgtcttataagtctctttgctatttaagaacccatggtatttttttatttctatttctatttcaaatattaaaatgtttatacccatatgtctatttcagaagaggtattgtaaaatgatttaaaattttgtggtcccttaataaattctatataaaaagcatagattaaagtggtcaggactatttaaaaaccagtatttgtgtgtatgtatatgtgtgtattttaagagagtgaatatccatgaaacatatcctcataaactggcctaactggtcttcatagaaaagcattattttcacgctattttatctatagaattaattgttttgcatagtcatagaattttctatatacaagaatccccagtgcccatcttcctacaagttaaataatgcataagtgtatcctgaaaaatgctagaatatctctcttcagagaacccatgtaaataaattagctcatattcttggaaaacagccttgctgtgtctgtgtgttctccttcaccacacctggacagacctcaactcgtaaacaaacatcctaagatcttaagtataattagtgcaaccaaaacacttgaatatcaatattattctttttaattgcattagcttaaaatattgtatctttttgttgtctaagaaccagagccctatggttttctcttaatgttaaattgtctataataatgagtcaaagtcatattagaaaatattagtactcacatggccattatctattatgccccattgatgaacgctttgggagggtgatgttaaatcttcttctattttatttaggaatctcattggatatcatagcacagtctacacatttcagtgtctcctgggtggcagacctcacagaatgaagccaggagccttatgctgagagaataggaatgttcaatgggttcttccttcatcaagaaaaaaagcacccagaaaacaaatagctaacagccatcttgaagctatcttgtgtgcttgtctcagtaaaaaaactaaacagaaggaggaaaaaacaaacttgacatggttaaaaagcagaggctgctcatctggatttatcttgcgttatgcttttttaatcaaaaattcttcaaagcttactgattgtttggttcatgaggtgaagggcctgtatcttcaaagaaagaagaggcaagatctgctaaaagagaaagcctctcgtgatgatgtacttactgccactcagaccagaaaagattctggccctgatgcagttaatcacttgggccatgagttggtcactgctgtatcctacggagagcctgaacaagtagaacttttgttgagtcattcaactgtagaatttctgcttcaaaggcaacaaagtcctttcctccaagatattaaaacatagactaaccaggaatgatttatgtattttaagatacaaataatacggatttttttaacactattactaaattatgtttaaggtctttgagtttaaaactgttaggaggactctcaggctatataaattacacagggctctcggagatcacaaactgtctaaagaaaaagggtcatgaggaaggcaccatctctccccatgttttcatgactgaatttccataatttatttagtttctaccaatgacagaaggcgggtggaggaaggaacaagaaagctatcttaaaaggagatacaacagagtaaatattttcccagttagaatcttagtgactttgaggggattaaaagaacctactgtgaataattatacatcaataacttggataatccagaaaaagtatataaattcctagaaacatacaacctatcaactgaatcatgaatataaaatctgaacagttcattaactattaaggagattaaatcagtaattaaaagcctcccaaaaaagaaaagcccagatgagatggttgcactggagaattacacaaaacaataaaaaaaaatagtgctaattcttctcagaattttctaagaaatagaagagaagagaacatttccatacttattttatgaggccagcattgtggtgatagggataccaaagctagacaaggactacaagaaaagaaaacaacaggccaatatccctagtgaacacagatgcaaaaattcacaacaaaatactaacaaagcaaatttaacagcatattaaaagtatcatacatcatgacgaagagggatctattcctgggttgcagggatggttcaacataccaaaagcaaatcaatgtaatacaccacattagtagaataaagagtgatcatctcaatagatgcagggggtaaaaaagtattttactaaattcaaccccttttcatgataaaaacacttaacaaactaggaatagaaaaattacttcaacataataaaggccatatgtgaaaaacccagagctaacaacatactcaaaggtgaaaaactaagagctcttcctggataatcaggaacaaggtattaatgctcactcttgccacttctattcaagatagtattggaagtcccagctagagcaatgaagtaagaaagataaataaaatgcatcaaagccagcaaaaagtaaaaaaaatctctgtttgcagatggcttgattttatatgtagaaaaccctaaagactccatagcaaaaaaaaaaaaaaaaaaaagttggaactaataagcaaaaaagttgcaggatacaaagtcaacatacaaaaacaattgtttttttttttattcctgaaaaaaagatattaatagtttgataaggattgcattgaatctgctgattgctttagatagtttggacatcttaacaatattaagcattccaatttggaaacacaggatgcctttctatttatctgtgtcttatttaatcagtatataagttttcagtatataggtctttcaactccttgggtaagtttatcactaactgttttattatttttgttgatattataaataaaattggtttaattttttatttttttattgtatatatccatatgcaaaagattgaaactggatccttatcttacacacaaaaatcaactcataatagattaaagacctaaacataagacctgcaactgtaaaatgcctaaaataaaacacaggtgaaaagctttaaaacattgctcttggcaatgatttcctgaatacgacaccaaaagtacagaaaagaggaaaattggacaaataagactacattaaactaaaaagcatatgtgcagtaaaggaaatgagtgaaaaggcaatctatggaatgagagaaaatatatgcaaaccatatatcttataagaaatcaataaccaaaatatataaaaaactccataactcaatggcagaaacacaacttgattaaaaagcgggcaaagaacttgtttagacatttgttccaagaaatacaaatggccaacaagtatataaaaagatgatcaatatcagtaatcaagcaaggaaatgcaaatcaaaaccacaaggaggagggaaagcaatgcgatatcaaccgacacctgttacgatggccataaccaaaacacaaaataacaactgtcagcaaggatgggaagacattggaacccttgtgcacttttggtgagaatgtaaaatggtgcagccactgtgtgaaacagtatggaggttcctcaaacaattaaaaatagaactaccatatgattcagtatttaccatgtgatttctggtattcacccaaaggaactgaaaactaggaccctgaagaggcatctgcacttctgtgttcgttgcagcattactcgcaatagccaaagggcagaaacaacctgtgtccattgacagataaatggaaaaagaaaatgtggtatgtacatacaatgaaatattattcttccttagagaaataggaacatcttgttatatgctacaacataaaccttgaggatatcatgctaagtgaaagaaaccagtcacaggagacaaacattgcatgattccacttctatgaggtacctaaaatgatcaagttcatataagtagaaagtagaacagtagctgacaggggataatagggcatagggaagatagggagttgctgttcaatgggtagagagtttcagtcacgcaaggtgaaaaaagttctagagatcttccctacaacaatgttcatattattaacaatagagtcctgcacacttagcaatttgttaagaggataaattacatgttatgtttttttttaaatctcaatcaaaggaaagaaaaaaagaatcttagtgatttttagagcagtgattatttccctgaattatttccatgttcaccccatcattaaaaaaagaaaaatccttggttgttcattcaaccacagagaagtggttataaatcccaacatattggtactttactgttaacactgacttgagcagacatcactcatgataattcctgtgtttgccatttgcattgtatcaccctgacttgtcctggtacgcaccagcaccactctgctcacttgttaatacacacattttccactgcacatgttggttacaggtcactttttccttaaatttaattgcaacacttaagcatggactaaccaggactcatgtttttattaatacatttttaagaacccatgattgatattcttttagccctggggatggggatatgaaaaaaaacaagaatcatgaagtggtccagaaaattgctctggaccatcctgatttctctcctgtattaattcctattgaacttactatcctttctattgaattttagtgcagaattgctttctgatagtgtctatctttattctctttccccattaaatcatctcactgttaccttactttctaacaccacttcctgcacaggtgttgtgtgtcccataatctcattgcttgagtgatttgaactaatttaactcacatgactgacagttcagtggagggtgtccttttgacagggtggagaagaagcttgactgtaatattgctcagctgtactgctatggacctcatttaagaccacaaacactttttcaatgatttatttaactttttgaacagataatatattcacaaagctcaaaaactaaaaagcacaaaaagatgtgtgctgcaatgtttccaacctattcttgtttgccgtctgcctttcatcctcgctctaccctccatccaggtgaccctgggatgtagacagcagtacctaaagtttcccagacgcttctaaagcagaacattgttgttttcagttgtaaacaaggaggagcctggtgtgatttcaggttccagtttccagatgtcgcctctctgtcagggatcaaaaccacttacagtgccaatttcacttgtcaagcaatcaaacactaaataaacaaaccaaatggatactgaacacccacgaggtctgtttgtgttatagattatggagaggatagggataaacaagtaaattattaatcttgaaacagatatgtggaaaaccatatctacattaaattgtcaataaaactgcattttctaattaagcaggtgtgagatttccatatatgcattcacccccaacaacatatttatttaggacttggcagaagtttaggtgtcatcaatgagaatccactcatttaactaatgagaaaactgaagttcagagatgcatcagggtttataattaagaatatgaagagtatggatccagccagacttggtttaatccaagcttgtccaacccacggcccacaggccccatgcagcccaggatggttttgaatgcagcccaacacaaattcttaaagtttcttaaaacattatagatttttttgcaacattttttaagctcatcagctatcgttagtgtattttatatgtggcccaagacaattcttcttcttccaatgtggtgaagggaaaccaaaagattggacacccctggcttaatcctaccacttagcagctgtgtgacattagacaaactacataactcctatgtgcttaaatcttcccatctgcaaaatggaaataagaatatatccttcataagactgtagtgattaagtgagttaacatatgtaaatagctaagaaggatgcttgacatagaataagcaccatagaagtgcaagctgttataggttaagtgtcttgtgaaagatgagaacagctgggagagtctagagagggttacatgctgataaaatgatgtactgaattatccattacaaagcattagaggaaaataaaattcataataaggtaatgtgcacattgcacacgtgaaaaaagaatttaagaaggctggagtaaaataagcaaattacactgatttagctcataaacaaggaaataaaaaaatcaataaggtggacaaataagtaggctctcataagcatcactgggccaggacaaaggtctcagagactccaaatctactcagttctggaaatgcttcctttatttatttatttatttttaattttctgagggaaaatacagaatgaaaaggacgtatactcacaggtaagtgccaaatgttttgataggaaaacattttaaacactaattgactttgaatcacgtttgagtaaattttggtcttcattgtatttaagtgatagtctaattactacctatgatttcagaacttttaccaaataagaaaataaaaacaattagctattgctcatctttttctatgtgagtgctaacataaatttttaaaatataaaacaaagtgaaagattagtataattttgcttttcattttaaaataaatatagctttccgtttaaactgtcttcagatacatttctctcagtatctaaaacaattactaaacaagatacgtttcaaagtaagaagtcatgcttttattaaagagaaaatggataataatgttcacaagtaccactgattcacaatttctagattagttatatttaagtgattgaacaacaaataaggaaagtcttaaaaataaatatttttctgcagaaaatacacaaatatattccactcttgagagatctcacctttgcataatataagacactcatctgatgcagttagcctatagatcctttaatgaccttacagccaaatctaatcaagcttagattgcaacagaaagtaaaggacacactcctattttatcaaaatgtgaatgctgagaaaaagagaagagggaataatatgccttttaaatttatgataagataattagcaaccttgctaatgtagttcttcaaacattaaatcctcgttttcattcttcttccctaccaaatttaatatactatgagaactctttagcttaattatgaaaataataataatagagttaagggtctgtcaatccagcttaagcccctatctagaatttagaacctggcatcctaattaaactgcaaatactttatttacaaagttattgtttatacattgtaatgaattaatctgattgaatctctgactgattatgggctaccatgtatattttcaaagcaatgagaggggcatacaattgcatttccaacattcagtcgctcagcataattagagaaagtaactatagacgtcaataatcaatgtgcacttgcaccctggagacctgggcaccattacgattccaggaacctctttgagttgtcattttaattatttgcatattaagatctctgcaggcaggcaatacttcaaaagataggccaaaacagctccttcaaatgttattaagttcaacattgccaaatatattttagttgccaattttgaaaaccaaagagattatttaaagtctatcacaaaactgttacagtgagaagactgagttaactacctgtgaccctaggccatcagtgcagacctggggttgctgaagatttggaaaagtgaatcaaaatttttttttctggaaaaaataataaaaagtaacaatacctaccatcatacaactacaataaaataaatgctttacaaataatgtcaaataatagatactccataaattctggtgaatctttgttattataagtagtagcagaggcaacatcaacattcacattcctgattcccatagcactgctttttctatgaattaatgttgtttcctcaactagactgaagaattaataaaaagtcctattttaccttaagtacaaagtgttttgtctacatgctaattaagtacgccaaattgttttctatgcttctagaagacaaataatgatttatgggtcctaaagagcacttggaatagtgctggatccacagtaaatgtccagtaattggttatttattgcttgatataagtaagcacacaaaatgaaggattcaatgttaaagaatcaaacagagatttatgagtgtgatcaaacagagttactatgttggaggtaaatttaattcttgtatatttcaaatatatgtcaaatatttctgggacattttgaattgactttcctctctgtgaatggcaacactacccaacatctatggtaagcctcattttctcttatccccaacaatgcctcacacacacaatgaacaagaaatgagaaacaatgtggtcaggctttctgtcataaaatctgattatagagcaggatttgctatgcagaagaatttagaggaagtcagagccacaaagtgtggctgtgccaccaaactacatttttttcacacacaaaaaagagaaagtagaataagaggctgaatggaaaggagaaataacatagacagtactgagtacttgttaacatccaatatataaaagagctacctgaataaacagagaaaaatatgactatagtattattattgctacaattcaaaccctttgagtgtgtgtgtgtgtgtgtgtgtgtgaaaaatagatacacaaaaatatcaaatgtggctatttatagatcttaaatacttaaagggtatgattattacaccttggctccttctcactcacattttaaagatgtagggaaaggtgatgcctaaaaagactaccattcctaaaatcttatgatttcacaattttctgcatagaagtagttgcttttaaaactctagtatgtatttgagctgtatgactccctgagaatggaatatgctaggatccagtaaagggatattgaggtttggcctaagggctaaacaaataaatacgttgaggccagaggcatagtcaaaggttagctccttggtaagaaaatagataatccccctctgaaaactccaggtgaatctagggcccagaaaaaaatacccacttctccagggtcatgcaaggctaaaacagaccagcctaggagcatggatacaaactggactagcaagcaccacaacctcagaaattagaatttggtgaggcagcttttcattagtaagatgaataacaagagggaatacttgttttaaaattgcatcaagctaactgaaaaagaaagattaggtgcaggcatccacaatttgttattatgtttttcaatcttggagaccggaattctcctgtgctttgaattaacagcacgcaagtgatacactatagagaagaaaagtcaaaaaattagtaaatcaatagggctgcctttatataacttgccaccataatttttccctggatgcttccaacgtatctatagttttgtttattcatttggcaaaatagggcacccacatccttggcacagttcatgggcttgaattgtaaccgggaagaagacaaatataattcctgctgtgatactgtgatttaaaatgagatatatacatttggtcttcactcccttctcctgacatataactcttaaaatctttgaaatctctggagtgataagaatatcatttgtatgctaatgaatgtttgctggctggcagcctctagatagcttcagaatgggggccagtcaccaagaccaagacagaattagagggttaaaactttcagccccaccaccaacatccaagtaggtgagaaaggctgaaagctaagttgataaccaatgaccaatgatttaatcaatcaggcctatgtaatgaagcttccataataactcaaaaggactggagtcagggagcttcctgacagctgaacatgtggaggatcccagagagagtatggcagctctgtgccccttcttccgtacatcttcatctgactgtttatctgtatcctttgtaatattctttataataatcaagccaaatgtaaagtattaagtgtttccctgacttctgtgagctgctctcgcaaattaatggaacccaaggatggggtctacagccagtcagtcaaaacctgtgcttgcaactggcattggaagtcggtcgggaggcactcttctgaaaatgatccttcaacttaagggatctaacactttctgctgctagactgtgtctgaattgacttaaattagagaacacttggcaggtgtctgttggagaactgctggcttgatgtttgggggaaaacccccacacatctcatgttagaggtattgtgttggctctgcaagagtaggaaagccactttgactcttcccacatatcttacatctgctctcatggaaattacagtggctatagacagagaatgaattcttaaacttaagaaaaacaatatagtttcagagagtgatccatgattggagctgtaaagaaaccagaagatgtggttgagagggactgggggaagggaaagaggggccacaggttggtggattctttaattagatgggctaattggaacatcctcactaaaaaggtagcatctgagctgagagtgaaatgacaagaacaagctagtcatgtaatcttctggggacagttttacaaataaaagtaaaaacaagtatgaaagccccaactaggaacaacttaaagtatgtaagaaaagcaaagacaggtaaagccaatgagccagtgaaggaaagtgaggtatgatgcagcctggagtcacagatcatttggcctgaaaaaggagttgaaatttagacattagatgaaaagactattctagccatcttgctactagatgatggtggcctgactaatgcatcacctgtgaaaatgaaaagacccatataaattcgggatacattttggaagtgaccctaagtaatccttcaattgttggggtgattatgtatgtttgtgttttaaagtgcggttcagtgagggatcagatgactcctaggtgtatttcgcttgaacaacaaggcatatactaatgatatctattgagaagaaacttcggcagaaattatgaactagaaaatggagaatggatagctctgttttggtcttgagaagtttgagatagctcttagacatcccagtggaaaggtcaagcagagggttttttacataaattaggagctcattgcagagatcaggattagagatatacatttgggattcatcagcatttagatggcattaaacgccacagtactgaatcaccttcagaaagattacagtctttcagaccagcatttggaagccaacagagcagaagtcagcaagaaaggccaagaagagcagtaggtatggaggagaacatagcatcatgatgccacagcagaaagtgtttgaagaagaaaagaactgtcaactttgtgacttgctaccgctgagtaaaaaaatgaggacagaaatgtgatcactggatttggcgcatagtgaccttggtaacagtctattcaatcaagaatggcaaatagcctggaagaaactgttgaggtcgatgcgtatgatacaatgaattaaaatacatcaatatttctagcaaagaaatactatcatttttacctatacttcaattcatccctgatttcatgaatatcacaatatagaatttggttataatttattgtttcatagcagttagttttttgaagctgtgaaaactcacaataattagcagcaaataattaatgtgcttataaaatactctggggaaatatgccctgacacttagtatcccaaatggcattactcttaaaagcaatacatgtgaccctctggctataatagtaaaaaataatttttaaaaatgaagaacaaagtaaactcttttaaagacttactttcaaatgtcacaatagcaataaattattgatttccacatctaaaattaatgtttttatttatttatttatttagttttttaattgatcgttcttggatgtttctcacagagggggacttggcagggtcataggacaacagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgactggacacagcacatgtttcagagagcacaggtttgggggtaaggtcacagatcaacaggatcccaaggcagaagaatttttcttagtacagaacgaaatgaaaagtctcccacgtctacttctttccacacagacagggcaaccatccgatttctcaatcttttccccacctttccccgctttctattccacaaaaccgccattgtcatcatggcccgttctcaatgagctgttgggtacccctcccagacggggtggtggccgggcagaggggctcctcacttcccagtaggggcggccgggcagaggcacccctcacctcccggacggggcggccgggcagaggcacccctcacctcccggacggggcggctggccgggcggggggctgaccccccccacctccctcccggacggggcggctggccgggagggggctgaaccccccgcctccctcccagatggggcggctggcctggcgggggctgacccccacctccctcccagacggggtggctgccgggcggaggggctcctcacttctcagacggggcggctgccgggcggaggggctcctcacttctcagacggggcggttgccaggcggagggtctcctcccttctcagacggggcggctgggcagagacgctcctcacctcccagacggggtcgcggccgggcagaggcgctccttacatcccagacagggcggtggggcaaaggcgctccccacatctcagaagatgggtggccgggcagagacactcctcacttcctagatgggatggcggccgggaagaggtgctcctcacttcctagatgggatggcggccgggcagagaccctcctcactttccagactgggcagccaggcagaggggctcctcatgtcccagacgataggcggccaggcagagacgctcctcacttcccagacggggtggcggccaggcagaggctgcactctcggcactttgggaggccaaggcaggcggctgggaggtggaggttgtagcgagccaagatcacgccactgcactccagcctgggcaccattgagcactgagtgaaccagacaccgtctgcaatcccggcacctcgggaggccgaggctggcggatcactcgcggttaggagctggagaccagcccagccaacacagcaaaaccccgtctccaccaaaaaaatacgaaaaccagtcaggcgtggtggcacgtgcctgcaatcgcaggcactcggcaggctgaggcaggagactcaggcagggaggttgcagtgagccgagatggcagcagtacagtccagcttcggcttggcatcagagggagaccgtggaaagagagggagagggagaccgtggggagagggagaccgtggggagagggagagggagagggagagggagaggggtaattttgtatttttagtagagatggggtttctccatgttgatcaggacagtcaaactcccaaactcaggtgatccgcccgcctcgggctcccaaagtgcggggattacaggcatgagccactgtgcccggctaactcaggatttttccctttgctgatgtagcctgacagcaggagggagcctataataatgagaaaggcgcgaatcaaaaacagcacagtggcaagtgcgatggccttataagggatcttaggaggggttttcttaaactgaaggtccatgtagccatcgtctgtgctggagagccttgaatatttcactttactactggggattccagtagccaggttggtacgggacggcatcataacaggctgacacagcggagcgccgcgccaggccgcccgcacacccagagctcgcccacggttggcagcgcccaaggttgcacggcatggcccgcttaagtgccactcagccctaatgtttttatttatgaagtaacttaacttttggtaacataatatataacttctctttcacagattattttatttttttagaattctagagtttgaatgaatccaattaagtgtgctctgtgtgtcttctcagcctgcccttagcaagactcacaatgtgagttctgttctacttgctatcaggagaaaccgcacaggaacccaaagaatactgcctgctggaaaaaaaaaaaaaaaaaaaaaaaaaaaaaaagctcatttcttcacaaagtctctggctgtggcaaatagaacacaccatccgtttatagagtctgctaattggcactagggcattgtctgggcttgcacttctttactggcaaatgcagctcatttttatttatgctcttcaatagattcagctaccaatacatacagatttggattatgaaaaattatctaggcaggtaaaaggaattgaaatttcagacagttcagtggattaggagggagggtgaggtaggcccaaactaccttgaagaaggagtattttgtgaaaatgagccaagccccatgttcacttttgaataataaaaacactcatccacatgccgacatgacacagggattttattgtgaattgtcacacacggtagttttattagtacctattcaacactaagctaatttaaaagcacttgaaaccttgggcagacgtttttaaatgaaaaaaaaaaaagttcaaaaagctctgcatcatatactatctactataaataaaataagactcagttcttctgagccctgaaacacattcatttccacatgagctgcctgcaccaaggatcactttcatcattctctagggcaacacagttccctgttctgtcagaactttatggcattcacccttttgcctagttttcactgcttggtccatttataatacatctcctcccatactagattcctataagaggtctcatttaatttcttttaaaattaaattaatacaattaactttgaaaaactggtagtctttactaaatctcaacataagcatactccatggcctagacttttcactcttaagtatagacccagcagaaaaaacgacacacacatccaccaaaagacatgcactaaagtgttcgtagcagcgctatttatttgtattacttttatttttatgttttatttttgtgggcatatagtaggtgtatatgtttatgaggtacatgaaatgttttgatgcaggcatgcaatatgaaataagcacatcatggaaaatggggtctctgtctcctcaaacatttatcctttcggttacaaacaatccaattatactccttaagttatttataaatgtacaattaagttattaaaacaaatatgtgtggtcaaataaagagtagaatggataaaattctcacacaatggaaactgtaatacaatgagaatgaacaatctacaacttcatgcaacaaggataaatctcaataatagattgttgagccaaacatgtcaaataacagatcacagtgaattatttcattacataaagaacaaataccttatcctgactaatataccaggtctgagtaaaataattgggaaattttagccaatgtaaacatgtctaattccctttttataagtacaaaaccagtcacaattagactatgttcctagaagaaagtattagttatccttactgtgggagctaatgagtagagggggcttgaggggcttctgaaactctggtgttattcttgcatctgggtacagattacacaaatgtgttcagtttgtcaaagttcttcagagtgtataaatatgttaagatatgtacacatttctgtctttagaatacagtttgaaaacaattttaaaacccttaaatttctaaaacttgtttttaaaacatggacgttacacctaccctcatatttggactgaatttccagccttgtaacaagagagcattctccggaatatgaatagaactggtggcagactattcatgtcatgcgaacagttagtttgctttctaaactagattgtacttttcccaagagcaggagccatttcttttgtgtctgttcatgtgtctgttttgtgcacagatgcacagagaaacagcgttctgagtgacgctgattgttcacattgagtagcagtggcgggcaagcaaaaaagagcagggctgaaatttggaaggctttaaataataactggtttccaagtttggatgccatcttctaggcaacagtcaactgtaaagattttgagtgaggcaataacataaggaaaatattattttaggcatgcatacgtactagaatcgagaaaatcaatgccagcagaccagtcagcaggcttagtttaagcctaaactagaatgatcctggcaccaatggaaaagagggatgggcatatatgaaaaaaagtcagacaaaaataatctatagagctttgaaagtgatagaggtcaagagagttgtaagttctaaagtgattgagttttgcagactgagtgagagcttaatagaggaaggaaaaccttatggattaattgatttgggaagacactgaaaaaatgacataatgggccaggtgcggtggctcacacctgtaatcctagcattttgggagtccacggtgggccgatcacctgtgggtcaggagttcgagatccacctggccaacatggcgaaacctcatctctactaaaaatgtaaaaatcagccaggcatggtggcaggcacctgtaatcacagctactccagagggtgaggcagggggaactgcttgaacccagtaggcagaggttgcagtgagccaatgtcgcaccactgcactccaactccagcttgggcgacagagtgagatcccgtctcaaaaacaaacaaacaaacaaacaaaaagacataacgaatagccaaagttggagctcaatgcagaactcatacaaagtacaggactcagatttcatatattaaatgtttctgttttcctcagggtattaaaaatactaaagaggcacagagatatagtgagaaagcatgagaagatttagaaatgctaaacatcatcaaaattaaaaacactatttctgtgaaaggatagactgagaggaaaatattttcaaatcacaaatctgacaaaagacttgaattcagactatataaggaattctcaaatgtcaacattcagaaaacctacaaatcaatttaaaagtggacaaaataattaaacagacacttcaccaaacaggctatatgggggcaaataaacacaggaaaaaaagtttagcattagtcatcagcaaaatgcaaaataacaccacaatgaaatgcaaattaacaccatgttctatacatatattacaatgaataaaatgaaaaacactgatagtaccaagtcccgacaaagatgtggaacaactagaactctaacacattgctggtgagaatgcaaaatggtacagttcctctggaaaacagtttggcagtatcctataaaattaaatatatacttaccatatgtccccaagattctacttttagatgtttatccaagaaaaatgaaagcatgtatccagagaaagatttgtatatgaatgtttacagttgttctatttataaatttatcaggtacatggataaacatactgtggtacctccctacaatggaataatacataccaataaaaaggagcaatctatttacagagagaacttgcatatatctcaaaggtcaagctgacagaaacaagctagtctcaaacagttccacatgttatgattacatttatacgacattctcaaagagacaaaactatagttacagagaaatggtcagtggatgccatgggtaaaggtgggagaagagtatatctacaaaaggacagcaagaggaagtattgttgggcattggaactgttcttgtatcctgactgtagtggtggttatacaaaactgcacgtgttaaaattcacagaacttcatataccactcaaaaagtcaattttcttatatgttaatttaaaaaaatcttctaaggaaatgcacagatagaacataaagcaaccatttaaatgtcagtattcttttgtatttttactgttatttatctaagagtatctaaaaattccacagtaataggacaagtaacttactagatactccagtatgcctataaaaattacataaaaacaaatttaagaaattgaacttttttgccaaacaactgaaatttaatttataccagattatacaaaatacttaatgtaaaactagttaccaaacctaattagcaaatgtacagtaattgacctaattggcaaatttcttattatttattgagatcactgactacccagctgggcttactaaaaaactgagaagtagtcaaaagactaaagaaaaaaaatccaaatatattgaacatgggagggattttgctcttaaatttaagattctctgtaatcaactgtgaaaatctgaatacatttgttttctaggtgaacaagggacaataataaatcataactgtcaattttgctcaaaatatggtttaggagtacattttggacttctcaggcagttaattggttttgcagttttgaaggatgtggtgctcagtttttgaggggttgaaaacaactcaactgctagaatttcaggaggaaaacaataactataacaaaattcacagtggctttttaactaaggtgacttttttggaaagttaccctaaatgatctgaccagtttcatgtatcataatgattttgaattgagataagaataattggtacgtgatctcagaaaatctgaatttgaaggacgccaataacaaactagataaccactggcaaattagtaaacctctttgatcctcagtttactcatttgtaaaataaactatctgtattagataagaagttctaatctttactatattacatatatctctgtgtgcgtatcttagattcctaagcagggcccaacccaggtctgagttggggctcaggggtgcatcattgtaataggagcctttgtggtgctgaggcagatggtccttagtgcacgcctttagaaacactggaccagagagacagtccctcactcttgcagctttaacacttgaatgcagtcagtgtcttcttagcctacttttgtgtcatccctcttttctctttagcagagaccagactattagatttgtcttctttcatatcagaaaggcaaagaaattactatggttttccttagacctgtattttctgagaataatatagacaacctcagacagcccagggtgagcttccttttcaaaactgctttcagatgggatgtcttctacctcgtaggttcaccttccctgtaatttctgtaattcaaacaggcctcataaaccacaactgatctttaagaagtcacctttcagattgtctcccaaaaaaaatttaaactcctaagtgaaagatgaagtaatatgatataaaagaaaatctaatgatacccttaaaataagattttactcaggcaaactaaaaggcctactaaagaaaattatctttgacctttactttcgatttcttatgtaatcctacccagttgcttttccaacaataagagaaaaattacatttaaaaatattttgatatttatttaagggaattctactattggctctcaaaggaagttttaattttatttgaaaggcaaagcaaattttagattaatcttagcctctgagtttaaaaatgcaaatgtttccaataataatgataattgacatgccagcacatgacatttgctttgagaatattaaagctgaggaaatatggatataaacattcaacattaaactttgagataattatattaatcctaaatgaataataattcttcaaaaataaaaataatctttaaatgctaaaagaatcaacataatcacatttatttatgctatgcaagtatacatactgtgtggaagaatccagaagcagggttgatacctgacactctagccagaatctgatgagactgatagtttggaactcagtccctttccttacaaactaggttgtcttgggcaagtaatttaactttgctgagcctcattttctaaatctataaaataataacaacctatcaaatctttctgcattaatcacatgttaaatgaggataaagacaccttttaattagaattttcaaatatctaaactgtggtgcttgcaaagtttcacattcttttcacgtttgtaaaattgaaaacattttactagtccccataaatctgaaaaagaatttctaattctagttttcgaaattcaaaagaaaaagaggcacgtttctgtcttattaatgtatggttttcttcttgttttccttcgacggtcgtctgtaacctcccttttgttttgtttaggtttttaatcgacaaataataattttacttatttatagggtacaatgtgttgttttgatgtatgattaaatcagggtaattaacaaatccaatgcttcatatacttaccatttttttgtggtaaaaacatttaaaatctacccccttagcaattttgaaatatacagtgcattatgatttattatagtcagcattctgtacagtaaatcactaaagcttatttcttctatctatggaaactttgtactctttaatcaacattccccttttgccatccaactccccacctccagcctctggtaaccaccattctactctttatgacttcaccttttttagattccacccgtaagtgagatcatgcagtatttgtccttttacacctagcttatttcacttagcatagtgtcccccgatttcatccaagttgtcaaaaatgacaggatttcctccccttttaaggctgaatagtatttcattatgcatatataccacatttttttaatccatttatcagttgatggacacccaggttgcttccatgtaatcttgacctaagttacaaatttgcgaactctttagattcttatatccttagtatatgagaaatatttaaatcaataaagcatcataattgtaaaaaaaaaaaaaaaacagaagaacaaatatgactgtggcagcatcaatagaaaccaattggtttgtgtaaattaaaaaaaaaatcagataaaactgaaatcagtcacttagaacaatattttaaaatcagtatcctgagcatatggtcatgtctgggttttcatttccaaaagagtaaatccctgaagatactttgcatatttttatcctctcagttagactttgctctttaaaataaaacctaccctggttaacaccgtatctccagagaaaaacacaatgcctgctacttaataggtgttaactttttatgtaattgatgaatgaaccaatgaaaaatgtataataattcttaagaaacaacaagtagtgttatctactcatagccaagtgaaaggacaactaaatattctgaagaatagcgcaaaaattgtgcttacccctttaaaatacaagtgatatcaatcgtttactagttccaaacaaagcactttctttgcatttgcttgaggcagtagagcataatggtttggggcaggcatactttttgggtcagatgagaatgggttagaatccaggctgtccttataaacaccattaacttgggcaagtactttcatttgttgagactcattttctttcttgcaaaactgggaaaatcaattttaacttatgacgctactgaaagatttaaatggcaacattttactggctatttgttaagttgcatacctgagaggactcctagccctaagagtgaaaaattaaatcaatattatttctgaacaactttacttaacaattataagagctgagtaagaaagaaagaaaatttgtattatatgagatgcatacaaaatattttagcataaaccagaaatatttttgcataagccaagaaaagagacaaaatgttaacagatttaagtggttagaaatgtgcttgacattcatgaaaatgcagtattccttatacaaaaataacaatttagttttattaggaaatacagaaaacttgaatagaaatctatttcagaaatacactcagaaatacttaaatatgaatccacagtgagctgatttattttgggcattaattaggtattctattacattatcaatcttttgatattctgcattgctggcctcataagactgttgcctgagtgaaacacatctaaagactacctcaatctaccttaaagttaaggagtagcagagaacaaatggctgaataaagagctcctcacattttataaaacatttcattgtctactgcaagctacttagctcaatttaaatactgaaatccatctttagccttccaaattatgtttcttatcagcaatgttagtgtaggtattactctgaaaactattataaacagtgtaaaaaatatgtatgtaagtcatgaaaatcattctgtttcccataatgaaatcaaaagctcattgcgtgtggatgaaagaaaaaattgagagaacagagagatggttttaaggaatattttggtgatactgcaaaccaacatgtaatgttttaaatttatcattaattcttcttgatattgcttagaattccagccatgtaggacctaaaagaattgttctgggttgaattgtggcaccccctcagagagtatgctataagcctaaccctcagaacttcagaatgtgaccttatatggaaataacgtctctacaaatgttaaaatgaggtcatttgtgtgggctccaatccagtatgactggcgtctttataaaaaggtgaaatttggtcacagggacagacatgcacagaaagaagatattgtgaagacacaccgggagaagctggctgtatgactagagtgacgcatctgcaagtgaaagaacaccaaggaccaccagggaaaaccagaagttaaaagaagcagagaataatcatcctagagtcatcagagggagcactgccctgtcagtaccatgatttcagacgtctatcctccagaaccgagacaataaatgtcaataaaccaccaatgtcttcaaactttggtactgaagccctaggaaactaacacagggacattccagagcttacagtcccataagccaaaacactgaggtgaaaaaaggtgaaatcttgctgaccaagatcttacagttacttcagacagaactctagaatcaagagcctggttttcttgactttaagtttaggcctgtcatttccccttggagaactgacagattggaaatgctaaattttaaaaaagttcatcaagttaattcctttaagctattttatttagtgacttctgtttaaactaaaaataaatactgtgactctgcccttttgatttttttctaagtagccatgctccaatttctgaagcctttttaatctaaaagataaaattgaaattcttattaacttagttgatacttcatttttatctcatgatccctttactattacatgcaagaggatgtgaaatttaaaaactatgattaaaattttacaacaaaaactatgaggaaaaggaaagtgtcataaaataccatcagttattttagttaaatagtcattttctcataatgtttgaattattgtaacctcccctaaggtatcaatatttttaacacacagatatcacggaacatctcctttctgatgttacttgtaggaacaattatttatttaactaatttttgaaaccgatgaggccagagaaagatcttcatgcatctttgcatctctagcatctagggccacaccaaacacaaagttggtgttccataaaggatgaataatacatcaattcaacaagtatctatttatcagatactatgagctagacagtcctctatatgctgagtataggataataaagaaaacacataagaatgcttgtcattattgagcttatgttctagtgagtacagacagagaagaaataagataattaaattagacggtatattggaaagtaattctcctcagaactaaggagaaaaataaggcggggagcaaaatttagggaatatggttgttgctattttaagtagggtgggaggggaaggttgtagaatttcaacttgacatttgacacttgagcaaaatattaaagaatgtttcagcatggctgaaagctttaaatcctagttgtgtcttttcacttctaataaataagaggacactgattcccagtgtacccaggatggtcctacttttacatgtatttaatcctagtttaactattaataactcctcctgtaattcttactggaatctcagattgaatgatatatagtctcattatttagatcattatctctacataatagttacaaatgtttgttaaatgaatgagtttttaaaaaggtatatctcagtctcacattttatcatttttatttgtcaagctgtttaaccactttaagcagcaactttgccatcaatctcaaaaccgtgaaaccaagattgatgctgggagagtcttttaatatccttaggtgaaaaactcaaaagatacacttatgattaacatcaacaataacaattttctctcactatgtaagttttatttagtatcccccttgtctttcatttcaccgctgagacgaacatctttatagaggtccagatggtgcagagagattatgacaatgaaaagtagctcatgctgagggcctcaaggaaaaacacgtctcggcttgcctgacagaccaatttcaattacgtacttactatgcccctcaacagctgaggtgctccctcttaccatgccttgtgcaacttcggataacacctgaggggattcatggttacacacaaaagagaagcgacatggacaagtaaaattcttcctactttacataagtgatgccacacccattttagaaataggggattcatcacaaatgatccactctatagaaatctcatgttttctgagagtaaatcttaagagaggacttcagggttccttgttatgaggacattttgaaacatcacgtgtttgtcaggctggcccaaacaatttctacaggcaggttgtcagaagaagatgccttcacctcagatgtgtaacgcttacttccctcaacccccatttcagtttcagaaagaagtgctaattagaactggggtagcttttgcgagtctgcataaattcagctatgtcaacgttgcttctgcccctctgcaaagtggaaaacagtgatgttctacataccatgttaatgtagaaataacttctatgctcatttagccacttcagcacatccaggaaaatgacattatgaatgagctacattacctagaggaaagagacagactaaatgtggacttctatacaacttaatatgcatctaatgtacaacttaagcagtatcttccacactaaatgacaggcaagttatctccatacatcagtatatgttaaggacatgacacagctttattgttgaaggaatttgaaatttccagccatacctggattttcctatatccatttattagtcagctacttgcagaagtcaaagtaattgccacattcattactgtgtttgcctccatttaatcagttttgcttaagcttctcctatcctcctctggaatccagacaagcaaaggccactatcaaaaagtgacaatgttacatatgtatacgtatgtgtgcacattttgccactgctaaaatccctttatttgcgttatgtaaatgacctacgttagtcacaggacatttacctcaatttaatatctgttatttagagtgcttgtttctggcaagacaaatgtcaacagtttttgaaaactaagcactgtttattgtttagctggcagttataaataaccacatctaacatttctgttatgtctttgggaaaaaaaattgtaatttttgtaaaccaaagtgtttcacgagaaattgccacagattattccataagatctttctttatatttccagctcccattctctcctcttgtattacataactatttactagccctacaatgcacatatctgatattgaacttactgaattatagtctggtgagttgaataaattctttgtcatttttggaaggaacaaagtctgtgtatgcattgacacacctaagtttcattaaccaacaaacaaaattatatgcaaagtgtctttcattttgactacataatatcaaataactagcttgaatgaattttatagccccaactggacatcatctccatttacagaagccatgtgggtcaagtacccagcatctttctgggcacctcatctgtgagtggacaggttacctgtcaccagcaaaaatgcttaccaattattaaccttccattaaatcatcacccaacacttggccctattgtaattacccccttcaaatggcttttctattactatttaaggtctgatttagatcacagatatgtgttaatatatccatatctgggaacagtgaggagcagaaggaaaaacataggctaacaattaatggagggaagaatgtgtcttaggcaatttcttagatcatctttagagaatacaggacaactgtaagtaaattacacattgtacagcattgaaaagtccttggatttgactctataaggaaaccacagtacactcattaagttagcaccaaacagttatgggatccaagtcaaaattatataataaaggatgaatacaacaatggcattcagggtgtcagcattggaaatatctgctttagcgtctaaatatttatttgctatacctgggaactaatctgatatccatttgtgtagtttgatcaatttgtctgtgagtaataaattagtaacccactacaaactagaaaaaagtgtacataaatgacccccaaagtggttgacctctacatgttcatgggatgacttttcatagaaccccttcaattatcacattggtattagcaagaccaatatttttatttacagattttcatgtaagtgtgcattccctcccttttatgtagcagacattttatcctggctagaaaatcaggttttttagacactgtaattgttctagtcttaagattacagaataggattatacagtatacaaacgtactgttaaaaggattttatgcttattcctatcccctcggtatttaataagagagaatccaaatcatttacagatgtctgtgggtagtaaagaaaaagtctatgtgtatagtactcattatcgctaaagaaaaataaacagatctgtgagcgagaaggcagggaagatgctggctacctggaatataagacagacacatactgagacctggacccagggacaagaaaccttagttcattcaagctcctgtcttcctggaagggatatccctatggctcttcttccacaagccattattccacaaacaattaactcctttaattaaaacatttttcctccaatggagactttgcaaaaatgttgaaaatctcaagaatttaaacctgaacagaaggtacaatatttttcaatatattaaattcttgctcctgttgtttaagtctagttttcctgatagaaaaaaacaactggatcaaagaaaatgagatagtaatggaggaaagtgatattttggttttgaaataaagatgagagactttcctttttcataaggactttagacttttcccctagtaacctaaaatacacctttgccttttatggaattgtcccacttgccatttcatttcacttcatttcatttcatttcattggtaatgggtggaagcccatgcagtggtaattgccagtgagaactgaaactacctatccgccatccaggttactgtttacattaacacacatttactatttcattgctctcattggtataacaactattctaggagagccatgcccaggtaaacaacttgatggttaattacagaaaactcccaaaagactcatcaagactgcagtaggaagtatcaaccaacagtttatgccctaaaacttctctgaaccccttccctcaaacgtctcacaatgctatttccaccaatcctaactgttacatcaggatcattatccaatctcaaccaaaccctaacataaaaaggtcagccttaaaccaaacttccaactgtcaatttattctgattctgcctttactcttctgagaccttgccacagcctggtctaggtggtcactctcactgaaggaagcaatgtgtcgtgagaaacacgctcacctgtccaaacccaaagaatggacctggaggcacgaagaacagcgaaagtgagacttttaatactagtcttgcaagatcgggtgtctggtgagcaggcacatccaggcagtcacaacaggtaatttatctcctagcacataagtccttcccccagttcctcactaatcaagtactatggcgttacaatcttcccggacgtcacctaagtttcattatcccccttgtaaggttataccctgctccacttctccgcttaaattttgatttcccaataacaaaactttcttcccttttataggctgacccttcgtctacattctgttcacttatggtgaccttctaggtgcatgaccatgtggtttgttacatttgcaggctggctgccagtatttagatatatcatgccttgaaaatggaccattgaaattatattctcacatgtactcagtttgtcttatcaatatttcgtataggtggtatttggggagcagccttttgacatcatccatttcttacaaaaagagaagtgtgtgcagattagtgggaaagactgttctagtaaaaagtatacatcatattatgataatccttcctgaaggaaatttaacctctggtttcagacgccacccaggttttcctgctttttcgaatagtcggttcgtcattcctcacgtaaggaaagtggtaaacacactaccagaggccagagcaagtatcatggaatggaaagttataggagagtcatttaataaacatattcactgcatagtgtggtttagccatcctcagctaatcattttttttttttgaagcagaggcttattctgttgttcaggctggagtgcagtggcgtgatcacagttcattgcagtctcgacttgccaggctcaagctatcctcccacctcagcctctcaagtagctgggaccacaggtgcacatcatctcacctagctaattttcaaaaattcttttgtgtagataggctcccccatattgcccaggctggtcttgaactcctaggttcaagtgatcctccctcatcagcctcccaaagtgccaggattaccatgcctggctctcaactaatctctgaatttaaaaaattgcctctgagaaaagtaagggagagttctctattttgtatggatccagagaatcatttcaggcatcaacataataccaagaagaaccaagccacaaaaccattatgataatgagctaccatctacgaacacttactatttattgagtacttactataatccaggcaattagaatatactgtcactcttaatcttcacatcagtcttatctggtagatgttatcgtctcaattttcaaaagaagaaaatgcttcagataggttagggaaccatccctgaccacacaaactaaaactcctctattccaatcatcctctattgaaacgtaatgacttactttcttcatggcgtttttcaccatctgaaattagcctgttcatttattcacttgttaactctctgtttttccctcacaaatttaaagttcagattaggaacctcaccatctatctacctctctaactctactgcctagagtggtacctggaatatggtggatgctcgatctatgtcaagtgatacagtagcatattccacaaagaagcaagggctgaaatatgtgtttaaaaatttccccacataattctgatatgcttacctccctccccaccacagatatgtctgatataaatatctacgctgacacactgaaggaaaaataaggctttttgaatttttatattttctgagggaaaaaaaaccagaaaatttatgtgaaagctcactttgactgacaaaagtgatgattctctagcaatagcacagcccatgaatttgttagcttgcaatcaactgctaatagcacatttcagtattgctgactggctttagagattactgtttctgtgttgtttttcacattaaaatttcttttctagcatcagacagtgagttactagctatagggagtaaaaggcaggagtagaggaggtctgtagaatcaacttaaaaaattttttttcattgatttagtcagtaattccatacattttttctgaaccacgggtgaccttcatacacaaccaccaggttgttcattttgttttgtgttttagagcatcagtaaaacatacatggtcttactgaattctcagcaactaaagccaccacagatctgccttgaatcggtattctcaaagtgtcaggtgtaaggctagaagagaaggaatgctcctcactccaatcaatttgctcattcaaatcaatctactgcactcgccagccagttaacaacctctgggtcggcaagcaagactttttttttttcttgcttttaagatgtgaatcctgtggtatatttagctcatgctactgtgtttgtcttactgtctctcagaaatgtctttaccctttaaaagatccataaacattttcagaaatatggtggcaataaatagatcttacaccataaaaggcattctaaagaaatagcatagaccaacaaaaacagttcaaaaaaatattttctgggagcagttgtaccatggaattcctcaaattgtttttactacaaaagcaacaattcaaaaccaaattgcaattcaagataaaaatatgagtgatttatgattccctctctaggagaggaaaaatatctttcctttatccttcctttggttcatggccaagcccctataacaaaagacggattaaaaagagaaaagcatataaatttattttacagaagttttttgtggcatgaaaagtttcataacgaaataatgaccttaagaaacaggcaatcctacaatttttaagctagttttgataaacaaatggatagtcatggaaaagaatgattggataaaaagtatgctctagtggtaataaactgggagaaacttagtaagacctgtcggatcagattcttctctgtaacctttgccaaagataaggaggaacttatattctcggtattggcaaggtatctctgacatgagggtcttgtgacatgcatcagggggaggtgagaaaatccttcctaggttttgtggcctgcttcaagagacaagggaaggagaaggtcagagcatgaccttcctacttcagtgttctttttttattattattatttttactttttcaaattccttcttaaattattttaaagtaattgtgaccagaaccccatcacctcacttaaaaacatctggaaactggcgtttagagggatatatcatccgtcaaggtcagaggccaaacaggtttctgaataaagctggattgaaactaggtctgactgcaggggaaacaatactggagtgctgggaagggaagagtgtggtcgctttaaatgatacagaagcggggaagggaagtgctgggtagagaaaggccagtccctggctagggctccacccccacggacccaggtgagaacaggcatttcctgcccaaatgttgcatttcccaagactaccctggcccatcctgggcctataaaaaccggagaccctagcaggccaacacacagaagcggctggataccctgaggagcacatcagcagaagacgacacaagctgctggacggcgagagaacatcgagaggatgtccagggagcacgtcaagaggacgtggagggagtatgcaggtggaagagcacaccgacagacgtcggcacagcagccagccgtccaccatcgaaaggtggcggagtttggctggagcgaccagagaagagtccggctgcaaagcggcctgactccaggggaaaaccatctccctctggctcagccatcagctgagagctacttctactcaataaaacctgccactcattctcctagcccacatatgatccgattcttctggcacaccaaggcaagaaaccccaggatacagaaatccctctgtcggaaggggatctaatggatctggttaacacaagccgcctatagacggcaaactaagagagcatcatgtaacacacgcccactggggtttcaggagctgtgaatattcacccctagacactgccatggggtcagagccccacagcctgccagtctttatgcacccctagacgttcaaacagcagggcactgaagcagccagccacatccccatcgcacgccctgcgagggggacaagggaatctttcccatttcagaagctggattgaaactaggtctgattccagcaacaaagctccaagttgctggcactctctgccatttgtcctcctaatgtctatgctccctaggaaagttattctccaatgggtcaaagttatcatctagtgtgtacatgttcagaaaagctaatgacatatgttagcggagctgccccctacagctctgcttcggtttgggaggcaattggttgctttgctatttaccaacaatttcagaggcgggagagaagtttgaaggatttctaagggatagtgagggatgaaataaaaacctgaaggaaaaaccctgtggggttttcagttaacattccaaaaataattcagagactaggactggaaaactttgtataatttattttgcttcaaattattatattttatgtctcttataccctaaaatgattaggaagaaacagctaatagaacaaatacaccaagactggtctttggatgtggcaaaaatgccagggtagtctcttccaattttgtacactcttggagggaaagaactccagggattagtgcataaactggctgctttaaggaggacaaaacaactgccaccctgggatttataggaagtgggcaaaggagaatgttaaagttgatccatgaggaacagatttgccttaacgaaagcaggtcccaggcgattccccacatacagcgccttctctgtccaactaacccatcactcacattgctattcttgacagaaatgtctgtctgtctttttttgtggttacaacattcttcaaagaccaactcaaatctctcctcctccagaaaactctgttgatcactctctaattgccagcatctccagaatgcttactgcctatatatcctgaactacgtaactcggaatttaattttataagtgggcaagaaggtcttaaccttcccttcaacttgaccaaacttcacacaggtttgttactgaccacaggcccttgatctcccttttctaagaggatttactttagaccacttggaattgtaaattctttctgtgttcccttaacacgtaaatcttctgctagactcctgtcagttttacaacccaggaatgtctttctcaaggtcctgggagccatcccttttgaaataaaatcttcaggaatgctactgttactatctcccagtcttagggtgaaggtaagagcctaacctctacaagcatcaattagcaaacacagatggcctcgtcaggatgaccaacgttacccaattaagttttctaatacttttccacttgctcaccccagttatcaataactcttcttttgtttcagcacagttcagttctctctctctctcctcttgcaatagtcttgatccctgttgcaataatcttaagtcttccttacccgcttgtccaggataacttctctttgatacactgataaattcagtagctatttcctgtgtgctatctttcttagaccggaatataagatcctgtaactattttaattgaataatgtggtctttctggaaacttctctgttaatatagtccctctcttcccctgtttactgcttctaccttccccagtacacacacacacatcattgacactttatgactgaattctaagttttttaaaaaatacgtatttgtccaggtgtggtgctcatacctgtaatcccaacactttcggagactgaggcaggaagatcgcttgagcccataagttgaagaccagcctaggcaacaaagtgagacctcacttctacaaaaattaaagaaaaattaaagaaaaaaaaatagccaggcatgatggtatatgcacctgtggtcccagccactggagaggctgaggcaggcagtaggatcacttgagcccaggcagttgcagctacagtgagctgtgattactgcactgcactccagcctgggcaacagagcaagacctgtctcgacagaaaaaaaaaaaaaaaaaaggtgttttgttgttgttgctgttgtttgtttgttttaaatacatatttggacctcccttctccactgctttttaacaaggtgctgagtggctaggaaacattcagtaaatactagtttccttggtggtcaaaatatttttcttctctggaactcagaaaatagattacagatgaaatatacgggataagtcagcctgtggtagtcacctctaatgactattttgactttctttcttgcttcagtcacagtaggctcagagtccttctcaacatcacatttcaggcagccagcaccacgctatcaaattccgcacataaattgaaacctactagcctttcttaaagatgcccttttaatctaaagaatatttgattttaaactctgttttttgatgagattcatcaccttcatgcttaaagagccatttattatttggtaagtaaactagttcacattccttttaaaaaatcaatatcaaagattaaactaaggtttttttttttccacacatttgagttgcgaaatcactggcagagggtgtctaaaatgaaatagaccaaaatatgctcaaaaacaacagatttttgttttcttgaaagacaagaactttcctagtcagtacatcttctaaaataaggcccttagaatgtgattgcctagaaaatattcactgcttttcttcttaaagtgttcattgttatttttgaagaaatgaagcagagtagaatgttaccagttttaatagccatcacttttactcatcatctttctaattcctagggttcaaaatataaaggaaagaataaaggaaccaccataatagattatgaaacatagagatgaccacggaaatggtcttctaagataaaaatacatgcaatgaataattgagggagaagagtcaccatgcagtcacttagtacacattgtttcctgccttaagaggagccataggtctaggcatttattccccccaaaagtgggggtgagggtgaggggtgagggtgacgggataagactggtttcaaggtaggtttctagttgattcaataaccaaggtaaacagagaaatgaggtgattcgagtttctcagggactctcaaagacaataatatttaggtaaacaagaaatatataagtgttttaaggttttcataatttctattgctttactatttttttaacccctggagtaagtgggggtgttgtctgtcttgctgcaatggcctcctctctctgaaaattgttgcctcttcccatccacatgttgtacacactaaggtgccaagtttgtaccttgacacctatctccagctactcctgtacatcaggatacacaactcactcaagatgaccaataccattttcagaaaatttgcaattgagtgtggcttgttagtttaaaataaacggataaattcctaagcagtgagacaaaatctaaatgcaacacacatggaaataaaacatacaggagagaccaaaaagggagaaaaaaaaatagaacaaaaacatggctgcccaaggttctcatcggcttttctgtcccttcatcaggccctcgaaaggacccttaaattctgtaagatacgcctgtgtcctcataattcattatttttgctaatggtaacataaatgactttctgtagttaaaaaggaaaaagagagtaagatactcttaatagtgcctttgtttttataggcagtaacaatagaaaacactccaaaggacgcgaatgtctttttagccacagaaaactgaaggagaaagctgtgctagcaatgatctgaaaggcaagggacacaggtggaaggccagatggttgttgccagaaggggagaaaatgggccaagttcttgatacccttgggatatagagatgcaaggtgaatagaatgttggccaggagacacaactggccccaaaggatttgaccaggcaaaaggcactagtcactcatagctttacactatgacagttgaaatgctttttaaatgggttctagaatgttatacatggagaaaatctactctttcccctatcaggcaaaaaaggcaagagggaaacaactttaagcaagaatgaaaatgattttttcctctgactaattgaattttgaggagccttgaatgtccctcttatttcattttcttttgttgttacgttaaaataatcaaaaaatagttttttaaagtttaaaatatgtctgcctgtttactcagaccccaatggagggtcatatttctgtcaattctttgattgtcaaaaagagtcaggttctggtacaagatctttaacaactgaattactctgaattctgttttactgcttaagaaggatggttatatttgtctttcatagaatctcagagttggaaaaaatcttagaaaatgtcaaatttaatttctcattcatatatacacactacctgtgtcagtactttcttgatatttttccttaagtagactcagtttttacctcttaataggaatttaatagaaaatcaataacatgaactaaaaaccagtagcatatttcagaaatagaaagtattcatttaagaaaatgttcatctgaatatcacctaaaatcaactggcatacacatattaatgataacattttagttgaaatagagtcctttcctcttgccatctaacaaggatatcatgaaaggctttgtaaaatattgtgctaagaagcagacagctgttaatcccaaaactcttcactctaaatggaaatctctttcatctaacttggcatgttcttagtaaatacaccttaattcactctcagtgtccactattgaagaccacatatacccaggaagatgctgtgacacatgtaagaggagcagttctttgtagaataaatgctttgtaatgattttattctctgctatctgaggactatctgtatatattgactacttgcacaaacgaaacttttacacattctatatgctcacatttcttcaacatcttactgaacaaaacaatttcacagtaggataccagtgaggattttcataatgaaaatctgcatgagagcacagtaataacatgctataattgctcagagagaaataattcttcatgtccaagtttgccaatggcacactccattattatttgaagtggaacaggtcacttaaatttctctgtatccatgtcacaagtttcatttaagttgtgcgttttacttgcaaatttacaaagtgaaatatggtttattagaagagatagtactggaaattatttgtcagatgtcttttgtagtaacatttctattcacatcttagcttcatgcaaggaataggaccatataaaaataaagctagaacacaaatcatcacatattcatatgtcaggactctgagcttaaagaagaaatcccttttatatctgtgataaactcagatgtctagctttccctgcaaccatgcatatcccttactggataaattgctaaaagaggttccctatacaaattcttatccataaaagcaggcatcctaatctgtacttgtcactgttattttctttaatatgtaagtcaattatagcaagctttaaatggaacctaatgagaaattctcataattaaagagaaaacagtacaggaacttcctgccaatataaactgttaatttcgcaacacatgctccatagactttttccaatttctatattttattcacactgtgtgtttccccaaaataatgcttttaatgaaattttcccattgagtacaattttcttaatttaaatgataactacatttttaatctgaaacctctttaagatcctcattggcaaaagacaagattgagaatcacttccattttcaggaaattgtgtaaaatcagcatggcagatatagcaatagatgtttctctttattttccactttgagacctgggagcttattatttgaatagccatgaaaaacagaatggattaacaacaaaaaaagagatcatacacatttttcttatcagaagtcaaaatggtatttcacttaactggctaaaaatacggaatgtaacatctcatatattaatgcatcttcctgtaagatctgttccaatatctaagcatatccaaatgctaaaatccacagaacagtgcaaggaaaaaatactagtaaaacccaatggaaagctaccatcagaagctgagtgtattcatctagctttgcactgcagtaaagtacattccgtagagtacattctgaatagcaatagcctacctttaagctgcactgtcttacatatttcaaatcacactttgtttgaaagaacagactggttatttccaagatatctcatgaaaaacttattatagttcgaggaaaataagagttgaagccttggcggaatacccaaaggcattttgcttttctgactactattcaaatcttacttggcccaacttgacagccattctttctgacaacgttaagcggtttcagtaagtggtatgtaacctgcagttttctttcacttgggatactgtttatagctaattcaggcacaagggactagaaaacataatattttcataactataaattacttttatgtggtttctcaactactatgtagtgtaggatgatgtacaggagtggaagaaagaacaatgagcctggacaggtttttcaaatttgagcaacagaaacggatttaaaagacagattacagggtcctcactccagatatttgaattatgtgcagggcctgaaaacctgtgttttgaaaaatctctccaaattattcttatattggagtaccttctctagacacaccggggttgagattaactaccaaatattaatagtgtgtgactgttaagaggaagaacgtggtgcagtggggtggagtgtgggaggtggttcaagatataagggaagagaatatattactttatttattacttcattcagtcatttattacttcaagtagacttcataaagaaaactcactttgctttgaaagtatcttaaagtataaaaaaaactttaactttatacaagcaatgaacgtatgtttcaaatatgcaaattaaatattttaaatattccaaaaaaagtatccatcttaattttatcaaaaagaaaactgagactcaaagaattccactgacttgtccagaattacacagctaacaaggtcaattacaactaaaattcaaattcaattctgcaaaacttatggtctttgtaatactccatgctgcttccttcaaatagtaagttaatttatcttggcctcactttaccaatggccaaaatgaaagaatgtgccagaggttgagaaatgactaacccagtaattatttaaaacatccaagggaaggtgtatggcccaatagcaagatttggccgaaagaaagtaattaggaaaagaacttcttggaaatttaaaataatttttttctactttaaacaaatatccaaaataattttccttaatatttaaaaagaggaaaggacaaacattcattgaatatcttactatgtccactgactatcctatcctgcatgctatacttaaagtgtattatttgatttaatcctcaagacaaacctctaaatatagttgtactgaatacatcatacacgggaaaaagtacggttaaacaaattaatttgtcaacaattgaaacaaaaagtccatgttagaatctataccgccttcccttaaaatcctatgtctttctaatatagagaaagacaacatcatatgcaatgagcaacagaacacgagtagcctttttttttttttttccaccatggaaagccttggtttctaaaaatgcattgcatgagacctttgtaattatgcagaagacagctggttattctcagttttccctgaggaaagaatgggagataataaacttcaaccatacttgtgacatttagattactgggaaataatctttagaagtattgggcttctagaagtattaggcaacaagagcttttagagtcaactatggatgaggaccttcaggggattatcaccttaaaaatcctggatcatttctcacttactggtattactcatgcacacccctcctagcttgaaagcaagagaaagtctaaggagactgctcagcagcttgcagcactgtaaatttatgtgcaggcactttcaaaacaacttcagaaaacagatttccctttcaacttacttgtttttttcatttagtgtattctatcagagcaagtccaagacaaaagctttcccaagagaaaagctgagataaggaataatgtattcggtgaaaatatgtaagatttattctaggtttatcattcagaccaaacctagtatctataaattatccacatttccccctaaattttatatcatcacaaatgtacatcaaaacaggtattcctttttaattgtcgtgaaatatgttatctcaggcaagtgtaataacttgaaaaatattcatgatacttaattacttttgttctttaattcatttaacttccctctgagggtgttagcatttcctagtatttcagaacaatggtttacaagttgtcttccacagcaatatcacgttcccatgtaggaatccctatggacatgattagtttagatataaatgaggtttatcaggaataattcccagataactagctctagcctatcctattctcacagtaattgtcatatccagtgctccagataccacaagagacaaatgcccttttacattgctatcaagggccagtattctacatttatgtttagattaagttggctaaacttttgtatcagtgtaagtgctaacactgacgttttacagaagagcttgcattttagttgcatatgtattaaatgatttggagactattttaattactaagatgctttgttgagagattattttgatacatttacttcggggtaaagttgagctgtgtgccctctgagtcaatattaagaaaggagagaagaggggatttgatattgtcaggataaactaaaaaggaaagaagaaacttggttggggcaaggatagtggggtgggggaaatggtgaagggtcagttaaaaagccagtggtggctacatggctgggaaagaactttggtgagtagatgtgtctagcactatttttttatgtggttgatttgaggtgtgaaaaattagcttccacccctttcctttgtagaggatgatcactggtaaattatgtgtgactcactgatgcttttgtggaagtgaattctctttggagagcttaaacagaaaaatgaagaagcagttaacatctaggttttcgaagtatatactcagagatcaacatctttgaagaaagatatacaaagccattaatttctctagagagtgcttcatcatgccccatgagtttataattcttcaaggcctaggtcaaggtctattttctccaagaaactgtttctgattatccatccctcggtgatcttcctcccttatgtaaccctacaattctcacctcctgtgccttttaatttagcatctaatactgtaattcataaaaggcctaatcaaaatagattaaaaaaaacagacaatggaataaaattcagaccaaagcctagcaaccatcttattcattctgcatcggtactggctggtgacagcttacaccacctgctatacaatgatgcaatccaatgtgcgagaatctttttttgttacacctttacatgtgctttcaggtgttttggttacagctatgggtatcagaattttattgatgggtgagcattttcttttcctaagacctaaaagtagcaggggaaaaggctcagcatgttttacccaaatagattttttttttttccgaatggataaagacaaactttggagccaaatgcttcattgtttgtgcataaatctcaacaggctggttgaattaagctctacatattcatcaacaggcattgccaataaagacacaaatacaacaaattaatatttttcaaaactctgtgtcttcagaaaatttctatgaggctttgatgaacaaaacacaaacataagaagcaccaccattgtctcactgtttgggcgcaatcattctcaaggacatctgtgctgattccttttcaaacttggatggctgctatctgaatcaggcccagatgcttttgttggaaaaaaaaatctgaattttggggttttcatttaagttgagtaacagctttctccactcaaacatgcaatttattttacagtgtgagattaatagcaataattgcctgggaaataaagaagtcttgaagaaaaataccacatatcaaaaggctacttaaaaaaaaaatgcgggtctttgctcaagcaatgaagctatgcttcttatttgcaaatcattctattataacttcagtcatactatgcagactactttaaacatctgaaatttaacatctgaaatttaaacatctgaaaattttaagtttttaaatgaaaaatcaggagggttgatattaggcttgtaaatgtaatatttgcatttacatatttctatataaaattgcacaattttatctagaacagaacccacctggcagtcttaacacaataattatttgcctaggggcccagaaagtggccatcagtagagattcaatttttctgagatgaaactattgagtgaagtgcattccctccttgataggaagcccaactgagagataaagttttgatggattcattaacagcccggcctgtaaatctcatctccactgagattttaaagcaaatggcattattctttcattatgctgaggcccttactaccctgttccgagttggtatttgaacctaacggcctaagaatatttataaagtgaagaaaagtaagggtacatttttttttcctttattttttccctcaaggcttgtctcacaagtgcaattacctggctctgggtccaggaaagccaggtctcagcatacagaatacattcacactgtgtcttccagcaacccaccagacctctgcatttcccaaaccacagtacttctcaaaccagcacaccttggcagtgctagggggcagtgcacagaagccagatttggcaagagagaaaagggaaaatatttaagtgtcaatgtaaagccacagtacactgcatgattttattcagctcataaaagggttatttctaggagaagtaaggaattctgcaaacatataagacaaaatcagaatgaaatgattattcaaagaaacagaaggggtgcaaaaaaaagagatgtctcctaagtcttttttgaggggaaaagggagaaatctaataaatctaacagaaatgtttacaggttggttacaggtattttttttttttttgacagatgaacacattggaaaggtggtctgggacagatgtcaacaaaagggtttgccagtataatgactgcaaggtgcaactacagagtacccacagttctccatctcaagtaaatcaattcagccttgagaaactactttgacaattataaatataaatatatacacacacgcacatattatatacacacacacattatatacacacacacaattatgtttgtgtgtgtgtgtgtgtgtgtgtgtgtgcaaaatacccagaatgtcacttccctccccaaactgatatctgtatacatttctatgttgtattggatacatatttataaattcaaaatttggagatacatatttatggataaatacctatctctttgtaaactacaggcaccaatatagcagtttttaatcttttaaaatctagtttagcatggaaaattatcctcattcttgttctttctgaaaccctcttactttatatcatagtattttgatgaaaaagaatacaagaagatcataactctcaatcaatcaacaattatttggtggtgaccagtaatctgatcagccttgtgccagttgctttgttgataaaaggactcaaaaccactgtcctgacataaacaagataacaacatcagaaaaaaaaaaaattgtgaggtatgtcacttatctttctgggtctctacttgcttgatttttaagaatcatatacaaataacagcagcctcgtatttttattctgtttatagaaatcagagattatatatgattttagagaagggagaaattagaaaaaactctgtggtttgaggtgcgacctgcagaggtcctgacatgtggaagggttggggtgaaaagatgaaaggtgaaaggtcatttctgaccaggaaaacaacacattgcagaggcacagatctggaatttgtatagggcatgtgggcacttgggaagaggacattaaccagctcttatggaaaggagtagtttgcagaggcaaggctgagtcaggcagaggtagtcctagaaagccacacaggagtttagtttggatgcatgggcaagtcatgcatccattcattctacattcactgctcatttcctgagttcttcctctgtgccaggccatactgaaaagcgatgacccagagtgagagaggataggcatggtcccagaccacatgaagtagaatctaagactaaagtgccagatttaaaactgtatataagtgaagagtcttcacattcaacatgacatacttataaagattttaaaaaggtctttgatgtttcatagtatctaacgttgttgcctagttctctcaaagcataattaaaaatgtgattctcttgacatgttataagcaataaaatttggggagaggaggggatttctagatgtcaaagtaagtataaatgggcatagacatgattaggttaggctgaaaggttggttggtcattgtttacagttggtggtagaacatgccaagttagatgagtcccaaagagattttatagctatgagatatcatcttgtgtgttcctggctttcagattggtacttgtcaccatggaattctagagcagcaaggaagtgcagatcttattattttgagacagagtctctctgtctctcaacctggagtgcagtgagatgaccatagctcactgtagcctccatcttctgggctcaagccatcctcccacctcggccttccaaagtattgggattacaggcatgcgccaccacacccagctgccgtactttatttagtttcaaactctattttctgaatgatgaaggtggaattcaaattggtcaaggattttactaaagccacacagctggttagttggcaaatcctgagctaaaaataatgtatactgattcgtataaccacccccacctttaccaagtttgagatcagattttaagaggatgctgcaatctctattctcttcataaccagaggagcgtttagtccatggtcctggttcccacagtcaaactcttttggatctataatttatttgtgaatgaaaacaagccattacaaagtggcaataaagcaaatgtagggtgtggctatagcaataattaatcataatctcaggtcccaggtggttcatcttgagctgatatttttttcctactgtttgtgacatgatgaagatataaatagattttaagtttaaatggaaagcaaatccatttctctagcagttataagtgtattaatagattgtttagtcactcgaacatgtttataatctgttattttcttaagaaatactctcagggctgggtgcagtggctcacacctgtaatcccagcaatttgggaggctgaggtgggcagattacctgaggtcacgagttcaagaccagcctggccaacatggtgaaaccctgtctccactaaaaataaaaaaatcagccaggaatggtggtgggcgcctgtattcccagctacatgggaggctgaggcaggagaattgtttgaaccagggaggcagaggtttcagtgagcagagattgtgccactgcactctagcctagaggacaagagcgagattccatctcaaaaaaaaaaaaaaaaaattcatgctagtatagtaggaatcagttgcagagtcagggaagctaagctttgcaagaaaccttggaccatttttattcagtggtatcataaatttatttggaggtacgatactttagaatacacatatacacacacaaaacacatttgcttattatgtcagggggttcctacatcttttgaagtctctcttcagacccacccttagctaagaaaactgatttggtgcagtcatttaacttggtacatggatacatttctttcagcattaagtggtctaaggtcaactcatgtgtaggaaggtcctgagtcaggaaaggaggaatactagacacatcatgttcatttcaggtccaatcccattgcaacgctgggcaagataacttacagtctttggccctcaggttcttcctctgtaaaaaagataaatgatcacagtagtacatgactgctgtttattgagtacctactgtgttaatgctaggcactttacatatttgctttcaattactgctaatatcaatattttgtagtagacatgaatcaccttttcacagatgagaaaaccaaggattagaaatggaaatgtgcctcatatcacgaagtaaaaagatccaggatttgtaccatttgtctccaaaatgcatgtccttctctatgatatggaaattcctacttgtaaggaataaggcagcctcatttatctgcctacgtgaaaagagccttcaaaataatattataaaaaccagagtttcatatcaatgtgatatagttgagcatttttataattctagagaacagaatgaggcaggaatgagagggaatatgaagaaaaggataacaggataacattctttatgatggggtacctgatttttggtgtcactgactatcatatttggtaaggtagtttataaaggggtttagaaagttacactaacagcttagaagtccaataatattttccttctaaagtattcaaagaaagaacaatgagataactttaaggagagtaaactggcttttcagatgaactttctgaaatgattatcaaaaagagctctagttttcttatgtctaagataaattattacaccaccgcagcaatttcaggtctggactgcttcctgagtgtagccccaaataaaggtcctcaagacacttccaaatatgcaaatcagctgagtgggtttgtgtgtgtgttaaactgtattgagtttcagagtaaacctgcttcagagtcagctagggaaacaaaccacagtttgattttagcagagtgaaggacaagcacagtccatcccctttcacaccccatagcttcaccaggtatcagcacacagccctttaaagattaagctctaaatggccacactttttgagactttaataaaaaagctttttacagtatttctcctaaaaatgtctgaaaacaatttgttttcttgaagccaaagcacagaactacagcttcccctcctctccctattattgtgatttccaaatgaatggcattgagttgattgtttatcatgctggataatggcttaatttattacagaaaccctagtcagacattaaaaaactgtaaaagcccactgatctaccaaatccttttgagacatagggcctatgcgcattaaaaacctgctagaccatggtgagcctatgagataggaaacttttttgtctcattagcaccaggatttaaaaatacagcacctcctcaggttgaaatgccaagcttgagactgctgtgtgcagctgggtgtagaggacacctggataagtcttaatggtgtgtaaacagcaggattagtgtttctgagtctccgctgtgcagagattttccgttggcttactcaatttacacacaaaaggtcttaggttcctttgggaaaaaagtccagctagacaaagaaaggacagaggaccttttcctttcacagggtatttggattcatgcatgcattcatccatttaagaaatctttcccaaaacatcaactaagacccaggtactgtgctaggtatacagtggtaagcaaaatcagacatgtatctgatcatcataaaagctaaaaaagctgtgggtcaaacacacacatgaacttcagcctgatttcaagctccctgaatttataggaatgtcttatttatcttttcattttccaagagactagcagagtgacttataaataataggtgactaatacacataaaggtaatggaagtttttaaacaaagtgtgtatgattagttttaaagtagtaataataacaaccattgtcatttattgaaaccatactatgcagcaagcactgattactcgaaataatcttgaaataaattgataggagacatttaaaaatctatgtagaacccacaaccccccataatactgccatatcacaaaaaatattcatttctcctgcgaagctgaaggcattaagatgctgtgtgtactgatttttaagaaagtgtcccaaaatctctgggccttttccaaatgcctatgtgaacagaggagaaatttgcagtatctgtgagacgtcctttgaaacttggtttttgatgagtgcactgtgtccaaagcagtggttttcaggtatcaagaagcacccggaagaactgttataacacaaattgctgtgctacatctccagagattcagcaagtccagggtggggcctttctaacaagttctcagggaaggtcgatgctgacagtgtagggatcacattttgataacctgcctttataggatttcagtttcaaagtctgagtcctactatgagaaggctctctttaagaatgtataagaggaaaagagtgcgtgtgtgtgtatgcggtgagggggagaaaaatgaatggatgaaggcctcagaaaactctctgtggttcacctccatcccagaatgagcaattgtagttctagggtctacagacaggtgaaacgacagaagacagctaggaacagtgcaagaaatattcaggtattatctttcagcttgattactagaggataaagggaaaggaagctcttagactagaaatcccttgctatcctgtaatttatatttcattacaaaactaaagaataaaagtagtcttatccagagaggggaagtcagtccaaattctggagattcctaaaattagtgtgtgtctctgtgtgttaaatcatcccagttttataaaaaaggaattgaggctcaaagaggtcattttggaggatctccaggatcaaaaaggaagaacaccaaaagctgagtctggtccaggtctctctggttccagagtgtatttacccattggaattattctgtctctgccttctctaagtggctccaaatatataaatgtgtgtgtgtgtgtgtgtgtgtgtgtgtgtgtgtagtagcacctggcacacagtaattcccagtaagcatttgaaagttttttttttttttttttttttttttttggtggtgggggtagtagcacctggcacatagtaattaccagtaaacatttgatagtttttttttggtggtggggggatgtacatacatctactattaactgcttactgggaatgggaattactatgtgccaggtgctagtcatatttatattagctcatttaatcttaaaaacaatctgagaaggggatcttacagaatcccaattgtatagataaggaaatagaggattaaataaagtctcagaccttggagaacttgcaaaagaaaacaaacaacaaggacaaaaaaacgaactccaaaccaattttacctcagagctagaatttttcatgttttttctttcctaataccagctacctcccaccatttggccaaattggtctgtctctggctctttatttaattatgtttctacggaattagattatcagtatcaaatttaatatgtaaatgaaatatccaagaatataaagatttctactgttgaatatcaattattagagaaaaatgtgaagagttccaccacattgaaactgtggctaatggccacattagggatgatttatatctatattagagtttcagttaatgtgaaataaaatgtatccttagttttttccattctcaaaatgaaataaacctgaataaattattatgaattgtgtactatcttacgacagctttttgcagttaaattgattaattgttattatccaatgctgaaatcattttcttgtgataactgggcaagtgagttaaaattttctaaggagaccaaaggcaatccactctgacacaaggtgaatagttttaagctaaaggtgacttccttgcagtatccatggctgtcatgaaagtagatgttaaaatatcagatctatttaccctcttcttacttcacaaaacagaatgagttatatagttataatttacacgcctctttaagggcaagtacaatgccagtgctggtctgtactgacatagagataacactggttaacaacggaatgattatattataaaaagaaaggacaaaaaaattgggttagtattagagtttatggaactcagagaatgaggccaattcatgctactctggagaattccaaccagctacaagcacactttccttaaggaaaaaacaaaaactgggttataattcattaaacttggctccttgaggtctgatgagatgagcacagggaacctgctctcttagcacaatcactactaactgacaatgtagtcgagaacagggtctgtttccataatactctcttaagctgtttgctcccaatactcttttaataataatgaaataaactaccttctcaatttttcatttcagtgctaaaagttacttatatagttttctaaggaagttcaccatgagcattgagtttcagaggcatgttgaactttcttaggacatctcatgagctttttacttttgttttttcacttgatgcataaaacccctaacagatacagaatatattcttctttaaacatttctaagggccctcttcccatctcctatgtagtgacagggcaaaaacactgagtcctagatgctcatggcccctgattaagacctgtggttgggaattcatgggaccctatttaaaccacctgctttgatggctcattgaaatcagaaggagatttttactctctcactgacactgtataaatgttagttcactacagggaaatggttgagaggggacagacggagaactgtgaagaaattaaaggacctttaatggattaaaaacaaaaagccattctgctctccagggtgcacatttatttagttagattttcttaaaaatattctcaagcctccaagttcaatcgaccagaatgactttaaaaccttttttttttcctgctccattggagagatatgcctttacatgattactttaatgacaattatctatcaggtaattgcaatgtaaagctaatatgtaagtatggcagaacctgtgaattttacaagtctaatgtctccagggtattttaaaaagcactttggctacatttttaaatctaactaaccattccaacagacatgggagttactactcttgggcaacattcaaaagaatgggtaaagttaaaaagagtaattttctgaagtatttttgacagcaattaatttcacaggggatacattcatatcctaaatctccaggaaaaaatttttttcactgtagaacaagatgcactttttgaagagaaattcctttactagagtttatactttataatgacctgaactgtagaagaaatataattaagtggattcattactatttcttttaataaggtaacttaattgcattttccccaaaccgcagaaaatttacagttattgttcaggcctaaaaagaaatacagttaatcaacctatgtgtccatcactggatgaatggataaacaaaatattatatatatatatatatatatatatatatatatatatatatatatatgcatacacacacacaggaatactatgcagccataaaaagaatgaaatcatatattttgcaggaacatggttggaactggaagtctttatgtgaaacaattcagaaacagaaagtcaaatacttcatgttctcacctataagcgaaaggtaaataatgtgtatacatggacataaattgtggaataatagacactggtgactgggaagggtgggatggagggagggcgggagggggtgaacaatgagaacttacttaaatgggtacagtgtacattattcaggtgatggttatactaaaagcccagactccaccactatgcaatatatccctgtaccaaaactgcacttgtgttccttaaattgatacaaataaaaaaaattaacttcaaaagaattacagaaacagagttacagaaacaagttctatacataagcatattatcataatttattgttaaagaattaaaattattgtagacaattgatatttgtggtcttttaaacttgatattaaaaattgagatcaaaatttcagagagactcattgacagcattttatttccatgttggcaatagttctcttctcctaatggtcatttgaggaaacattggtttacctctttccccatctctctgtatacacttaaattcaaagtataaattgtaggattaccttaacattcaatgtatagtcagaaaagaaacataattaagaaatataaaagcttatcatcttgaaaaattagttcctaaatgccaacttggagattttaaactaattttaaggcaaaacaatgtaatacaaataaataacaaaagctgatattcttcagtatagaaatgccttcatgttcatagtccaatcctctttaggccttcagacacaatgccattgtgttttctcccttttttaaattcatgtgataatattgttttcttgctgacatgtgatctctttttataaggaaataattctttaagttcaataatgaagcaattaataacagtctgaaataatttagatggcattggtcctttcttctggaaaaacaaaccaattcattggaattctcttattcaaagttaaaaggctgaaattactatttatgtaataaaataatgagaaattaacaagcaataccttcacgatgacagaattattattactattgctgctactactgtaattctcaaaatttttccttagaaacaatttggaagaaaatgacacagttaaggtatcctgacttaaaagtaagtcaaaaaaataaaaaaaaaagatgactattaaagttttaatcactctgaggagagagaatggaaaaaaccacatagaagaatcaagctgaagatacaagttaaatcaaattttaaagaacattgatatgaagctgtgaccagttttagaggtttaattagtaaggtaattacatatagagctactgatgacacacagcctagaggttctatattaatgaaaattaactttaattatttaatttgtctaattaaaaggtagttatgtcactagattttgaattacattaagccaagtacaacacattacatccttgtgtccaccaaaacccaacacattcttagccctgttattaactcaacataagtgagttgatttgaaatttctagttaattgacaatttaaggcattaaagttgaaagactcaactaattaaatacatcattcatttattgaataaacagttgctgagcatctgctcagggctaaataccatgacaagtttggggaatgcaaaagttaataagacacttaaatgctttttggcttttaaaataacttattagaaactgtcatttctacattctaggtactcaataataatattgtaattggattctccagaattatcataattttgccaataggtaaataacattttctactcagagaaatctgtgttggcatatcaaatatgtgaaatttggagacaaataatataaaaatacattactctccaaattcctaaattatcaaatttcctagtataattattattcatttattataaaaccaaataaccataggtttaatcttttaaacttcacttacccaagcttaaatttctaccatagttcccacattgagtaaaatttagtcaatcattgagtcttcttttaagaggtgggtgctcgttatgttgtccaggctggtctctaactcctaagctcaagggatccccccgcctcagccttctgagtagctgggactaaaggcatgcaccaacacacatggcagtcaggtcttattttgtacccagacattctcaatggcttcctatgtagtcctaattacagctctgcatttgcaacttactattcttttgcataaatcttccagtttaagtttttcttgactctgtctccagaaattactttcctatcaccacacttttgagcttgtaacccatgtgttgccctattatcttcttcctttgcctccaatgatctaaatgttgcctggattcttggaaacattttcccctttcctggacttccaaaaagaagctcctcaccaccctttcaatttttcactcatcacatcccttttgcaggatgtcgtttgcaaaagaccatatgcaatctctatttagcatatacaatttatcatcaatatctcaagctctctgtggttaggacctatgtcttggacttctgcacaacatcctcagaagttactactctgctataaataaaatctcaatatatttcattgaataagttaacaatagtttttgaggtgctgtgggattttaaagtacattctgaacatatgtgcattgtaaaagtgttaatcacattttattgaaaaattaaaattatttgaaagtttcatttatcagtagcatataggataaatctttgttaatcagaaaagtctattaatcagatctagcattttgaattgttccgaaacaataaaaaatagagatctacggaatttatctgaagtttttgctcagtttattttcagtttatctttactgcaatcctaagcaagaatgctctcctattctctattatctttataatttatcaatttattatttaaaatgtcctattcctgtatgacattttacaaagctaaatgttttttctaaaaagccctatattctccactaattagctgacaattatatgatttatcatttttaatatggctttctttcaatttattcagataagcaggatctaacatgggcttataaggtgaacaaacgtagaaagttctaaaatattatgatctcccttcaagcaggactttataaatgtgtacaataaattatgctaagtaaatgagataattattcattcaatttaagagaaatatacaggcacaggccacattgttagatctagatatgtttaaggacatctctgctgctatattgtttctaatttcaaatgtatttaaattgacccttttttggtggagagtgttgggagaaaggagaaactcaaaacatgccgaggggtcactaaaagcatattaaggagcttcaaaattttcaagatgaatggtatagaaggatttctaagtttagaaaaattcacttagtttaagcagagatgtcacattcaatttcctcattcatccattggtctaaatatattaaacactcactacattccacatattaaaatttagagtattttaaagcccttggtatataatgttcctgttcagtgaagaactccattttcatttctaacaggtctaggatatgcttatgtattttaatgtaataaaactacttcattttccctgtagagaatttgaaatatttagagaaagtgtaagaaaaaaaattctcataacaaaccctactactcagagacaactacctttaactctttcacatatttcgccctccattctttttcccctttatgtgtgtgtatgcatgtgacataagttagttactcttttatatatttttcatatttcttctttatatataatgtgagtcatttcacagccactatcttcacggaacttacgattttgtgggagagagagatgtgagaccaaaagatgaactaaaatgtaatgtgtaataatggtgattgtacacagtataacccatgcctacacaagggcccatccatcagtctggtggagtgcagatatacgttgttgagctgagggttgaggagtgtggagtacttgcaggagctaggtgatggggatgttgaatggggagcgagtagtgatattgggtatttagggtctaaggcataccttggaggtggtagaaaactcgcagtagaatagcagagtaatgtttgggtataggagacaaagtagaggttgacggggctaccattttatgctaaatagtcaggtctttcctttaggccagggctcaagaaaataagaataaaataaaaataaaataaaataaaataatcactctcactggtttgttacacctgaaaatctcaggcctgatgcagtggctcactcttgtaatcccagcactttgggaggcaaaggtgcgaggaccacttgtggccagaagtttaagagcactctgggcaacaaaacaagatcttgtctctacaaaagaataaaaaataaaataaaaattaattagctgggtgtggtggtgcattcctgtagtcctagctacatgtagtgaagaatttacacggtcaacaatcaaaacttgagattgaagcaggaggatcatttgagttcaggagtagaggctgcagtgagctatgattgtaccactatactccaacctaggtggcaaagcaagaccctgtctctaaaaaagaaaatataatttcccactcccccatatgatgtctaaaagttagatcacagacactggaaccaaattactgacttagaattctagttccaccattcagtagctattgggtcatgagcacattaacctatctgtgcctcagtttctttataatgaagtaaccataatatctagcccttgaggctgttataaggatcaaatgagataacatttataaagccgtaagaatggtgactggcatataataacactatataaacggttgttaaataaaagcaatacccctgtaatatcaaaacaaacaaatcttgatagccaaaattcctgctacagaatagaattcatgtgctttggggtaattgctaatgcactgtatagttacttctaaagaatttcatgattataacattctataatgaatcaatataataatagcatttctatggattaatttaaaagattaagcatccaagctgattataattgagctcatttccagtctggttaattctggcagttttggagcagcagagtacttaggttctgagttatttttcattttgggcggggtggtttatgctctgaattaaccatgagctccactttagagaacttgaaaaaattgactttttagaatatttttggcagaatatacaaattgcttgataaactgcaaaagattgagtaatttttcaaaacacccagactgcacctgttagatcattattatttcagaaattccatattgtacattgaaaataacctcacaagtatattttctgtatttatggccaagagctggtcattggagatttatgatgctctgcaaaaaacaatgctgacctggcaagtgcctccagggaaggagttgctcagaaaccagtgaatgaaataaattgctattaattatggtactaagtcttaactccagcccaccccattggtttgtgacccaaatgtttttaaataccttaattcaatttataataatgctgcccaagggcaaccaatttgcctcatatggttttctaggacacaacgtagtattttggcacactgcacatgcttaaaaattatttgttaaattagttaaaaataaatcaaaccaaagtcatcaacaaagtctgtttcctattgagccatgaagtgttttgcaaagaatgactctcttgtcttagttcagatgccatcttgatttaggattttcacttatccaacttttcttacaaggaatagttaattccagttattatttccctagcaccgttatctcagatagtgtaaactgaatatcaacacatacatatatcatactatcaattctttgtcaggtacttgatacactttagatttaatcctgacaaccacactgttttaaaatgggcatttttccatctcttttttttatagatgaaaaacctgaggcaccaataggggtactggtcacacaaggagaaaggggagacttcaggattcttttcttctaaattaactttgaaatcgttttactgttagcatcacgttttgagaataatttttgataaatgtggtatgcttttatcctaaaaagtgtattttcatctccaaatgaaatagtagtaataaaagtaataaaactttttatttcatttttttctagcaagagatggtcttacttttacttccaacaggagaattcttagtcaaagaaaaataatctttaacacaattaacagaaaaaagttgaatctcatttcatttcctgtggggccctcccaggcctaccattaatactcattgctaccattttgcttttctttggtccattaagtaggctgacagtccttcatatttttatatactacgttgagaaatgggaattcctgtcaaatgtatcttacgaataagcattactataataaaattattaaatgggtagatttagatgctaaaactggtagaaccacaattacaaagtatgtaaaaaagccccatcagttgtccatacacaaaagtggtgttatatgttagtgaatataaaatattttatactagagcattctgctcccaggagttgtttttgttgtgttctactttgttttaaagagaaaattctctagtagtatcagactctcccccaggacaaactttcagtttgtttcttttgttgttttgagagaacatatttacaacttaattttcttaagaggggtacatttttttgacatcactatattacaatttgaatcaaaactaagatgttgaccatataacttcttcactgcatgtaagtatatcaaaacaccatgttgtatatcttaaatataaataaaaacaaataaaacctagtataccaaatatggagatactaagattctactaatgtacactctccaaccatgagacaatccatctaaagatgaaagatgagtaacatatattagttcctcaatatattttagcaattattattattattactattcttattactatatattcaaatctttatcctaaaatccagccatttttctccaatgcttttctttttatggttttcaagcttgctcttgggaaacaagataagatttctacctcatgcctaaccaattacaataggccttaaaagctaagctcctcaattgagattttatttcttttcccaattacattctccccatgggattttcttagaggtaagcagagaccaacagaaccaacagcttgatatccaggcataaaagccccaggaattatgattttgtgttggcagatggtcaaactaagctaatgggtggcagaagcaaataacaccccagttaattttctagctcaatcaattctgatctcatctcaggcttatagcacattgcactgtcagcccaaatttaaaaagacagtacattccctcaccctacagaatgcagcaatagatactacaaccagaggactcaagttctaagcagacagctttgaaagtggaagagaccctgtaattccatgttgtttattagactgactcacataagcctcactcctgacagggattctgtcatgctgggtgcaggagtggaacacacctagcaaggctaactactctttttccagcccctcctggattgtaactattaagacgggcaggcatgatcccaagtaaagatctcaaaattcaaactgttgaaactcagaagtacatcttcctcttgatgaatataaaacccatcctagaggagaaactaagattttttttttctacctaactgaaaatatggcaagggattcttttttgtttggtttcttagaacatttccaaaactctgtgacaccattatcatgatgaaaaattccacttaggaagtcacaaaaaatactgtggtctgatgctggggactattgaaatatttaaaaacacaattatttacaactaaaatgtaattaagtccaacaaattcttttttaatatttactatatatttcccactgtactacacactaggaaagcgaaggtgagtcaagcccagggcctgatgtaaaataaggacattcacctttctggttctctttggattacatgtatattataatgcataatacaatatcagtatttgctcatgagttctccattctttcaacgtcttcttttcacatctcattatggtaagaatctgtaattctaatgagatcaaatatgccagtttatcacagtaactaatatacattccaaaattgccaacaatctccacatttgcctaccgttcggctctttatttttaagcagtaacatggtagaagagacacattacttctttatgttcttgtaagaagataattattcccatctaccccaaaatattggtattatgaatgacttagggggtacatatgggagacaaatttaaaacaaaaaataatctgattcttttattggccaaaggaaatctgtttgcttctgttaaaatcttataatatttttaacagagttcagttacttcttattttcttcctccacatatccacattggtaattgttacacttaatttttattgaactatttaaacttcattttaatgttttactgtctctttcttcctgttaaaactttactaactcatctaaaggatggtgtcctagttcaatgttaatgatgtgcttgatgtaatctcccactcaatacacacacatccccaacacacacatagacacacacatatacacacacacacatatatatacacacatacacacatacatatctacacacagtttgcagtttattttttctattgattattcttaaaaagttaaacaaagatagagaacatcacaaactacttttccgttctagtctcagtgcttcacaggctagttaattctaaggtagaaaagatggtaaggagattagttgcagggactagaaaattctactttagcagctgagactttttctctgcctgctcaaacactgaactttttccactcccagatcaagtccaatcacatcttttctgaatcactgcattaaagtgattccttctttctttgagttctttatgctttagtcatttacaattgaacactaagttatatactttaattgttcttttgttgttttccaaattcatattttgcctcctgctaaatctgaaggtttcttgaaaacaagcaatataatcacttgactatactacattaatagtatttgaatggtaatatgcatgtgaagagttagttaatacatactggtgaactgcttcacaataatattctactcataaaaccatgagtgtaacttgttgcagggttagcaaggagccagaggagcttagcaaagccatgctctgtgggaagagtacaaaaacacaaaaacgttagagaattcttttccttggcatcaactcttctgagatggagccatataggcattccataaatgttaactgattgtgatcaacatattttacttccaagatttcacatccaaccacctgccactcatccacctctaatgttagattccaaagggactgcaagttctgttttccaggtttgcctgcttgctcctctggattctgctttttaaggtaggaggcaagtggctgtgagaaggaacacatactgcttttaaagaaatctgggcaaaacagttcaataagtgcctgaaaacgaggagaattataaagttactgaaaataagaatttaaaagaggaaaaactaatgcattctaaattctacattaccagagcccacttttacttgcttcacagttttcttcagttccaggaacctgcaggaaccctcctgaggctgagtgccattttaaattttccctgtgagtagaaggccctgtgaagtagctttagaagttttggaaggtttactggctttggtattttgtcaggcagttcttttgatcaattgctgagcctgacaccagaaggccctcctcctccacctacaccctacagctctacaacatctgaagtcgcctccagtttctattttgtttttgttttttcctcaaaagaaaccagaaacccatgtgggcatcctgtactggctttttataaactctgtaattctagaaccctggacatcagaaagactaccacctctttaaaagtgactgagctataaggattcaattaaggatgatgaagaagaaattgctcattcctttgtatgtttcccttatgccaaccacagaatacaataaatagcatggctgacgagattgttccacagaacctttcatcagatgtatttggggaaaaagcttataatttaaaaataaaactcttcagaatcacctctgcctggtagagtttttccttccccagggattctctacaaggtaggtttttgcttccccaaagattctcatgtacaaacaagcactttaacagtactattaatacaacattttaacaaaaggtgggagtagtaaagatttgttttttgttttttagagcaccatgatgggtaatttttgttttatgtgccaacttggctatgatgaccagttgtttggtcaaacactggtctagatgttgtaaaggtaccctgtagatgtaactggcatctaaatcagttgactttaagtagagcagatgaccctacatagtgtggctgtacgttatccaatcagttgaaaaccttgagaccgaagacaggtttctcagaaaggagggattctgcttctagactgcaatatagaaattctgcccgagtttccagctttctaagtaaagactgcaactaacccttacctgaatctccagcctgccatttgcccaacacatttctgacttgccaggccctacatgagccactttcttaaaaatcaagcaatctataaatactcatatagattgcttatttgcagttatttctaattattttttctctcttaaattagtgtatattgctagacattagtcaagagagtatcatttcaggagttatgaataaataaaattttctcccaaataaatgttttaatttttcttccatcatgctttaaatgtatgtgttaaaaagtcaaatcccttcatttaataatctgtgagcagatatgatgatgtaataggtagcacattaagatctaaaggaaaagaataggggaggataggagttggggtggtgggggcagcaggtggtacctatttgccaagttcctctttctcagtttcgcctgtggtctagtctgtgaacagatgaataaataattagaattctctctttccacctctgtttttcttgctattctgaagtgcctgaatatgcctataggtaactgtggatccaagtaccggctataggaaaagaatcttgtcatgttgtgttatggtcgtaatgctacagaaagtagcattaaaaggaggtgctgaggcatgcccatggttgagacgtatttgcggcaggctccgagtcctgccacccagtactccacacaaactgagctatggaagaaataagtatacatttttcagcactgaattaaagatgcctcttttcccagtactctatactagcagtagaaatgaattccagggatgtgcaggacaatgacacagacaaatggttctctgctgcatttctgcagtcagatatgggaactgcagaaacatttgctttgaagatacataatatccaataagcaaagaagctgggttttttccctgtgaagttatccccaagagaaaaaaagatcagaattagaatgctttgtaaaagtatttaaaactttatatgttggcacccaagaaatgtagctccactcacccagtatcaggttatctcttttgatttcttttctaaccaactgaaataaggagtatatgtattctgaaaggccaagacaatgttacatttcttgcttgtcaagttaattaaacctcagaaaataaaggtattttgtagaatagtcatatgtgatcacatattacatgtcaatcttcacaatttataagcattagcatataagctctattaaccactgtgtctcccacagatagaacaatgcctatgatactcactcatctttgttttaggagtaatcagtcatttttaaaagacatgacatcatttaattgtcattatggtttctgaggttcttcatattctaaatgaatgtttactccaaatggccaacaatttgcacgaggttaacagaagaatcaggcattttgtgttttgtcttgctttcagaataacagaatttccttcctagacataaataaatggagtttgactgtgaacaccaattatggaacccaggtctatagaaatacactgaaaataatgctgcaaatcactaaagcaagaggataattcacaacaaacatcagtatggggctgtaccaaatggaaccatccaaaggttccctgcctcaggtaacaagctttaagcaatgcttgtaataagccctggggaacaattatgactagagaagacatgagtagagtcaaggtgtctcaacggtgtcaggacacagagaagtcaagagatatagaccagatttggcagctaattttagattattaagtagcatcacattatcaaccatatgaatttattaaagcaactttaaaactttattcagatgaacttacccagacttctctgagacaaagcaaacagaaaatattttcctaaaagatgtgcaatgtaagagtcctcctctctgcttaaaagcataatacgttaaaatatcagactgatatgtgatctcatcttaaatatttcctgtaagcttcatcttcctgttttctttagcaatctattccccttctgtccttagaaagcaaagggtatttgatgctaatgtactttgttgcaatatatacacatttctcccttgttccagctttcctaaagacatgaaaaatagcattgaatcctgtttctggcatggtcaatgttattcggctataaattttctgtgatttagtacatgattttggttgacaatttctacttttactatgcagtataactaattaaacattaagaagctttgttgtcatgctgttgataaaaatggcacttgcaaaaattactaatgactaattctataagaaaggacacacagggttttctttcctacccacaaggacttctgaattatggaaagtgaggtctagacaagatcaaacaaggctggaagagtggaatcaggggctggaccctgatttgagtgaggaggtttaaatctatgtgcttatcaatagatttaaatgttaaccaaataataatgtctctgaaattgtatataattaagaatacatgaaatttacattagagggtaatgccttttaatataaaattattattcaaatgctgtagtaaattcctgaatttactactcctgtcccaggagttaatggagtttgccagctgagaacatactgtttttttaaaaaaatataatacaaacttttttttctataaacgcaaaaatagcaattgaagggggagggagcgaaaattctgtcctatgttcagtgtctggaagcaaaacatatgctcaaatttttgttctttgcaaataactacttttcaataaaacaaccactaaaaggatatattgtcaaaacaaaacactgttttcatgaaaaatgacttaaaaagttaaagtagaatttatgaatttctaaagactgaattaggttacattgcctaacatttcaaaatcaacctcctaacatttaagtagattttcagttacacatatactttaaataaaatgtggtggtattttatcactaacatcacacatggacaaaccacatttaaaaccatcgttacatttgtttttccaacatttcctctggtttaattcaaaaagtatataataacttcatttatgaaattcctactatttttcaggtattttccatgcattatctctcgtttaaaatattgctttcagtattttatttaaagaaaataagtttcaaagaatttgtgtaacagcccaggtgacatagctggtgtacggctgagctagagtttaaaccatgtttatcaggcttcagtgcagttttctccccatgttacccagacagaaccagcaaaccataaaaagttttataagcacctgatctcagataaaaattgagcgccaagttaaagacgaacccacaggtgcccacagtatttttattgtcaccatcagtagtgttctcaattcctgagaaataataattttggggatctggaaacaagaaattgaaattcatagcatttcttagaaattccttcaaccataaattattatgtacctttaataatattttgttttaagataacaatgagtgaccataatcataaattgtgtatcatttttctgtaacagacttatacatacaaaagtgtcagaggcttttctataaaaaagatatacagtttttattattaaaacatattgtgaaaagaaaacatatatatttttataacatcaaaatatgcttacctgacatacatatttggtaacagacaactgtcatagtagcgaatgttaacacaaaataaatgtccataaaattattttttaaattgtaatataacaccacagctatttaatatttaaatgctattattcttaaaatgaaattttgaagcagataaactaactgctctctctgaaagtcttgacctttgttttgtgacgaatattctatttgcaattttcttttcatttttgcattgacattagttgaataattaagagtaaatccgaaatggtcttcatgttaggcattaaggtgtatatactgatccatataagctaattttctctttgaacataatagtttctaggtttatccagagtttggttttgctactgaaattgacattgcttttgttaattgaagtttttaatcattttcagatttcatttcaaagtagttcacaacattcaacatttacatctttttttttttttgcattttaagtatttgtacacaactgtaccctacagcaaatattcaaacactggaaaatatctgtgaatgttattggataacattaaaataatgtaaaatttgaattgctcagcaacactaatactacacagaatcaagtgtagaaattgttaattcaaggatacattttgcctccaaaacttgtttcttgggacactataggacttacataaagtatattatgtgtaaaaacatataaacatattttgtatttacaagtatgattactcactgttagtagcagaataaataaattgtgatttaggtaaacaatagaatactataccacaatggcaatgacaatgacaatttagaaacataatattcaagtctcctgacacagaagcctacaaactgtgatgattccatttttacaaaatacagaatcaggcaaactaatctacttagttaaagtcagaatgttgattactttcaggggtgcagtgtgtaacagccaggaagggagcaccaggatggcatgcttctgggagctagaaatattctgctttttgctaaacacatgtgtgcactgagtttgtgaaaattcatttatctgtattcttagtatgcttcgataaaaagttaagaaggtaaatataaagcacaaaaaaatgttacttcaaaacttttgacgaaagcagcttaccttttgaactagtttctgcagcagacaagaaattagaagtcaaaaagattttttaaaaatttacaggaaaaacactaagaaaaatcactgagactcctatcttatcattagatataaatggacatattgtttggtaaatgttattttctcaacaatgtatcaatcaaagctgtattaattgtattctacttatcttgtcaatttagttttttagcaattcaaattttcttatgcctacacatattaacagtacctaaatgaatacttaaaatgaacttgagaaatgagctttcaaataatgcatttctgtgattcaaaatgtttgtttgtgagcaaagcaactccaacttctactaaaaaataaattatttagttttgaagatctatatgaagagtggaaattagactaaatatcttactagagatcatgtattcatgttttgcggccccagtatccagcattgtagcttcgtaggagataaatatgaaccatgttttccgagagcacattatctttccatgaaagtgtagtaatatctacacttgaaactctatggaaacttgaaactctatgatagtttgaaactcactgctcacaggtacatacaactctgctttaaactaagttgcagtaacatagaaacccataggttttaacagtattgtttaatggagtttaccagctgagaacatactgttttttaaaaaaaaaataaaatacaaacttttttttctataaacgcaaaagtagcaattgaagggggagggagcgaaaattctgtcctatgttcagtgtctggaagcaaaacatatgctcaaatttttgttctttgcaaataacttgtggaagaaaaagaaagattgtgaaaataatgcagaatatcttacaaatgaagttattttcaaataagagacttaagaatataaaatgagactttcgtttcagtatctaatattactaagcaaagtgaaattgccataaagccacattctgtaactatagcaaccttgcaaggtaacacaaaagggctcatctttatgcaacagttttagaatatctatgatcctgaatgtgacagtatgtactatcttttttggtctgctgtgacatcctaatacatagatattatgaactatatccaatggttcattctttatcagtcaagaaagctatatcttagaaacatgtttaaaattaaaatgaaatacgtttaaatttaaaataaaacaggtttaaacagttaaacttgctaaccataaactaccaaaaaaaaaaacccacaagtgatatcactgttgctattttaaacataaataaaaatatcatacttatttgtatgtttatttccaactactattttatacctgaataagaaaatctcatcaaagtgctatgatatccccataatgacaacttccaaaatgaaattttcttggtctcaaagcacacaaaactctgacacaactgaatgaaaatgtaaaaatgaagttgtcccaggagatatgaagtcatacatatttactgaagccagcagagagcatcattaaaaattcccatggtagactcaatgtgaaagataatttattccacttaaatatgcctgatgatgatattagaaaataatctaaattaagaactcttggataagttgataggtgtctttttgctcagaatgtctaaatcgtaaatatttctataaacacacacacacacacacacacacacacacacgtctataccatttaatgtagtccaaagagatttgagttagaagtacattttagttaattgtctctcctcaaataactctctgtgggggagaataaaatacaaaataaaatatctaagggaattcaccccacagactaagtataaagaactctgtaatttggtttgaatgagcttttggttttttggtttaactaatacagagatttttatttgatcattgtatagactagtgaatccatttttgtgctcctttttaagtagtctactggggagtataacaaacatacactgatgacttaatgtgaaaccaaacacaaaggtgtttacccaaacacttttctaactggctagataacatgtactaaaaataaaggcccatagaaatgaggagaatgaaaggaaaagaggtggtagaaaaataaagatagaaatttacttaatatttttcaacatatattgtcaaatttttatctagattgttctttctggaatgcaataaaatgatggtttgaacaaagcagtggaaaaacacgtgatcccaattttggcttgtttgttttatataatattgtggtttctattcaaattaatatttctaattttaaaaaaggaaatttgcattaggacacacaaaattactatgcaaggaataaattagacaatctcataagatttgagatgtagaagattacaaacaaaaaataattataagcatgactttgaaggccaaagggaagttatttgctgcttacaaacaaattctattattaaagtctgtattctatcaatagtcatttgtgtgactgggtgggagtgtttgtgtgaaacagacaatatgtccatctgagaaacagtaagctgactgaacagtcatgagattatttgctcatatactgcctggcaaattttaactgtcctttaaggatacagtttttaattttgttctttttgtgtctaataatagctatattatactttggagagcccaaagtctagaatattcaaagaaataaattagggttattatctcaatcattaattcataaacgtgtttctcatataagcacatcactggccttattcttctttaagaaaaagaactagtcagttaaatttcaaataatttttagaatatattaaatttggatgagaactacaatagaaaataggggtatttaatgtatagttgttagtcttattcatcacttttaagaatatatttttcttgaaaaagcaataaaattatctcagaatgcaagttactagttttattttattcactttatgttttcagtatccaaaatggatttgaccaactacaattacgttagactgttctccatttctaaataaagttctgatgttgaaaaagaaaattttgcatctctcttctacttgatccattagaggagttcggtctacttttctttcttggattgccaaactctacataaaaactaagcagctaaatatttgcaaaaggaatatcagtttcagatacgtactaggctatttaatactgtttcattgagaaagctggccatatttgtaaacagttagaatagcaaagatcttcagaagtattttcctgctctaaaaagatgaaaaactcctggtacatttctcagagtgggaaagaagttggaaacgcaagaagctttgagaaaatggctccaatcattttaatggctcactaaagtctttagtgtttaacatctgtgagtttatctagtctttcgtttactcttttaatgtctatgagtcaaaatgatgaggctgaattgtgttaagtgatatcacatccttgagcttgccatttggaatacatttttcataatagctaataactatcatttatttaatttttctatcgtgtttcattcattaaattcatgttcatggtcagggaaaagatgaaacttagtcaccaatatgagggtgttcagcaacagattcaaggtgctctttagtaatcatgctttttactttaacctcaaattgttttactgaattccaaagttgttgacaccaagactcataccaaattgtaaaatagttatttttttatctttcctttctggaaaataaaacaataaggtaccttttaagtaaaaaaaaaaaaaaagtagaagaggctggataatgtataatcagtggtattttcatttacatggtctgttttctattggtcaccatttctacactgagaaacaatgatatctgtcttaatctttcaagatcagtacagtgtcacagctgactggaagaaatgacagacaattcttaaaaactgggagaatgaagtatagagcttcaagaaaaatgatatcaatactaaccccaaacattaaaacaacaaaccaaccaaaaacacaacgcaaaaacctttggaaattataaaagagaaagaagggattggtcaagatcaaacaattatacaaattggagggaaagaaagtccatgagatttaattggaggcaggtgaaattcagaatttcttccaactgatttcatgtttgcaagggtcttatgccacagccagtactaaagagaaagaacagctcagggctaaggtggaactgaaagcagtgaaagtaggagggaggaccataaaattagccaagtaacctggagagttaaaacagtctagagattttttcttccttctttcctttcttgctccctctgttatcttttcctccctctctctctcactctctgccttactgtcttcattcctctctgcagaaaatcatgaactgcaataactgtaatccaccattagcttcagaaaaaagtataatgttgcttgaattttatgccaaaatatgttttgacaatgataatttctaattgccctgacaatgtattctcaataatcatacaaaatcagaacaataatgcaggtactcaatttgaattctgtggcttaactcttgtttgattttcatatgataattagcacaaatcattacctacattctatctctgattaagaaatggcttcctttaacctgatggatttgataactacctgttcaaagattttgctttcctctttattattttcttatgattgtcacagcatgaaaaatatccttgttgtttggaaatatcagattataatatgtttaattggtattctactttacagatcaaactatcatagcctaaaaagtaaaatctaaccttaacacagacagcatattttcatcatgtttaatcacaacttgatcatttctcagtctttcagcaaaaaagattcggttttgaaacatggagattggcaaagaattttagctttgtaaactatgagtcttcttaactgctcttcatgtatttaaaatcccaccaatacttgaaattggcttatatcaaatgtgccctctttctttctgactttccatcagacgggaagtgttctctgagctcttcaaaatactttgctcctgagttatttgtgtactcttgcatattaatatgttgagttgcttaaagatagtaaccatgttttggtttctttgatgtctcccactctacttgtcaatgatttgtacacagagcaaatgctcaataaacactccgtaagttcatgcaagtaaaagtaatttgtttcccatctaaacaaaggaaaaaccatgtctgatggcagctttctttccgattctatctgtttaacctcaaattcaaaataagaagaggttgtggtataacgtgtacattattttcagaaaaaacatatttttacattcaaatataacttgtaattaagtccaaggttatttatgtagtagagctaaaatccttcttattggtaatagcttttcatttaaatatagaataagactttggttacatgattaatttatgttggaatatcacacttttagtaaactttagaaaatgtaaatactaataaaatgttataaaacaaattttataaagcattcataaacataactgcatacaatatataaccacttttattaaaatatagcatttagactatcataccaggttattccttctaaaacatttaagtatttcctttcagttacttttcagtaactaataaaaatgcttatttttcctaaacatatctttaaaataaatctaatttatcagtatttaaaatatttttaataatgctgcatgttaataacttcctactttctatgtgctcattctgtaacatgagcttcaggttttcctttaatatagaggcttagttttaactcaaacacacaaatatgcactgggcagagttctcaacttgtataatgcttctttgtatttaatatcatgcatcacctacttccaaaattccttttgctatctgttatgtttagcaaaacaaatgtgtcatccagcagtgtcattaattagaattccttgtaaaaggtggtgaagtgagtgaaactctaaccttaaaatatattttggatcactctgcttcacaaaacttagagaagacattaacactgccctttaaaaatcaaccactcagtaaatgtaccatatacattttatctatatcacataatgaaagagtaaaacataattaaaagactgaaactgacttattttatttaatggaggacatttaaggagtgaaaatttatttcaaagttttacttagattttttttaatgtgaatcgttagttttgtcagaccataattgtccttagctactctttaatggtatttaacactcacccatatttcaaagttcagatcaaatatatctgatatttgtcagactacgttaagtatgaatgtgattattgcaggagaactttttattcttcttaaaatagtatcttcagggaaaattttatttccatttatattgaacaattaaaacaaaaaacatgaacagaaacctacactgaaaaattcatttaattatcaccttaccagctcataattacttcattctgaactgagataacgactgtagtgaaacaactgtatttgttttattgtattatgcacaaaacacaaacttctaatgattaggtttattttcagtaatatcattattcttaaattttacttcaacgtaaagaataaaataagtagatatttaatgccttaaccaaataatgcaaaacttaacatattttaatccctatttagtgaaaacaaagcacatgtttatacatggtcaatattttactacttaggggcttagatttttacttctggccaaaggatactccacagcctcctcgaagtcaaaatttcagccaggcaaacagtctgtcagtaactattgattgtttagagaaaatactagtgatttattgaaagatctatgcttctgtctttcaatagtaaatgaagaagtaggccaagtgaaccatgatatgatgacatggagaaaagaatatctccaaaattgctgctgcagatgcagaagaaatagaaaagtggcaagttgaaatcaatactcattttagacttagtgatggaatgcttcatagttaccagactgaccataaagcacaggactccaggtcagctgcaaaggccataaccttctttcctttttcactttatagtagacataaatggaattgttctgtttatacttaaatatacacgagtattttattatacaatctgatataagaccatgtgaaagtctcattgaccttgctgaggattatgctgtttgaaagattctcaactgctcaagaggtagacttctataaaaattaatcattacttgaaaaatgactgattaaaacagattactgctttaataaaatcacatgccaaggctagagaaacatcctttcttgttaacatatcttgatatacaaagtatactaccagaaaaaacttacttttcctcagatgatgatacagtttctcttggaatgggaatgtaccataagcctggatcagggtaaactcttgtttttatacagacacaattatatttttgaaacatgagtagcgggcaaagacttctcaacatattcacttgtttcttcattcatcacccatccattcattaattcactgaattgatattttctgagtgcctactacatatgccatgcactgttgtaggttctgggggtacagccacatagaaaacagacaaaaatccctgtacttaaggtatccaatattatcaggatacacaaacttacagctgtataatatattgccacatatgaacaactattattttagggaaagaaaggaaagaggatagttctgaagcctttatttcagatcagatggagacagacttctttgagaaggtgacatttgaacagggattacaataaagcagggaaacttgtattgccaatacctgagggaagaatatgcaggaaaaaacaataggtgaaaatgtcctgacagagaacatggcatttattaagtctgcttcattaaatgaagttttgagaatggaaataaaatactgagaataattgtagatggaagttgtgatgcttcctttatcaaacagttattactcagctattgggaattgagagatcaatatctcctaaggctgggttatgattaggttctttatattatgtagcacaattcattaagccctcccagtataatatgtttttccattcaaaaaataatatacactggtgtagtatttaattggtcatcttacagaggcagtaatactcagacttagagaaagagccaccaaatagtctgaaattcacatacagctctagcttgatagttgcaattgtccaatcctttgaaactaccttgacatggaattcttaaaccattgataaaaacctgcaaacatttaaagttctattgagtctgagataccttggccaataatataaacattctttactttaaacatacatggcatattgtgtacatacatatatttattcataacatatgtatgtaaacacatattatatattggagcagccattaacatgtgccagttgccatatgtcactcaatgtttatttcaacaacttactgttcatctttaaggagtgcagttaattgacaactcccaacaaataatacttgcaagatctgctgaggccatgctctctgggtttgcccctagccaatgactaaccatggcgtggtcaagggagggcaggaagattgggacctggccattttcacccaaacaagaactcctctgatgggcagtcttcactccagagctttccagagaggtggctgagagcctatcagatctgtactgtggcttgaggcctgtcacccctttctatctggattctttcctcttttatcactcataattgctacctcccaacaactttttgtaccctaagtgcatctgagcatttgtcccctggagcacccagctgtcacatgtgtttatagatgtacatgcaaatatctattattttagggtaggtaatacattattaaaactcttttcacttacttatagtatatgactaatgccacaaaaggacagacaattattttgtagttaaatatatcctacttaaatgttaaagggggctttcatataatgaaacatttgacatttgtgaataatttttaatgagaacgtcaatatataaggcagcctcaataaagcattttcctgtagggtttaatataggatttggtttggttgtcatatctaaattgtttattaaaggaccaaaagattcttcttagaagctattctgatatttgagatgtccccatgtcatataactcaagtgtcggtgcaggacaaatctttactatgtgatatttatttttattgaatccagaagttctctgattatgcagggatgtattataattatagtaatgtacagtcagcatatacattcacaattataatgtgatttttgataaacaaaagtattttcgtttattagtaagactttctatttctggtactatagttatccttcaggattttttcaacaatttattaaaaacttgactcattgttcaatttccacctatgagtgagaatatgcggtgtttggttttttgttcttgtgatagtttactgagaatgatgatttccaatttcatccatgtccctacaaaggacatgaactcaacatttttcatggctgcatagtattccatggtgtatatgtgccacattttcttaatccagtctatcactgttggacatttgggttggttccaagtctttgctattgtgaataatgccacacaggaaggggaacatcacactctggggactgttgtgggttggggggagggggaagggatagcattgggagatatacctaatgctagatgacgagttagtgggtgcagcgcaccagcatggcacatgtatacatatgtaactaacctgcacattgtgcacatgtaccctaaaacttaaagtataataataataaataaataaataaataaataaataaataaaataacaggaaaagcaaaataaatgtgacatgtctaaaacagtaaaataaaaccaaaaaaaaaaacctgactcattctcagaataaaattaatacaactgaggaaactgtcaattaattgttcttcactttcagcaaaaatgattaaagtcaactgcacgaacaattcaagatttgtcctgattattcatttgaaacttcctattttccccatgtttttccataaacgcagaacacttaattaatatattctatacacaaagaaatagttgaaattatatgggcagcactttattgtataaattttctttatagtgtctaagatctactgaacatgaaaaacatttaacacctcagtccatgagattaacataaaaattagtgctaatataatggtgagccatgtggttatataatttatatgtaaattatctcaaactaaaaaataaaatcaacaaaaagtatatgttatattactgaatccagtggcagaggatatcatttgaggaatgctgtttctacatttttaaattaattagaagaaaatttagcaatgggagttttgtttaaaaatataaattataccacgatgtaatctaacatttgtttgactaggcaacaaaaatttcctggccttctcccaagattatgttattcctagaaatataaaataatattactccttcatgttattccatatctcatgcttacatcaaatgcaattactactgcttttcaagaaacaaccatgacaagccaataaataaagtattttgactttgagttgggttcccactacaaatgaattgccacaagaataaatgacaaattattcatttgctattccctcccccaagtttaacagaagccttagaaccttcagtacatctcaaacgctgtaagagtaatttatgatcctgaaagagaacataccctattggggcctaaatgaccacaaacaatgagccattttatgagtgttaagtaaggaatccaataaaaaggtgatttaaaaagcagacatgacatctttgaattaatctttgctctaactgacaagtaaatgcctctacatattggatatttttccccttacagcaaaaaaggcagtaactagtcatttcattatagataagttgctttaccacttgagcctgttttctcttccgtaacataaagaggctgtatcagaggtggtctagttaactatattcaggggtcaggcactgaaatgagtgggtcactataaattaagacaaaatactgctttgagctattttgttttttttggttgttttttttgtttgtttgtcttttttttttgagatggaactttgcttttgttgtccaggctggagtgaaatggcacaatcttggctgactgcaacctttgcctcccaggtccaagtaatggtcctgcctcagcctcccaagtagctgggattacaggagtgcgccaccacgcctggctaattttgtatttttagtaaagatggggtttcaccatgtcagccaggcttgtcccaaactcctgatctcaagtaatccaccctcatcagcctcccaaagtgctgggattacaggcatgagacaccgtgcctggcctatgcaagaaattttatgtaagggcattgacattccaaacgattattaaaacccatgtgaaatatattcgctccacaaccctccaaagctcccaaatttcaaattttggaccaaattatctcgaaattctctcaagcctcttcaatctctaagaagcaatctaaaaaagccctgataatgtgaaccattaaaatcaatataacacaggcacaagatagtagaggggattaatgcagaaaattatttcttactatttactgagtcctgttagagaattgcatatcaatgtttctattctttcatctggtctctaaatcacccaagtatcactcaacgctacatcttccaagaaaaaaaaataactcagatattatgggaagagagccaaaaacatcccagctcatagcctaatacacacatttattgggaacctactatgtgtaagatactgtcccaggcatttgggataaatcagataacagcactgacaaagattcctgcccttgtggggcttatactctgcagagacaaacaaggaaacaatcattaaactttaagtaattcgtgtatatattagaaaatggtgtgtgctatggttttctaaaaaataaacaagtaaaagggattgggagggtgggagacaagtggcagaaggttgaagtatctaatagaaaggttcagaattggccaggcgcagtggctcacacctgtaatcccagcactttgggaggctgaggcaggtggatcacttaaaatcaggagttcaagatcagactggccaacatggcgaaacgctgtctctactaaaaatacaaaattagctgggtgtggtggggcatgcccatagtcccagctactcaggaggctgggggcaggagaatcgcttgagcccgggaggtggaggttgcagtgagccaggattgtgccactgcaccccagcctgggcgacagagcaagattctgtctcaaaaaaaaaaaaaaattcagaatagactcagtgaggtccaatttgagcaatgatttgaaagatgtaagggatttaagcatctgaaagaggcactacagccagcgccctgagatggcaggaagtgtcctgagcaaaactgcaagaggtcagtgtgagagaaggagacaataaaaggtctgaaaattctcctagaaaccattaacactgtgcattttagctactatatggattttcattctaagtaactgttgaaatgaggtatcatggctaacagcaactgctttggtgttaagcagctctactgtttatcagcttcagtgtcaagttgcttaatctctgtgcttcacctaacaaataagtataattgcagtataagtaccacgtaggactggttatgaggataaatgagattaatgccaaacgtcgtactgtgactggcatagagaaaccgctcaataaattgttttctctgaacttgctactttcaacacaaaatttttctcaaacaatgagtatcagtgataccaggaccattctaaaacttatctccaacatctatgctcagaatgatgaatcaattaaccaacaaacctctactatgtgcaagggattattttaggtgctgaagggatacaaagaatttaaaatgcattccttgatattaataagaacatgatttaagtgaagaaataaaacatacacataaaaacataatttaatattcctatcaataaaaaggaataaagtactgcatctgcacaaacacatttggatgactcttaaactcactgtgcagaaatgaagaagccacacacaagagcacatacttggtgattccaattaaacaaaatgaagactattctatggtgacaaaaggaagatcagtggttgcccagatccaagggaaggtgtgagaatggtttataaaggagtataaagaatcttcacaatctttggaaatgttctgtatcttggttgcagcattgtttcacaagtgtaaacaattgtcaaaattcatcaaagtgtgcactttaaatgggttctatttactgtattcctccataaaattgatgatagcaaaaacaaaacataatagtcataattgatcagaatggattgaataatcactacagtatatcttccactatagtttgaactagaaaattacaggacaagtttagtttagatatgccaggtcacacaataatttccagatatttcttgaattgcattaggtctagaaattttgttaagcttgaagataaagttctcctattaagttgtcattagttgtggctctattcagtcaatgtctgaataactttatgtcactgtttctttgtttctatatgaagaatcctttcatcttcaaactttttcctcaaaaattttctttttttatacagttcattccctcttaggactgtcccttgcagagatttccaacactttcttactgctttcaatgtaactatcaaagattttaactgcagttttattttttaaatatgggccattctggcttctatctgtagcccttttccaaagatgtataagagaggaagtggcatgtctaacatgtctaatcttaaaaaggacacacttttcaaagagttttattttcaaagttatcctactattggttaccaataattataacacatttttatgaaatgtcaaataaaagacatgcatatatccgtagggaggtagaaaatgaaacgggatattgtgctcttcctaggattcaactttgctgtaatattctatgaggttatcattcaattgttctacaatctaaattcccacatttcaaaaatttaattttcctatgaaattaattgcttaatataaaaagcacatttataatttattcttcagaaatgaatgctttgaaaatacatttaaataagtgttgatggacatcattaacagtgaaatataattaaaagagtaaattatttagttgggtttttttaaccagaataaaagatttctatggaagctttctgttcagaatattaaatgcctaagaagtcatactagattttgaatgtagtacctattctggaaagcaaattcaggattcttgccgacagattaaaaattatttcctaatatagatgactcaaagaaatacctgtcaaacagagagttaagacttctgaatgcagacacagcttgaaaaagaagatgatgtattttccatggagcatttgccgaagaactattcagcagagacataaataattaaaattaaactacagtcgctaaaataaatgaacgatattctgaagcaataggttgacttttaatcctgattttcacttacttccaagctcacaaaatttaaccatctgcagcaaatcgccacatcaataatttgaattagccggattccaccgtaatttctgaagtgcacctcactccaatttccaatgcagtacaattgaaaacgttatcagataaaactggttgcagaaggcttggaacattaaatgctttgacaatgacaaatagaataaggtgagatgtgtcttaaaaggagggtcttcccactacactgtgtttattcaattttagggacaccctctgccacattagaggccttttcattttcttctctccagacaaggattagtagatgtgggccctgcttcccccaggtttatattactgtataagggtaaccctgtgaagtaacaagattaccagagagaaaattttttaaaaaatttaaaaaagggggtagattatgtcaaagccttccttgaagagagagttaatttgtttttttctaatattttgcaggatgtattaaagaaagtctgtagaaagacaagcagggaaatgtgacaacagactatacaaagaatttataggttcttatgacattatttttctttgatgtaaccccatgttggtgatgttatagaacttttgatatctggcagaattatgtcaaatacatgaactgcagtttaagaagcataaacgtcaggttgttgaaatcttccacatcaaactaattagaaagaatttttgaatgtgaattacagcagtttattagacgtcatgggagatacagaagatgtactgatattaggcacacagaggtattttaaaatatgtaataactgaagagacaagacatgaaatataccaaaagggatttttttgtgtgtaaattaagcatctaaccataaaataatcagagaattaatcaatctagagtaacatgaatattatcaagagaaggctgagcaatacaaataaaagaaataatatctccccatggctactcacaagaaattaaaccttgctgaatgtcagtttcccctttgtgacagggatcagcctaaaggcctagtgtccacaacatgttggacaatgtgggatttttaagtgcataatagatcccaatcctttaaatctccaaacctcaccatatcctatatcacattacacttcaactctccagtggaagggtaagtatctgggagttcaccctttaaggacagtagttctagaacccgtagtatgtacttgggatcagcctctagttgaggttattaggtctaagtcagttttactttctattataagcatatttgtcagtatcaattaaacaaaccctctcacttgggtaaaatatttagaaaacggaaggcatttcaggtgggaaggcgggtacaagtaagaaaatagaattggaaacaagtatggcttactcaagatagcatgaacagacctacttgtcagagtgaggattaaaagtaaaattattaaataaatagggctcttcaatagtaggaaaataatgtggaggagcctgtaattgatatgacaggtaataagggaacatttgcacatttctgagcaacggcattccgtgatgttgtacaagccagagagagtgaaacctaactaagagaaaccagctaaagcagctggcaggaatgatgtaatgcaagaacgaggtgatgagcgctacctggattagactgagctcactggaggtagaaaggaagagatggttctcctaagaatcaagaaaactgaactcatattgaattacctcttcaattctctcaaatgtcatgctgccagtgaaggccttacctgacaacctcatgtaaaaattaaacctccttttctcatcggtacactcctgtgtcccattcactgatttttttctctatagaaggtatcactatctgacacactatttatctggcttttgttgtttttgttaatgcttgtttcataccattaaaatgtgagtaccatgatccatgattttcatctgttcatttccctgttcccctgagcccacaagaggggattcaataaatttgaactgagtgaacagaatgaattaatatccaataaagaaaacaaagatgaggctgggcacggtggctcacacctgtaatcccagcactttgggaggctgaggcgggcggatcacaaggtcaggagatcgagaccatcctggctaacatggtgaaaaccagtctctactaaaaatacaaaaaaaattagccaggcatggtgggaggcacctgtagtcccagctactcaggaggctgaggcaggagaatgacgtcaacctaggaggtagaacttgcagtgagccgagattgcgccactgcactccagcctgggtgacagagcgagactccgtccccgcaaaaaaagaaagaaaataaagatgagaaaacattaattatgctttcaaagttccccacctggcgttctggtacaaagttatatacaagcaagaacttcattaaaggatctcaaataaatcttacaatcttaaaaggaaagttcaacaatagttcgatatcacgtgacactaagaaaaaaatgtgatttgaccagtaggtaatcaaaaacagactaaacaacaatccaaagaaactgccaatagtccacaagttcttcagtaaatgtgaattatagcaataatgtgctaatttgtattcactaaataggttttcaagctttcaaaatgtttaaaaatgttttcatttatcattgcaacacgcatggcgaatggaagatggagacactaaggagttaaataacctcccatatgctgtccttccatattaatgaatagaacattacttgcttctataccaaactagaatttggtgggaaagtcatgaagttctccaaagcaaagttagagccattagattaagaaagtgagtgtaataatgtactatttttttcctttagaaaagcgtaacctcaattggccattgagaaggatggctttattagatgatgaggagtctgaaatatcattaattcactcatcagcatctagaaatattctttaaccagggcaagacaaagaaaatgcatttattctcagcaatattcattataccaaaacatttattcattttgcttagaatcactgaagtaaaaacagacacaaattagaaaaaaaataaagcaaatgttgaatcacattctgagtttagaatagaagaagaacaaaaacaagttttctcgggaactgaaaaaaaaaagaggtcataaatattaatgtactagatctacataaaaaaattctaaatgcaggattttcataactctaaaccagaaatcattttagcttatcttggaaaacactaccagtgaaacaacttaatatcagttaattttgttttctaattcaatttgtgagacagcactggatgtattgagaaacagtacatctcctgatcttctaagataccatgtaacttgggagtgctgagaatatattacagcaccctggtaaaaacccatgcatggtgtagtttgaccttagtggggagctttagctttcaccatcaggttctgacttgctatttccttactgtgtaatgtgaaaaagtttttatcttggttattttttcttatctgaaaaaaggaagtcaaatgtcattgtccctttatctcagatagttattataacagataagaaaatgctttttacaagtcaaaaatgaattaatagattaatttaatgtattattctataagtttacctaaatcagaactactactactgttacaattagaaaatgataaggaagggaagaggaagtacatttagaaaactgcttttacaaaccaaaaacaagtatttatgaataaaagatgaagctgctgagaaaagtagaaaattacaataatatcactttattcaagaagatattgggcatgtattcccaaccagcaccaatatattatttttcagagataatgttaccaggaagaataaagctatgtttatttagacagggccagaactttttttaaaagataaactaaaataagtaagatactggaattgatttgaggaccctttgcaatctctttatgttctctgctttctaggtattcactaccagacctcgccaacctaaattttaactctctctttagtcttgttgaccaaaatgacttttcttcaatctaaaccatactgaagctgaattcaatctaactataggaagacattaacatggttcaaataaagctttgcataataactgtttctattatgttgatggtcttggaggtaactaactgttaattcatctttaactgaagaattattatagaagtattctgggggaggtgtttttttgttttggtttttgttttttgtagtgacatgtgctctcagtgtaccacaatatcatagccccacccccacaacataccttatgggccttgtgcataagcattctgtaaattataacacaggataaaatggggcttacttgtatcttctcctaatggaaagcctctcctttagttgtgaaaacttgaaattatttcctctcaatacgtccttaggcaaagggagctgtgttggcaaaagccagagagagatgatgcttggctcagagctgaatggctcaaaggtactttcaggataaaattgaacttctgtgatttactcatttgaaataatgagatttggagtgttctaatataatccacaaatacaagacagtaagatctgaaacgccggctgtagccctgagattaataacctctagcagtagttatcaaatattttaaaataagagacccttcctttatagacaatcatgggagaaagcccaatgttaaaacagagaaaagactatgtctctgctggaatcagggcaagggctccaagtcctgctctttccgcactcttaagccccagcagtggtcctcaggtccctccccagaacccttaggctcagtaaggcatgacctgaaatccattagccttacataattctgtgaaatttagaactgaagaatccagtttgttccataacagcaatttgactgaaatacatgagacaagttagagtggccaggccagaatactagaaattaaagtataataataattttaaaaaatgacataaaataaagctggtagctttcaccctaggcttccttgcagccccactctctttctactaggtcttgaaatttagaaaaggtatcttgaaatccctaagtattaaatagtccatacgtgaattttacaaatgtatccaagttcatatttgggaacataaacgatggtaaaatggttctcttctaagtagggaatgggaccgtgtggaaacttgtgaggggatgtcagaggtagtgcagtaaactgctgatgcaatacaaggaatgtccttttctgtgctagagctaactctcccatttaccagttgattaactttacgcaaaacacttgttattcagtttctccatccatgaaacaacctgtctgcattaaatgatcagacctttctttttaaaaagattactaatctgtattttatctagatacataatatttttgctgagttgaaataaactttcttaattttcatattcccttttcattataatctctatcctgagaaccatattcatattttcatcactgctgaatgttgtctccctggatgtcttcttagaacttgatctaagatgaatgttattctcccacaggcactttcagaagcataatccttctgggtacttatatccaggctcttcaagtcgccttcagttctttcctttcacttctcacatccaattcaactactccaatgtcttcattcattcattttttttattatctactttgtgatttgtcccactgaaagaacaagacccaggccatgtcctaatgaaattgtaaatctagtttctcatgtttggtcctttccttcttttcctcatattatcatcacagttcagcccacttttatcttaacgttttaaacaacctcttagcttattcaccttcctctaatgatcccacctttcctcagcactgtaatttggaattcactctgccattaagatgtctttttaaagtgggactctgataatggcagcatccatccccaaccctctgacacacactgtgtgttgactgcaaaataagtttataaatccagggttataaatgcagctatttaaggaacctggtaagacacataaatgtgtgagtctggttagggcacacagtagggagtaagagagcctagggaaaatttggagaggctatgtgctgcccagtgactttcaaattcaattaaaaataactacatctatgaaccagaaagctaccaattctttcattccaaacctcccttgcagccacatttgtgttgcagccacacaacatccctcactataatcatgctttgcttgaagctgttccaatatttctaatgacactgttctttctttcaggtgtcctctttcccagtgaatctatcctcatttctcatctcttccctgtcagctaccacttatccaagcactttttttccagtaagaattcatctcttgctctcctatatggtcattatattttatattttacatatttataaacatgacatatgtatttatgttccacaaagggctttgaatagaatttacacatagagttccctgggttgatgtgtttatcaaaatggaagataaagtgaattaattacttaaatatttaacactattgaatagaaataacttccccaatattgcttcatgatttagacagtctattaaatgtttaagcaaggcactagactaagtttattaagacaaattttggaatatgtgcagaaatatgacctggctaatagtacagagtcaaagctggttgaatggtgttatatagtggattcagattgatgtggcagtggtggttacactaggggcactaaggttatccctactggcactctgaggactctattctctaccacacttttttccattaaaaataccaagtagattaatatcatatttgtagataacacagggatagaattacatacgaggagaaaatatagcttacttatatccatgtactaaaatggaaatcagaagcatttctcttcctttgactcctcatctctactttctcttcagtaatccatactataaatgacatcaccattcacctagagtcttctcatgaaaatctgggaagcagtcttgactccagtcgtgcccacatctttgtaactaatcaaccaacaaacccatagaccctaactccttagcacatatcaaatctattacttatttttcacctctgatgttaggaaaatagtgtaagcttctggtatctttcttgactaaataattgttgctatgctgttttcttatctttggttctgcattttttaaatctgttctcttgccagaataatcttttgaaacaaccaatctgatcctgttccttaagtctttccatcatcttgacctttatctgtttctccagtttcatcctttaggttcccttgttgcattaatactcaattgcttgcaacctgcatttctcttacatacttacattatgcttctgcctgaaatgtgtctacctatgctagacaaatataatggcaccacaatgatgtataaatcttaatctccagaacctgtgaataggttggattacatgtggattacatgtgttgcggctcagaacataccccaaagtatggcaccctggcatgctgagtacttggaactgaaggaaattggaaaagcctcagaaacaaggtctctgaccttttcctgccctcctctctcacacccctctttctccccagaagcaagtcatagcaaccagaattgcatttctccaaggtctgtctagaaactaaaagtcttctcccctaaagtaagccataaaatgtagaaaggtcactctctcccttttcccttgaagactctcattgccctatactctggagggaaaaatgctacaaagagaagaatctgaaaaaaaccaaaaaaccaaaaaaaaaaacaaaaaaataaaccaacctttctggatttcccccctcagtctattaccattagattatactcttttgtccaatcacatttctacatggcggttcattcttcactgaaactcagtataaaaagtacacagttttccctgggtatttgggtcttcaactctgaaagtgcctgtgttacatgaaactttgattaactaagtttgttatacttttctcttgttaatctgtccttcattacagcagtgttggctgtgacctttacgaagggtgagaaaaagatgcccttattctttttgcccttaaagatagcaaaggcaattaaggttgaagatgttaattacgtttgctaatcagctgacctaactatagggtaagaaccctggacccaatgttgtcacaagctccttacaagtggaagaaaacagcagaagaggagtcagaggaaaatgtgactacagaagaatggtctgagagatgcaaggttactggctttgaagatgaaagaaaggagtcaccagccaaggaatataggcagcctcaaaaaagatagaaaaggaagaaagcagattctttgcaagtgcttctaacagaaatgcaccattgatgacaaatcaaatttaccccagtgggatccatgccagacttctgacctacagaagagtgagataatacattcacgttgtttaagctattacatttgtagtaatttgttatggcatcaatagaaaactaatacactacaatgtcactctagccaacactcatcactcaacaagactcagctaatgaagaatgttggtttctgtaaataacttatattacagggcttttaactattgatgagacttccatgtaaaaatgtattcacctactgagctataaatccctctagaacaaataccaagccttatttatgtttgtattcacagcatcttgcataggacccttagtagataatttactacttttaatgattgaaggtagaattgaatagtaatgtttcatgttttaaagtgggctgacaacatcaactcttgagtagagtacagaaaggctgacttatgagcagttcatgtggaaaaacttagagatttcaactgactaaaagttcagtatgaattgataaaacagtaacactgacaaaaatacatacacacattcacacatacacacacacacacacacacacaaccacacccctacctttgattttagatggcattaacagaagtattatttccaaaaccacagaatgcttccattttactatgccttgctcagatacccagggatagtataattaattttagacttggctttaagaggtatcctgacaattagagcatgccaagattaggagaaggagacaaccagcaaagagatggtaaggtcttcagcactgtgaaggatggtttgaaagaaccaaaaaataaaatatggaagagaaaaaatctgaatttgggtataggagttgctatggtttgaatgtgttccccaaattttgtgtgttgaaaacttaatcctcaaattaatacgctgactggaagtgggtcctttaggaggtaattaggattagataaggtcatcagtatggagcccccttcatgggacaggtggctttaagaagaggaagagagacctgagctggcagggactctcttaccctctcaccatgtgatgccctccacatgttatgatgcagcaagaaggccctcactggttgctagtgccatgctcttcgacttcccagcctgcagaactataagaaataaacttattttctttataacttacacatttatggtattttcttatagcaacaaaaaataaagatggggtggagaaatatatttatagaaagtatttttttaagtaaatgagaaattagacataatgtttttaactctagagaaattgaaaacagagcacagcacatcggataaattcaataactatcttaagaatcagcaaaacaacatgcagatggctgattggcaatagtttcagtaggcagattttgattaaaataaagaaaaactttttaataattaaacctctccttaaaacattatgactttatgaggtaacaaggtaacaagtacagccttctgaaagcataaacagcgtttacatcatcacccattacttaactagcagaggagtttgtttgaataggcatttggactaggagacttctaaagattttgtcaaatttgtgacttcattatttgttaattaagtccctctccattctaaagcaatttctgtgatttttctgattgtggtagacttcacaattatactgatttaaaacacattaccatgtactttctggctcctagtaaattgctattcacttaagtgttatctctgagtcctaaagtgttaacagacctaccaaattatgtgaggaatctcgccttcccccacaccccaacaagcttaattttctcttgaatatttatctcactctctcataactttcatataatttcaaactctccaaaacacacccaaaaagggagctgaaggacaggaagggattatatattttttccatggtatattctcttctaatgcagaaaggcaattaggcaaaacaagttaaaagcaagctaagctttttcttcttgagcagtgtagaacaaaaggctttatctgatttatgctaaaactagttcattgcaagcaggatcttaataccctaatcaaagaaatttaaaaataaattaaagaaaacatctcacctttgttacttagaggcaaaaattacgacaaaattatttcctggtcagcattcttagactagcctcagctattttttttttcttgaattaagaataatgaaaatcaccataaaatgaaacaaaaaaaatgtatcacaaaaatattttgcaattctctttctgcccccttccattttacttcctttctcaacatttgggatttaatgagctttaaaaatatgtatacaaaggataactgtctttgacttttttgatctttcctccatgtagtttgtgatttaaaaagttagttgtttcctttgaaaattaattttatttgactcatcattagacacccaatactctgccacatgttccactattgtgcattcactattcactagaaatacattacacactttaccgatattcatatacttcatccccatagctaaaagagatttttagattttactatctgtgctttacaaatgagacaaatgagtttcaaagaggccagataactttcccaaagccacacagcagatacatcatgaatctagggtctaaatgtgggtctacttaactccagtctccatgatccttggctatgcttgtgcaacaagatttcctcagcatctttcatgtaccaagctctacccttaattcaaaactgaaaatatcaaagcccctgccttcaggggtatcacattctaacaacagtgactgaccaataataaatgcaatccagctaaagaactttataatagaggtaaatattaggtataatggtgttcctaaaaaaagaataatccacctttcctagtttggggtaggagtgccagtgtgcgcaatgactgaatatatactgctaacagctaatctttgaccaaaaaagtaagattcagtctatcattggattctgcttcctctataactccaggaatcagccatgccaaatgtgctaagggcttccaactctgcacagatctcactggggctaactcaagggctggacaatgccatctgacaagttccactgacattaaaaaatacttgtctggtgtcccctatcatcaaatccctccttaagaacagatacatcagttaaaattatgtggcactttcaaatactatcatcatgatttattgcaacagatgggaccactgagagatttatctttggcaaggggataatttttggatccccctcaaatcacatgcaatatgtaaccatctatgaatagagcttccctagaccctaaagttgccctctcaggctgctgtcattactctttcacatctatttctacttggagaaatgagtaacaccttgctcttgcagtgacaacattacaatctcgtgttcttgtccccataggagcttgaccttatcaccctcatcactctctccctgctttttcttgtattcacactaatctttcaaccacttcctttatagttttttttttaaatcttaccatacatttccatataatttctatacctgagtctgtcatttctgaatgtctaataagaatactgtctattatttttcagtagaatccatggaccaaatttctaccccaataaagcctgaattttgtacatacaacatattcttgttttatttaatggttctttctccacaatttccagaaaaaagggtcattatcatcatccttttccattgcatcaagatatatttgtgccagattttaaacgtgagctcagtatttgctgtttagcttttccttgtctggatcctttttccattgtacattattgagaatgatcctaaaacatattacaaagtgtccataggtgggcattacatacaaagtttaaaagttgccacatattcaatttgatttttgttttgtctttttgtaaagcacatggtctgaactctacacaatgaaaattttaatgacctttacaacaagatttgaaagagctcagtgacatctttactaatgtgaaaactgacaatttagtttcagggatgaagggtagatctaatagaataactacattttttttcagtcctttcataatggagcaacttcttttaaagcaagttaataattattctttttattatcaaaaaaagtctttcaatgcagaagcattatgaggtgagttatcaagttgtacatgtcactgcaaggaaaaaacaaaaatcctcaccatgaagattaagtcctcagcttttggaggtcaaaggtcaaatcaatgagttgatagcactagtcacaaagtgactgggcattagatcttctgggggaaggagtgatctcttttaaagtacaggatgccaatctgccataacctagtgaataaaatcctctgttaagttccttgaaaaatctctattttagaaaatgcatcccaggtgattgtgggagttcctcaacttcagaatttagggaagctctatacatagagggttacatattgcatgtgatttaagatggtaccaaaaattatccccttgccaaagataaatctctcagtggtcctgtcctgttgcaataaatcaagatgatagtatttgaaagtgccacatatttttaactgatttatctgttcttacacagggaattgatgacatgggacactagacaagtatgttttaatgtgagtgaaacatgtgagtaactgctctgggctgtccctctgagaactactaggtagaacaatagtaatgatctcaaggtttgcactgatgtttgagcaactgttcagatgttctgacagggaagtgagctacttgaacatgtttgattaaagaatggttctcctatgggctttctctctattcagggaataacatgcttaaagtagttaaacaaaaaaaaaaaagaaaaaaaaaagaaataaactggaacctagcctaataactggcattcgttctataaataatgaggacaaatgccaaaccaaagagtcctcacattcatcagtctaggtgttggctttctttgggatcaatcagcttctctcttcttccacctcattggtcagtgcaaatccaactgctctttaagactcttaacttcagccagtcctctggaaaagaatgccactggtcactgaaagtaccgatgggtcagtgtaaatccaaccacactgctgagaaaacaattcaaaacgcatttctgctgactgccagacaaggtattgttttatttaaacaataaacacctgaaagacagctgttaaaagccatcacatcattcttttaggtcagtatagcatcaaacattatctgttcactgagtttagaggaagatttctggcagattttgctactagcaatctatgaaatcctatggctaacttgtgaactagggtttccctgtgaaatggaatcacaattggacaatttagggatttccatccctctagcagcagtttagcccaatctaaatttgattgtttccttaaatggagtaatttaattttctccaaatgtctacagactttataatgccaagtccagaaaatgaaagggaaaactgggtcagtttcccaggtaactcaagccaaagaataaaatattgctttgaaattccttataaagcataagttgttttaattttctgaattatcttattcattgtctcagtagtgtaattgtatagtctatacctgggttatgcaataaaatagtattttaaacatgaaagaaaatattagtctcagttcatagttctttgaatatccctgcattttacctgtttgaaagttaacacgaataattaatagagagtacttcagctgctcctattgtgaatggactatcatggggtcgtaggtacatggcaaacaagccaaacagaaagggagaactgcagttttgtgcaataggcatttatataagtaggtataatatgaatgcaaaagaatacatcccgaaaatggtagctattattatacatgtggctacatttcttaatataaaccgtgaaaacaaccattctgaaaagctgtgcctttacaccacatgtaacagtcccacataaagcagaatctccttggtgattacagtaataatgactacgattgaatgaaaccctttagctctcactctcttttcgaaaggacaagtaataggacatacattttaagcaaaatatggcctcaggcactgtagtactgttgatgctttttaattcgaagatttcctaccattgtagttcttcagcacaggttctatggcttaggacagccggctgtggacctggacgcactgataagtcatctacttggacatacaataatgtatctgtgtgctgagaaagaaaaatcaaaggcttttgggtgtttatgcctacttgatgatctcggaagaatgaatcaatttatatttattttagtgaaagataagctacatgaccataaaatataagatctacttcattttttgaaactttccatcacaaattgccaaaagatccttcctgaaaacgtcgcaatgaatcatgctattcagaagccaaacttccaggatcctcttcctgttacttgtatagacacagagacatgcaaagattaattactgtccctttcttaaagaaatattcatttaagactgagataattagaaaaatgtgaaaagaaacctttgaccatcagtggttgtgaaagtggtttttaaatcttttccaaaatttctagaggcttcttgcattggacagggaatgagaaagataaaaagtgtcaaatctgaggccacttgacccacaatacgatacaaaaacttttttgttttcgttgactttgtttattcttcatagaaagatttaccttggagcaaaaaggaaaaagaaatttaaaaattagtgtactatgagaaagaaaaaatatccaaagtaaaacccaaaggaaacttgacaaacttgtttagctaaccaaccagttgatcattaaacaagaatttattgagtatctatttgtgccagtcactgctctagggacccttgagacacatcagggcagggtagagatttctgccttcaccagattccttcctctggtgaaaggaagacaaataaacaaaataaatgagaatttttttaaagtatgttaaaagatagtaatttctatgaagagaaactagatcatggtatggaagttcaggagacggccaaattgcagtattaagcagggtggtcggttttagtctccttaacatttttagcaaaatcttgaagtatgtgagaatactagccaattatttaactatttcaagataattatatgttatttttccaatatagacacctcagaaatatatctacttagcttttccttgaaaatgtggtattcagataactaggtgtcagcagtctcaactatatatcattctgtgaagtcattagtatggcaaaacattaatttacaaaaaaagtttcatctcattggtacctccagtccatgaaaaaatgtctatctccctgcctccttcaaccaataaatttgcatctgaaaaccagcattttaccaatgatttcctagggttgctcaaagtggaggcaagcctatttcatcctcattattgtatgtaagataaatgttaaagtgtaaagagtaacagatatctaaataattttgattgaggataatcaatctttaatacttttttgtacaaatgttctctgtagtacggatcatcaggacatgggtgtctagttagtttcaaccaaagacaatgccagaatcataaataatagggtattaatatgatggaaagaagatattaagataatgatactgtttttgttaaacctttggcagattacagatcaatcgttttaaaatcatttaatccaaatgcacacggtatcttttccttattgtcaccattaataaaaagcctcctctatgcacttttgcaatttgtcatgtaacattagcctcagtaattgagtatttttattaatccatattacagatcataaggttttgatatttgaggctaaattatttactcaaggtcagtaaggaacaaatctggaatatgaacccagctcttatgacttcaggactattacccatcagttacaaggtggagttttactccctcaaatgaaaatcttgataatgagagacaccggcattctagataaaaatctgtgaatggtttcctttatactaccactaaatttattgactaagaataagaagatgaaactctgtttcatgattattagtgtttaactgaagaaaaatctttgaagtctccttaaggttggctattctatattatgatagttattttggttcaaaattgtacaaagttttgcctatcataataagcagcgtcacctttcatgccttgtaacacaaagagggacaatattatattattatatttttagaagatctctaatattcttctctgctccaaaatgttatgattctaattaaagatccaaatttatctagtttaagagctaaagactatagaaaattacattgttttttaacctctgaccagcacaatttaggaaatagcctcctatcaagcctaaaagtgttgatggttgttaaaaatctagattaaaaaagtacatttgcaaatgtataaataacataaagtcattattttggagaagaaataatcagtttaacctccattatgtcataatttgaaagttttgctatttgcaacatatttcagtaaaacgcatctaagtttctattcataccacctcattttttaaactattaaagtacagagagtcctttctgtgctcctctctgaggataagttagtctacaacaagtttagtaaaagtcttgtttagatgatcagtttttcaatgttatcattgtttaaggaatgtataatgacacagaaaactttgcttcacagagccaggattacagaaatacattcaagctgggacttttattagtaatacatgtaacaagattggttaaatcacagcaagagataatacataagcatatactcttcaattagtttttcttggttctactcagaactaatgaacatgtaagctaaagatgaactagtaaacaaacattgaattctaaatagtcacatagccttctatgtgtactgtatagataaaagtagatatttaatgtctgatattataaggtgaaactccggtcttcccacggtctgcggctgtgagttaaggggatccagtattgcaagagtagaggtaacacagtagaaaatttaaacaaatattcttacttcttagtttgtatatgcaccaaacacaggcatttcaacagtaagggtctgtcaacattcacaaacttttctgaacaaacagatgacttattattatgaaactaaatgaggaaatacaatttaagaatttatacagaagaagatacatatcatattttaataaccaaattaggtctatatcagaaatcacagcaaaatatattttaaaaagcataaaacaaatatgcattaggattttagtaactggaagttgtgcacttcacagacaaattcgctatatagcaacacaggacttgaaaatggtataaaaataaaaatcatggaaactgtgtgatctgaatgttgtatctttccaaaattgataaactgaaatccgaacccacaaaatgacggattaggagagggggattttgggatttgattaggtcctgagggcagagcctttatgaatgggattgctgtccttataaaagacactccagagagctctctttctccctttcaagtgaggacacaaagagaaggtagtgatctatgaaccaggaagcaaaatctcactggacaccgactgtgtcagcccttggtcttggacttcccagcctccagacgtttgagaaataagtttctgttacttacaagctacccagtttatggtatttttatatagaagcccaaatggactaagacaaagacaaaagaaaatgtattaaaaaaacaccaaatgctttattcttttctaagtattaataatatcaaatctattataagagtaagtttaatgaaatattattgtggtatgacagtatagataaaaatttaaagcacatggtaatattagatattactcatcaattagttcaggtggaagagttgtatccaggtcttaacaattacaattagctttaacaattagttttgagaaaaatctatctttattacttttataaattatactaatttaagatctactcttcacaaagagaataaggcttatgcactttcagaatgtgtaactatattcttttcagttctacttgtaatattttgctcttctagtaacatgagaagcctggataattaaacagtaaatgtccatttgactctttaaaatggacagttgaaaccaccgcccccaaacaaatacatttaagtcatgaaaatcgcaaattcaagatacaataagaaaaatgttctggaaatacaatggtcaaagagaaagacaagctttctgccctcatagagcttacactctactaggaaaagttagcattaagtataatcacaaatacaaatatgtaattacaattatgatgacttatgaaggaaaagtacaagcctccaatcaaagtgccaacattcgctgataattattaacttgtgctcctgagctattaaccagctattatggcttgattttcatgtataacatattttgacttttttgtaatttaaatagtcattcatttctgataagccattaaagtaaaatataaataaacaatcaaagcaattattggaatgaagtgaccagttacacatacataggaaaagaaacaagaacaaaagagaaaagacatacttcattcaaggcaaacagataaacctaaattctaaatagaaaggagaataaaattagcattatcaatgatcctaacaacaacatcattgacaaatttcaagccccaaaaaaatgtgatccaaatttcatgaagactatttgaatccatctacccacaaccagcaaaagtaaggttggctttgaataacagatcttcagctgccccaaagaaaactataattcattcaaagtttattcttaaccatatccagttaaaggtgacatatctttgtttaggaatgtaaaaaacacaagtaacagactgactctaaagtttgaaacaggatgactaattaaaaataggaggcactatggcctatgagaagaatgagtaaactcgtgtttaattcattgtgattctgccagcccacagcagtggtctctaacatgtctccagctgacttcgccatttttgtcatgtacacatgataagggattttgcagtttccaaaccctgagttgttatggagcacagaaggatcaacatcaactctgtaaggacacatcacaaagtgagaccagtgcttacctcgagagaaaggacttgagaggaggatgaagaaggttatcaaaaggcatgttctttttacatgtgttaattattttttaatgaaatatattcatctatcactggacatttaaacagttagaaaatatttaagaattcataaagaagaaatcaaaataatgaagatgttcttgaatttatttttttatagtctttttttcataaagaaagacattaatccacaaaacttcattccagatcccctgaattcactactcacacaagagaaaagtggggaaattgagaaaattgctccatgattatattgagatataaaaatttaggaaacataagtttacactgtaaatcagttatataaactgtccagacttaaccccgattttatgcacaactaggatttaactccacataggaaattgcaatgtaaagttcctaaattattttttccagatttttttttaattcctccaacagatggcacaaggtggggatattcacataagacagacttggattgatgttatgctttcctttttctgaattcctacttcactttgtaccagtctcacagcacttccattctgtcattcattctaacttgcccaaatgttttcatttccttgttatatgaacactctgtggatgccatgtcatagtcatgattgtatttctgctctagaatatagatttgttgaattaatctgcaattagagaagacttacaatcacctttctcatttctctacatctaattaaacaatatgaaatgggtaccaatgtgatttgcaaaatactcaagtccatctaaaaatcttctctctccatttaacagcaaaaagcttactcgtcccaataatagaagaagaatgcaatgaaaaaaacaaattcctgtcctctgtgtctttgtgctgattgaggaacaaaatctgatgaaaactggtgaagttaaaaaataatgtttgacacacatgccaacagaaaacatttaagactgacatagaaaaactaaataaagttaagtgacacttgacattaagtacaccaaaacaaatatcagctgagtataaacatgaactattccatatgtagaaaatggttgtataattaaaaaattattttaagagttactttttcacaaaataacaaatatacgagtgtatatacttagaaattgtgtatttatacatgcatccatacaaatacacatatgcatacatacaaacacatatacatatactttactcagccagtaagataaagtatattcttccctctatgccatccctaagtccacaaactaaagaacatgatgagaaatgcccacttaagagaacgcagtggatgagattttggcctcaagtaaaaatgtttagaaagcactcaaaatggtacacaaaacctctaaaataattgatacatactgtcatttgcatagttgctagaggcttaatatgagattaaattatactattgaaaatagctgccaaaaccaaaactgtgataacctatgttgttggatcaaagtattcaaacagcatttgtttctaaagctctattttacacatttaaaattgatatcatttcttacatattgcctggctcatgttcagatgctttttcaagcagaaaagttttcctgctagatgacacaaacataaaggtgcagaactgtgaactgtggtcccaattcaccagattaacactgagaacacaggaaagaataaagatattcctgcatttaaactaataataataattaaaaaacagaaactaaatagaaacattcactaacacacagttaaaaatggttgatttaaagactattctatatgtttgccacagctgcataccacttacttccttttaatgacaacattaaacacaatgaggatggttttaaatggcaaattacacatgcttctggatttcgtaccaacatcatcaaagagtacacatgcctgacttaccaagcaatgcgggaatgcatagctagttgataatgcccttaaaacaaagttagtatgcataaaaagaaatgtcttgctcctctgtttgtctctttcttaatactgcctttttaggttactacagtgttcatgtgcataaatgacacctagcagacaacaagatgatgcacccacagcagtaccatttcagtggtgcacatgcttagacttatgtctcaatacagaatggctagggcaggtgtgctccagagctgaatatttgaagatcacatatttacagttcctacacttatttaagtaccattaaatgatactgcagaaactgacaccgaaacttgtagctaatttctaaatatattaattatgtgagcacctgacatgaaaaagatcactctaaagagaaaaaaaagggtgggggcgaaaatggaaacatattgatggatttttcttatcttaaatttataaaatatttattaacacatatacctacctcccagtgcccattaccaatgccaaaaggtctaaatacatttatgtaactcagacacactgtaattcatacagatgatattaagaagaaataaaataatgtaatacctttacttttacctatggatttgatgaaatgggtccatgaagaaagggtttccagacaaagaggataaagaggagaaaaacaacaataagtattatgaacatatgtaaagccactactctctgaaaattaaacaagacatgaaagtataaacaaggttttgaagacaaatggagatgcaatcaggacatgttgggaattctgccttttttgaaggcaagtacatgcaaaaaactgaaaggcccatgctcagttttaaaagatcacacaaaagagagacatacaataaatctacgtagagaaagtattgattctgtggaacactatactcagcattctacaagccagaagccaaagatgtctgcatgttcccaaactgtcatgcatggatgaaaaatggacttattttttggatacagtggtttaaactgaggatcttctttcagacagcaacttctgatggttctcggtttttctttaccataaccaccctttactgcatatgctgataagtatatagaaactttcaatcacaatttcttatgtctcatttatttgcaaatattataatgcaagaaatgaaggaaaataaaagccacaggaacaaaccaaaatcaaacgaacaaagaaatggaagaaaaacacatgaaaaaatgtgaacaaaagatatgtatttaatttgcagccatataatttgcaagcatttgcccatcctttgcagtgatggtttgaaagcagctacagaacaagaaaacactgaaagcagagtggaaaaggaacagagcccataccttggtcgcccatcatcaggtgcgccagaccttgaagggaaacaagagcacagtcagcaataaacaagggagcatgggaaggcagggttgtcacggtgacaaaaatgttcagtgacagacatctcttttcctatgagacatgtctgtatcacagaggcaaatcaaaaagcattctttcaacccctggttggaatgctttggggcaaagtgttctagaactgcgttttaaacactggcatatgctgcactgtgtatttcttccatgcatcagttggaacaaccaagagcacaagagcatgacttaaaatccaaccaaacccctcaatattacatctgccctctgtgccctttaatgagactgttttgcatattgcccccacagggcttgtaattcttcagtgatgaaattacatttttttaaaacccaatggaatacatgaaacatgggctgggtctgatctttttcccctcatcaaaaaatgagcattttataattaaatgaagaaaaaaaaattgtagtcacattgaaatgataatgcagaaatgtctccttgtctgacacatgtagcggctgactaggcttgttcaaatacaaaatgatcattagacatgcagttgtaaagctagaatttactacaaaaaagggtttttaagaaacaatgggtcagctgcaaatacactaaagcaattttcctcagagaacaaaattatttgagatttcacctaaatatttcttaaatgctgaactctaagttagtgtaaagatacatattacagatgtaatttcatcaaggaattctttaaaggacattgaaattcctttatttaatttatttattatttcctgcttgacaattcacttcaaactgaagagcacttctcttctaaataatactactaacatgctttcaaaaattcttttgctattcaagaagttactttttactgaaaggcataattcctagctttttattttaaattcagaaataaagctatttctctatccatgtatatgtctacaatacgggaaaatgttagagaaatacacatttatcagttttaataaacttgtattttcaatttccagtgctatttcagatatatttgaaactttatttgagctatataacattacacattggtttcatcagtatttaaattatctgtgttgttttcttaaaattttaggggtattcaaacatctctgtaggctagatataattacaaataatcatctaatcacaatataacatgaaagttattaaacacagtagtgtgatgcctctgaactgtagcctctctgtattttctgagtgattttaacaaaaagttcacacaggcagattcaacagcttatgatctattgataattcatagtgttttatatgctgatagtggcttatttgtccaggttacatattttttcatttaatttcacttttaaaactactacagatatttccaagtaacattttataagttttatggactaaatgaggaaattgtcttgaagatctaccttttagaaaatatattaggtacttccaacggttttgatgctacatcaataaggatggaaattcactaatccccaaagaattcacattcttcctgctagactttctacctatactgtaaaggtcatattatagatagaaatattaaaattatgattgaacagactttattacaatagcttatgggcctatattctaaaaataaatcttaccatgggatgagtgtgtgtgaaaagagagaagcattcatgctaattaggctgattttaaagcctcttgggatgcaataggattttaagagaaaagaaaagcatttcacaggatggataaggaaatgcaaaagaagttgaaaagatacctctaaaaaataacttttaaactcagttgacatgcacaatataaatgagactgacttcaaaagatattaggcctgcagggtaatatatcatttttatcaagtatatactcacatgcaattaaaattatagtatacaaaaacagaagccatatatggatacaacacttagaaaatagtaatttatgatttcttttaaagttttaatctattttatttaaataacaaaacagaaatgttcagcagctaagcaattataatattatccatgtacgaatcacaaatataatgtttacccctgctactggtcaactctgtattatcatgaagtgttctttcttagatacatgaagtcttggtaaccttaatggctatttatctgtaacctgggatagggagtctttttctaagaaatccttcattctatggaaatgtacatttacagaatgactatatttcaaaatatggtagtaaaataaaatatactaaatgctgtcttcccatatacaaatattagtaaattagtaaatctttatgtaggaactgttaatgctgtgaatatataagttgatagaacatatataatttgataaaaccttccctttcaccattcttttgttatgccttgttctttttgcatgttaacactttgaagatttgtttgtagcacactgactaatgcatttaagttcttaaaaaatgagaataaggaaatatgttttaatttgctggattctacaggaaaatatataagctatataacttcttcaaaattccttgacagagataattttttataaaagactgaataaaatatttagcaggcaaaaaatattacaaatatacttaccaggaatcatatcgaaatgctgtatgctttcatgtccactggccaatggcttattttttaatctaaatttatgtctcttacttatactcagtactttattgcattctttttatacatccaatcattttaaacaaaccaatgggcttgaaatgagataatgctaaattttgccagaatagaataagtcattttgataaaaaatggaaaaaggatcatgcactgtcttatgaaactacaaagaaatattttgtcttttaaagtaaaaaaagcagaattgttatcatttttctcatacagaacactgtaataactattctaagcttcatatgggatgctgaggtctaacaagggttggagttaagcttgaaaaagtttcatatacttgggatggcagggttgagaatgtatgtgttctgtatgaaaagtgatacacaatccagaaaccaacaaatgttcagaaagaagttcaacttaccatctaacttcaagatgtaccctattagtactaagaaataaaggacaaatgagagttggaaaaataaggtagaaagcacccaccttccacattgttgtcttctgaaagcacatgacaaggagggagagaaaaggaaaaacattcattaagcagcatgcagactggaccttgcctttgcatgtcttcctcatgcaaggcaccaaacacatcatgcaagtgctccatcactatcattcaagggggaaaacaaaatcacagggaagcaggttccctcccattggcagcattgataggaagtgagacaaactttcataatactgccatgccctgtgcaaagagtttttaaaaaaatctttcaactacccagtataaagcaaacattattgttattacatgttgctggtgtggtctttctaggcaattatttttaaaagcttttttgttttctttttaacaattctaaaaggttctatttccacatactgatttggccttagattttaagaagtctattggaaagagctatgaaatttcacttaaagatattccagttctaccaaatatattatccatatgccattactgccttttagtatttctaatacctcaattgctttccttaaagaaaaacaacgtaactatatggaactaaaatctgcaatttatttggttaatttatagcatattaatattgtattgcaaatgagaatagtttattggaatttataaaaatgctaacttttaaaaatgttaggtaggaaagtgatcactggaagagaagtccactgggaactgtccataaggcaatttggtttgtcgtgatttaaaaactttgtacttctgttgaggatgtgaatatgaatttgtttgagacaatgaaaatatttagctcaatttctcttatatttctatatatctataaaatacctacatgttttcatatattttgttagtcatatttccatgtgtgtacctatgtatatatgtataaacatatatatccaagcagatttgtatttcccaagataatcaatataaatatataaggtttaaagtattattagtacctagtggaaaattcaagttctatttgagactcggggcctgcaatcccggcaagaaatggaagggaaagctgtcttaggggactagggcaagagcaaggtttcagtagttatcaaaaatgttctaatagtaaactctacccatgttgacattctagtctcatccttattttttgtttaattaattgtactttataaactcatcatctgatcagaggtgtttataaacatggcaacatgcaagtatagaaacttgaaagcaaaaacaactaagaatgtaccatttgattaggttcacctaaaaccttcttaattggataaagttactagtgaattaaaaatcaacaattttgtttaaaacatttcagctgaaaattgaagtatcaacacaggcacatctactgatgtggtgttagcatgtaatagaaaatggctggtggctaaatgtgggtaataacatctttacacaatacttggttttccagagtttatttttaaagaaacaacaaaaaaaactttcaaatatttggtctgtgatattgacttctagtttgtttttgtttgttttttggactgccaatttattaaacaaggaattaggctgaatttgttacttttcagtggtgactttgatgttacacaaacacaaatattaaagttttgttttactgcattatattggacataatacaaagatataaattattgtaatgtttaagatatacttttcctgtatattaactttgaaattgtatcttctgtttaagatgcttacttaacaagattatttaatatgtattgtaaaataataaaatcagggaatttagaggagagtcatgtgccaagacagtatgtcaattgctacagcattatttaatttctgtaaagacgggcaaatatggttgtgaggagcagtgcttcggtagaaattttggtaaagtgtggcctaaaactacaattaaaaaaaaaggaaagaaaagcaaaccaacaaaatgaaacaggcccaggcctgacaccaactttaggaatgcactaagtagggcattataaaaggagttcaaggtcactgattcagtcctgacggcaagttctcctttcatgaccatagatacaagcctaggttttgccatggatcctactctaccatctagcatttttttctgaattcttattcataatgagaacaagcttaataatgggaattcctttaaacgatccaagtcatgtttaatgtgtaaacaaattctgactcgactaaatccagaaaagtggtctgtctcagaaaatttagatttagaaaaaaaaaatcaaagtactagaataaatgggtgatatattaaccactgtttaaaaaaaagatggtgatgatgatgaagacaactggcttggagcagactttccttgagtttccatatactttcagattcaatctcagaataaaaatcctctttcctcttccattctattctattctggtatccatttgctaactttacataatttaaaacttgttaacctaaagaaaatccctacattatttcagaatttggacgtgattataactggtggtagctccagcatttacaaccattctccaggtatttttttcccttctctttcctttccattttatttctgtactaaataataaatgtcgagtcaaaaaagaatagtttatctcctcataacaattttttctttatctttgtaaattcttatacacacaaatgctactttgcttttgagcagcaacaaagacaggtgctgaattttggcatgccacggtgtacaggtaaagcagcatattttggtttagtgtaaggtagaaagcagtccatccggccttacctgtggacactgtcaagttagggaaaatctcttggtttgcagaaaaccctggcttcttaattctgctgacctaatccttgctgagtaaatgaagtgcgtctcttaatcattaactttactacgatgaccacgccacctataaagatcacactcttgctttcttttcattggaaaaataatgaatatagagctgtgaaaaagatactttacattttatttttctttcagataggatgggcttctctcacaaagatgggaattaggcaccagaatatcaatcatgctatgaataatggctgtgtgctgacaagaaggcaagcaacagcctgttttaaaatcactgtaaaagagcatcttcacaaaatttttatcttcggcccccagcttataagaatgcaaggacagtaactttagtttatcattccagtgttctttgcacatactcttaagtatacggttctaggaaaacaaatgaatacaaaaacaaatgtgcttgtttcaatataaagaaaatcatgaccagtaaaaaattaaaatttggaataaaatatcacaaaaatctcctttctgtataatcagtgctaaagtttggcaatatgtaagtctttctctaaatgtacagacagtggtccatttagtgctacaacttacattaaaaaatgaccaaaagaagcttcctgatatcacttgggcattcctttacttctttaatttttggtttccttccttctctgctagatgcctgtgactggctcccctcattttccttgattccctctctcctccatcaaaactgccactactgcgagtagcttctgtcccagataccagcactccaaggtatggcatattacagcaaaactggtggtggtaacaggcagtggaaagacagatgaagaataagattctatttccttcctccatacagggagtgtgctaacttctatccacgtctctctcgcccatcacattacttctcaagcctgtactcctcattttggagatcaaatgccagtacagcagagcttagttcccatggtggcacaggatggagctttgttttttcttttggtattagcagtgaaagcctttaaaaaacctcaatagtctgggaatgcttcaagcactgggaaatggaggaaatcattgagactgtggattaaagcagcagtcagctgaaggaatagaaatgcggcccagaaccaagacgatgttcaaagagaaaatgaagcataaaggtccattatggagacttagggaaggaaagaaatggtcctggacaggaattgggctaatttcaaacatgctttttaacagaggacatcacctcctttttcaatcccagctaaataatattgcaggacactcccacccagcctgcttggagtactcatcctaggaaatatatggagtcaactacaacaaccagtttttctccttcttcactgctcgggaataaaaaatgtatctctaaaccggatgcagcaacacagatgttcctggcatcacactagaaacacttaaaacaatttccccccaaaatattttgttacaaagacatttgtggtatttaattcaaaatgttctatcttgttaatgacaattaaaagaaagaagagaaaaagagaaagggggcaggaggaaggaaaagcaagaaagcctaaagttattgcgatttatagtgattaagctatttgatgaacctgatgaaatttaataactgttagtcaacatattataatataaatcgaatgactcacataagctataatgaattcaatttcaaattttcatgaggaactactacaaggattttcaaatttgttttgctttgataatctcagttcttccccaagtctaaatcttgagagttaacatttcaacattcatttcaatagttggacttaggaaggaacactgaatttaacagtgactgtaaacatggtgacaagcacagtctacagtatgtgtgctcacaccacctatttttattttttattgctgagaaatgaatgcttcctgatacggaattgacagacaacactgagcagagtgcttatcacataccctcccaaccaagcttaatcactgttaaacaactctcctaagaaaggtggctcaggtgagcagtgctttcctttctaagagtttgacgtcatcatattttaggatacagagcaagaaagctcttggactgaggttaagagagtgaacttaaatacaccctacctactttcccaacttaccaacccttctagtggttatgtggttttgacttctttgttaacagatggacaggagacatcctttggcctgtgtattaccatcagagaatattctgcaatgtgttctaggtttgctatcattaagatgaaaagtaggtgaactcccactaataagactaatggtcttcatttgaaagagctgtcaaatgtctactggtatataaatttttttcaccattttttttcatcttactacagatgtttttcaactaaatattaaaatactcttaactttattattctatacctgggttcttagacatgtccaaaacaaatctatttaatttatctaagaaaaggcaaaaatactttgtgatgaaattaaaaatatgactaaaccacattgtaaaaaggagtcttaagtttgatgcttaaaaattacatttacatgcagtgtacagaaaataaaattatttatatgatatgaccgacctgacaattatacattctttttatatcaaagaaaaaatgaaattttatatcaaattaaaaatattttatattgttatcttcacttcaataggaccctcacatatgtaacaaacagcttggaaggaagctattccttggaaggaaaaatgcacagcatattaaaaggatttgatttttcatttcttcagagctcttagtttttcattttatatggtgttaaaaattcactgtatttacatgtgtcagtttatgactaaattaatttcaaagttttatgaaaatcactgaaaattattttaaaaggaataggccattcttagctaaataaattagatcatacattgaaattttccaggaggctctcgggattgattaaaatattattttttttttctggagatggagtctcactctgttgccaagactggagtgcagtgtcaccgtgttggctcactgcagcctctgtctcctgggttcaagcaattctcctgcctcagcctcccacgtagctgggattacaggcacccaccaccatgctctgctaatttttgcatttttttagtagacacaggatttcaccatgttggccaggtgcctggccaaaaaatattacttataatcaggctgagcacggtggttcacacctgtaatcccagtactttgggaggctgaggaaagtggatcacttggtgtcaggagttcgagactagcctggctaacatggtaaaaccccatctctactacaaagacaaaaattggctgggcatggtggcacatgcctgtaatcccagctactcaggaggctgaggaaggagaatcatccttccttcctgctcacttttggtttccatttacatggaatatctttttccacctctttacattaagtttatgtgagtccctatgtattaggtcaatctcttgaagacagcaaatacttggttggtagattgttacccattttgccattctgtatcttttaagtggagcatttaggccattgacatcaatgttaatatcatatgttcccacttacaagtgggaactaagctatgaggacacaaaggcaaacataatagactctggggactcaagggaaagggcaggagaggagtaagggatacaagatacacattaggtacagtgtacactgctcgggtgatgggtgcaccaacgtctcagaaatcgccactaaagaacttatccatgcaaccaaacacaacctgttcccaaaaatctattgaaataatttaaaaaaataatgtgctagaaaaacacacacacaaaatataactactggtatcacttttttttcttaacagcaatagaataaatgagtaagaagactgtgagaagactgaatgatttcatagatcctgctgcaagaaggcagaaaaacctcagagaaaaatactattttcttaattgcatttatttgttgattctataaagtctaagaaactttaatactgcttaatttcctttattaaagaaaaaaaaaggctcccagtcctcttctctagattgttacaataaattgcttcctcaagaaaaaacaaaacaaaacaaaacaaaaaaacacgcatttagaaaatattttgtcctactttaagagcaaaattaggtccaggtttataaatgtgtttacccatgggcattctaaccactagaaatcaaagaaagaattattccataaatttcttgctgtctttaaaatttaaagaaaagcactcgtttcatacccatcacataaattgtgccttccttttaaaacatctgaaacaaaatgacacttttgttcaaagccaaatattttggtaggtgagacaatatattatgaatttgccacataaaatatatttgctctttcatttgagttataaaatgcaaatttggtaaaaaatattactttcattccccttacatactcgctgtgtagtaaatctcctgggaactgagcagcaaattataattcttttgcaggaagaaaaactaaatactatacaaactgcaattctcttttggaaaaaaagtgttttgtgttacagagttataggaaaatagtttgttcataggtacaaccaattctatacttttgaagatattatatatgtagttatttgagttaatgtctagtgactaaactaaacccatatgaatattggtcatgtggaagagagagccatgatcttgattaatccattttatatctgttgatttactgatccataaaatcaaatcaacacaaatacaaatttctaggtaccctaatgattcctttttaatgttttcctgaaatgggcattcactacttaagaaaacatgctgaacagaaagagaaatttccttttgtaaccctaatatagcttcttaaaatattaattccataattcagagaagttcactttactttttaaaaatgtataataagaagacggtatacttaattacttcttcaaatttgtttaaactgctttctatgactaccggcaagtctgcatttctaccaaaacaatttcaagaaaatttaattttaaaaataatctcatcaagccacacctcattatatgttgctttaaaatgtgtggcaatacaatgataccattacttcaaaagctcctccctaaacatcagtaccagcatgtgtgtatctctctaacacatatgtgtatacatatacacacccaattggtatttcatttcataaacaaatccaaactgtgatatttttctcaataaaaatattttttctacaaaagttaacgtgaatagaagaaaaacatttataataaataatttgataagatcatcaataataacacaactactacatgaccacttttcctataaacattttaccttactaataataggcattaaataaattataaacttctcttttcctctttgtatctgttatttcaattttgtttgtacgtattagaaaaacagagtgttttctaactgcatgattgaatatgtaaccacagagacatatggcatatttctaagtaaaattaaaatttcagttccttagccatgttccacatgctcaatagccacatgtagccactggctaccaggctggacagcacaaattgtgaagctttcagtcattacaataagttctattgagcggtattaactacagcttctctgacaatatcttttaatatcaagctattcatataatgtacatattatttgttctttattcaaaaaaggaaataattaaaatgcatgatggttttaaaagcaaacatctatttagagcagggttattacatttgtgcaatatggagaactttgtaatatttccacttaaccttaaaataataacaattaggaaataaacctgataaaaattttattgtattcatttaaaaatgtgtttgaataattcaaactctggacaattattactcttttcatcataagtcttttcctttagacctcatagatgagaaaacgctgaacctattttgatttttaagtaaactaaactagtaatctaatatcgtcttactcttaagcccctcattctcgcagtatgcccaattagatcatttatcattactgtctttaagtctatgaccatttttcaatgtaagagtttaataagcttttaacagagtagttttaaaattaatttaaaaagcgcctttcatcctactatcttatataatgtattctcttataggtcaaagactttccttcctataacatgggcctctttttgaatattacaccatagaaaaataaaccaaatgagcaaataaaatagtcaacatttctgtaagacttaaatacagcagagataaggcaattggataaatggagcagttcacacctctagttaattctagaaaagtccaagatcctattaaggaactactacatagaaataaatgaaccaatgagaaggcaaataaaaactgagtagggagaatagaaaaataatccttaggctgggcgcagtggctcaggcctattataatctcagcacttcgggaggccaaggcaggcagatcacttgaggtcagcagttccaacaccagtctggtgaaattgcatgtctcttaaaaatacaaaaattagccaggcatggtggcaggcacctgtaattccagctactcaggaggctgaggccggataatcacttgaatctgggaggcggaggttgcagtgagcagagatcacaccactgcactccagcctaggtaacagggcaagactgtctcaaaaacaaaaaagtaacccgaatatggaatggtagaaaagcaaaagaaaaaaaaaagtggcaaaattatctatgggatgaaatgatgaaataaaaagtttcatgtcaagaatgagtaagatgtataataaaaatttataatagactttgccaagtctattttagtatttaaagtattttccaagtctattttcagtgttgaaagaatgctggcctgctccaaagattaaatatctttaatgattatagaaaactgacctttttatgttagattagtgacatcaaatctctattgatacatagtgaatgaaataaggcaatgcatttatacctcaatttcctaatgaataacatttaatctaacatttaatccatatgtcccaagcatatgagctgttgtttggaaaataaactaagtattgagaaggaaagatgatttccaaaagatactgaggtcatctgatattttatcagcaccatgctctaaccaactgagctaaccggccgactggtcatctgacattttagcccaaccctggtattagaacaacttgaaagagattacacaacataatgagatgcttattaatatttataatgaagaaaatatgtgttggaaagccagaatcagcatcctgactcagtactatcttatatcttgtactactagagaaaacacacttttacataaaataataaatgacagaaaaccttaatacatttctgacagtattgcaataactaagaaaaaaactagttgtgcaacatgtacagtaagtatgtgaaatggctaatagctgctagtaaatgtagcttgtggcagtacctagtagcttagacaatgtatatcttgcagctatctaaagtaaactatgctcaaaatgtgtaatattgaaaataatacttaacacatggggaaagcacagtggaaagagagtagaaaagtcactgctttctgaaatactgaatagaaagtgtcatcgtttttttaattaatatggctcagagcaatatgaaaactattctggactgagattgagaaaatagacttgataactttaaataggcctaataatagactatgagaattaaatcaatcacttgaaagtttgtaaacatgtatgaaaacgtgggtagtgtgataatttttaaaaaatgaataaattgtcaggaacaaaaaatacactaagaaactacgaatcattggagaatctaggcatttcttaccaatacttcaatgttttatctattcatcttgaagaagaaattggagagagcaaggtgcctctcgttacgagacttctagggtctgttatcacaaataagataaatctaatatactttttctaatatttaaaaatgtttctcaatgctaaatatttaacttgctccacagagcctggcacacagcaaaagaatgtaagaccccttattcaataatgccagattataaagcatcttatttatggctaatacgtatttaatgatgttagccattatattattataattaatgcttccttatacaaatcacaggctgcttaagagcaatgccttttccattccccttcttttgttcagcttctagcacagtatgtatatgtagaatttgcttaataaatatgtgttataaagaataattagtttcctacctcaatttcctgcttggcttctatgaaactatcagtagcatgggaatgagtatgtttcttttagttggcaggatttacttgccgcagtgagctttcttaagttgtattctcacaccagatgtaaggaactcaatcaactggacatgtcatttggggcaaaataaactgaaggagtttagtattagttgccatccaaatttcaggcagtcccagatttattagttaggcatttccaaactttctccatcgattgttgtttatgaagtagatgatgatgatgatgaagatgatgacaatgatgatgatgcagaatacaactgtctcttaaactcaaaaattatttccacttgtgtaatctcattcaattattataaagacatggccatgattagttgagagaaaattaactattaaagatccaattgggtgctaataaagtcatgcatgcctcagaaatggggatacgtttcaagaaatgcattgttaggtgatttcatccttgtgcaagcataatagggtgtacttgaacaaacctggatggtatggcctactacacacctaggctatctggtatagcttattgcttctaggctatcaacccatgtagcatgttactgtactaaatgctgtagacaactgtcatacaaggtaggtatttgtgcatttaaacataggaaaggtaaagtaaaaatatgattttttttttaatggtacacctgtgcagggcacttaccatgaatggagcttgcaggactgaaagttactctgggcaagtcagacagtagatagtgagtaaatgtgaaagcctaggacattactatacactattgtaaactttataaacatggtacatttaagctacactaaatttataaaaaatgaaaattaaggtatgtgtgctcgatggctattatgtcactaggcatttttcaggtccattacaatcttgtggaaccatcatcatatatggagtacattgttgactaaaacgctgttatgccacacctgacttcattgtcaatatcactatcagtatttttgtcagaaccattcaacaagactctaggaagttccaaactttcccatatcttcctgtcttcttctgagccctccaaactattccgatttctgcccgttacccagttccaaagtttcttccacatttttgggtatctttatagcagtaccccactcctgatatcaattttctgtattagtctgtttcacactgctataaagaactacctaagactgggtaattcataaagagtttaaattgactcacagttctgcatggctgaggatgtctcaagaaacttaaaatttcatttttagcaaaatgcctgacacatagcaaaaagtcaataaacatgaggaattaaatgaagaatgaatgacccaatggtaaaatcaggcctgactccaaattctatgttcattcctctgtattagggagttttagcaaacttttaattagtcacaggtaccctacaggcttagcagtatatttataggaagtaaataattgtagatttttaaaaaattaaatgtaggggctgagcgcggtggctcatgcctataatccctgcactttgggaggccaaggcaggaggatcacgaggtcaggagatcgagaccatcctggttaacatggtgaaaccctgtctctactaaaaatactaaaaattagctgggagtggtggtggacacctgtagtcccagctacctgggaggctgaggcaggagaatggcatgaacctgggaggcagagcttgcagtgagctgagatcacaccactgcactctagcctgggcaacagagcgagactccatctcaaaaaaaaaaaaaaaaaaaaaaaaaaattaaatgtaggtagccccattaaaataatgacttacaaagcttcatttagaaatcatattttttggaaaactagcattgtttcctgaatacaaactattgtttcatgatatatttagtaagttaacaatgaaaacatttttagtaaattaaataattttgtttacaatctaaaaatcaactttatttttcagaattttaatagatttatgatttattatttataataaaatatgtcaaacttaaacctatttttattggataggatgcaaatattgaacacaattagattactgacattttaggatgatctcaagcaacttttcttttctctaacaatttgccttgataaacttcaagaataagcaaggtatttaagatggcattctcaggattttggtccaaataattaattttaggtttcacttaaactagtcaccatggtacctaacacgtaaatactaaactaaaataaagctccctctaattaaaacaattcaaaataaccacatcaattatgcacaacagaaaaatacaattttaaatactgttttcagggatactaatctggtaaacatgacatacatgttctgattccagtgcggatgtacatttagaaaattcatccatatagtagttaactgagacatgcagaaacaacagaaccacccactgcatttagaattatatagctgtcaattaaatttttaagaaccacccattgcatttagaattataaagccatcaattaaatttttaaatgactttcttatgaagggattataatactagtcctgactttaaatagaacagacctacgaaatagaattatttcctatttattatttaattctatttatggctcccgaaattgtggctaaacttaagtttttcaatccatgaacttagagtgcagtttaagagatttaatattatcttatttaaaagataagaaaaccagggcaggcgtagtggctcacatctgtaatcccagcactttgggaggccaaggcggaggatcatgaggttaagagatcgagaccatcctggccaacatggtgaaaccccatctctaccaaaaatacaaaaattagctgggcatggtggtgcatgcctgcagtcccagctacatgggaggcttaggcaggagaactgcttgaacccgggaggtggaggttgcagtgaaccaatatcgtgccactgtactccaacctggtgacagagcaagactccatctcaaaaaaaaaaaaaaaagaaaagaaaagaaaaccaaaggccacattgtatgacacaacataaccttgtgctctctgggtcacaagtttgaatacaacttcaaaagaaatagtgtcaataactaaactacttaagaagcagacttcagataacaaacaagatgaaagttgcatactccttacttaaggatagtaagtacaacttggctaaagtttttgttttttgtttttcacattaattttagatgagaaactggaattctaaggtttggttttgttttgttttgctaatagactcctgtattaaaatacaaggggaaaaataatcaaaagtagccaattaaccaataacccctgtccccaaaagggcatctgaaactatgtatatcagaatttgcaaattacaaaaaagaaaatcaacaaacaagttttgccggcctgagatagagatgtattgctatggtttggctctgtttctccacccaaatctcatctagaattgtaatcctaacgtgttgggagattggcctgatgggaggtgattgaatcacaggtgcaaacttcccccttgctgttctcatgatagaattcttatgggatctggttgttggataagtgtatggctcttccccttcctgctctctctctcttctgccatcatgcaagatatgccttgctttcccttcactttccactatgattttaagtttcttgagacctcctcagccatgtagaactctgagtcaatttaaactctttatgaattaccgagtctcgggtagttctttatagcagtgtgaaacagactaatacagaaaattggtaccaggagtggggtactgctataaaggtacccgaaaatgtagaagcaactttggaactgggtaacgggcagaaattggaatagtttggaagactcagaagaagacaggaagatatgggaaagtttggaacttcctagagtcttgttgaatggtcctgaccaaaatactgatagtgatattaacaatgaagtccaggctgaggtggtctcagatgaagatgaagaacctcttgggaactggagtaaaggtcactcttgctatgctttagcaaaggagactggtggcatttttctcctgccctagagatctgtggaactttgaatttaaaagagatgacttaacatgtctggcagaagaaatttctaagcaacaaagcattcaatatgtgacctggctttttccgaaagtgtacagtcacatacgttcacaaacagattacctgatattggaacttatgtttaaaagggaaacagagcataaaagttttgaaaatttgcaactggaccatgtggtagaagacaaaaactcattttctggggagaaattaaagctagctgcagaaatttgcataactaaagagaagtcaaatgttaatagccaagacaataaggaaaatatctccaggacatttagtatatctttgggtagcccctcccatcagaggccttgaggcctgggagggaaaaaatggttgcatgggctagtcacatggcccagctgctctgttatgccttgagatatggcaccctgcatcccagtcactccagttccagtcatggctaaaaggggagaaggcacagcacaggccatggcttcaaaggatgcaagccccaagccttggcagcttccacatggtgttgggcctgcaggtgcatagaagacaagagttgagctttggagccactgcctagagatttcagaggatgtatggaaacacctggatgtccaggcagaaatctactgtgggaatggagcccacatggagaacctctactagggcaatgcagagaggaaatatggggttggagcccccacaaagagttgccactgaggcactgcctagtggagttgtgagaaggcagctactccagaccccagaatggtagatccaccgacagcttgcaccatgaacctggaaaggctgcaggcacttaacaccagcctgtgaaagcagccacaggatccataccctacagagccatggaggtagagctgcccaaggccttgggagccccactcttgcatctgcatgtcttggatatgagacatgaagccaggggagattattttggagctttaagatttaataactgccctgtttggttttagattttcatggggcctgtagcccctttgtttgggccaattcctcccatttggaaagggaacatttacccaatgcctaaacttccattgtatcttgaaagtaactaacatgtttttgattttacaggctcacaggaggaagaaccttgccttgtctcagatgagactttggacttggacttttgagttaatgctgaaatgagttaaggtcttgggggactgttgggaaggcatgattggttttgaaatgtgaaagagacatgagatttggtaggcgccagggatggaataacatggtttggctctgtgtcccacccaaaccttatcacaaattgtaatccccatgtgttggagttaggggagtggcctgtgggtggtgactgaatcatggagcagacatcccccttgctcttctggtgatagaattcttaggagatctggttgtttgataagtatgtggctcttctcctttgtgctctctctctctctcttctgccatcatgtaaggcatgccctacttcccctgcaccttctgccatgattgaaagtctcctgaggcctcccagccatgaggaactgtaagtcaattaaacctcttttctttataaattaccaagtctcaagcagctccttacagcagtgtaaaaataaactaatacgcggacttcacatgttaggctagtacaaaagtaatggtggtttttgcaattacttttactggcaaaaactgcaattacttttgcaccaacctaatataatcatattttcattttatagattagaaagctatggtccagagtggttaagctgctaataagtgtcactggcaacaagacatactttctaagaacatttctatttctctttttagaccagtgctatctaatagcaccttctataatgatggaaatgttctatgaaacttaggaatgaattatcaccctaagcaagactaattctctatatgtaactgttcacatctagaactgtgccctgggaaatatcccacaggccttgtagatcttgatgagaagcaatcatcccaataagaattcctgtttgtgaggacttctgtgtagctctggtaaaaataaaagaaggctcatgatcacctagcccagatcagtcttccacacaaaggtaaagaaaaatgtaatgtgaaataacttttttctgaaaataatatatgttgcagagacagtcagacatgttagaaaacagtagagagagaaaataatttactataattgtatttcctcatcctaagcaactccttacaacatttacttaagaagcaaatattatttttggaagaccctggcatacgatttctgacaaatgatggaaggaattggaatggagaaacgaaaaaccatcttgcatctctgataaaatcaaaattggcttcagcactcaaaatatgcagggcttggttgtttttgtttagacagaattaaaaaggaacttgtagatcttattttagaattgttttttcacttggctaaaacagtaagcagtataatctggtactataaaagcaggactatgtatttagtttgccaattgttgtgcaaaaataaaagcaaatcttggaaaaaaagttgagaagggctgatccattttaggcactggttacacaaattataaagaatgggtataactctcctggtgaagaaattcacagctaagcaggaaactcggggtctccaacacaaactactctctaatgtgacactgggaaggtctttccacattgtgagcctcagtcaccctatctttaaaatggagataatagaatctacttcataggattattttaaggacaaattagtaaaaatcacatatattatgtaacacatagctaatgaataatagacacccaaatactttcctacttccgtttattcattttgtataagaaaacaggataaaaataacttaaatgaaaccaaacttttaaatcttaacatatttaccaacaattttcttatcctatacttctatctggcaaaaggaaattgtatactgagtaacagcaagaatctgaatgccaattgatttccaaaatggtgcagtataattaggaaattcatgagtcaaattcctgtttatgcctgtactgcaaaggctaatcatttgtttgttttctataagaaggacttgattaaagcctctagcagcaataattaaccctgtgcttgaaggatgcagactcaactagcactgtgtgtgctaaaatctgtaattaatgcataggaatgcatgtaaattaacagatgagtgtcatttacactgatggtacaaatgcaggtttctttttttgggaattacttcagtgttttctgctaaccattacatactataaactcagactgatgtaaacagcattctaacatctacaaagagtctctacttcagaccatgatctagatgaggggttggcaaacttttctacaaagggccagatagtaaatattttaggatttcccgaccttaaagcctctattgcagctactcaactctgttattgcaatgggaaagcagttacaaataatacataaacaaacatataggctgagctcattggctcatgcctgtaattccagcaatttgggaggccaaggcaggaggatcacttgagccccaagttctagaccagcctgggcaatatggtaaaaccacatctctacaaaaattagctggtgtgctggtgcacatctttgatctcagctactgaagaggctgaggcaggaggattgcttgagcccaagaggtggaggatgcaataagctgagatcgtgccagtgatttccagcctgggtgacagagtgagacactgtctcaaaaaataataactagatatataaatatatagctccctctctctctctctcttactatatatatatatatatatggctatgttgcaataaaactttatcaaaaaataggtaatgagccagatttggcctatacaccatagtttgtttaaccctgagccatagtttgctcatccctgacctagattctaattattaggtaatacagcatactgtataatcttagaaaatcaatatttatagattagatacgggcactgaaatataaacctgatgtgaaaacctgacaagtttctgaacttaagttagtctccctcctcacataaaatttagataaaacatgacagactgaatttaccacgactttatcgtaagaaacaagtgactccaaaatatgaaagtacttcagaaaaacagatatatatatatatatatatatacacacacacacacacacacacatctttacttgtaaagtattattattattattattattattaattggtcatcttttcagctctatgttttaaggcacctagaggactcacttactctggaatgaccatagaggatacaaactacacaaaacatactcagagctgatccagtaatgctagaatttaagaaacacctggcagacttaggatcccatggggctgccatgttaaggaagcaatttctaaagtcagacccaaggtacactagtcatgagagatgtccgtcaagaagtccttcaccagtaagtttggaaatgctgcatacgacgctatgaacatgagcttaattacactatgagcattagtactaaagagatatttgtcaaaaagttcttgacaaataagtgtggaacacttacacctatttcagaggctcacagtgaattattataaacttaagatgctaagatgtcctgcataaactgtgcacctttgtccaatttcccaaatgtgtatctattgagattctttatcttgtgggtgaagccaattaacagagctccccaaaactaactttgaggaaagctttcatatagattattctgaacagttacattctttcactctgggtgtgagaaaactgccctactaaacttacatttttaaccacataagagcaaaaacactcatttaggtatttacttacatttaatttgtctgtcattataatggaacttttacttataaacaattttatggaacccaaccaaatttataaaattatttaaagcagtataaaaattacactcacctcaatatactttaaaaaaacgcaagacttattccaaacatgaaatatttctgatttaaactttaaaaaatcacagacaggtatctactggagcactatcaagacacagtgacttaaataactttgtgctgaaggcactaaaagctattaaatccaaacatttgttgcttttgctgaatattgcttaaactgtccatcaggaaagaaggttgaaaaataactgcatagttcatgactttcctatatatgtggctttctgattattgggtttcttctggtggctttttcacaaactatttaatcaagaaaggcaatcctattcttactgggcagggaatagctaagtaatgatttctcttaattccaaatgtttctttcatttgcaaccagaaatttcttacatgacaaagacaaacatttttgtccagtcatgtattttgatatagaagttgaatctccctttggagctaaacataaaaattaaccaaaatcaactcatatcaaaatcaacatgataccctttttctagcatttagcagtctagcataatccctgacatgtactacgcattcaataaatgtttggtgaatgaataaatgaagaaatgaatcagacatttgtcaaatactgtagttcaaatatacaaatactattattttaaaataatttatattgaataatttaaaaatatattcttagtccaaatatccaataattcaaaagatctgaaacagtgataatatgttattacagttattcatttcaatatcataaccattcttttcccatgcacggcaatggagaactaagaaattttattctagacaagataatatacccattcatgatacacagacactagatacataaaacttaattatagagcttagattatattctaaccagtgaatatgcttcttgtgatttttggaccctagaatccatcaattaaaattcaatatcataatattcccttacagaggaatagggcactcctgccttgaatgcttaggcaaaggtacgtatccaaataaaaccaatcatgttaaagctacgaagggtttccctcatttccagtgaaatagacatgtataatatctacttaacagtacacttgcaaattttttcacattagtgaaaagggaaaaacttgttttctcatcacgctgagtatcaatttgataagtttacataagccacaaaatattggtttcatttattcagacagataatatggttcctaccatattccattgccatttatgaaacatttgcttatctcaaaatacattaaaaaatccttcccacataatcctggcaagttatttattttattttaaaatatattaatatttcagaacacacttcccaggacatccttacaacgcatatggcacagacaccacatttcttcaataaaaaataaaagccatttgtctctaaatacacttgaaaagatttcttgaggtaatttttgttttctttactctcaatgaacagaattattaacatctgaatattgacaactttttaatcatcaaacgtccattatatattatggcaaaattaataaactgtaacatggcaatttagatagatccaaaatttcacaaatgatataagatattgttctaagtatttatacacataaatcattgctaatccctggatgccttttataagtaaaatagccagataacaaaagaagcaataaaaaacacacttaaaatatactgtgcaaggaaagtacaattgaatgcttttaaaaatatcagtactctgggcaggttaatatttgccaaaatcgtttgctcctttgaggtttgctggttgatctgaatttattggagttcatttcattgctttagaactcattagcattagaattctgatgattgagggagcagctaatacatactgccccatttaatcttagagtaggcttctaaaataatagtaagaattaaccactttggaacctcagagtagccatatcacaggcaaatgtctctttcaggcagtcactaattgagcccagttactttttatttgtccttcaagataccacactgcatagagcttatttggaagtctaattttttgtgagaactactaggttatttacaagtagggacaatgaaacagacacactttcccttggagactttccagaatactgtgagtttcctgaataggtatttccatgaattcaatatggcttatccaccaattttggatctggtggaatacaccaaaataaaaaggcttactacaaaagctgacaaccagggagcagaaaactgctagatctgttctataaacccaaggaaatatatataattaattagtccagcatttgttaataagaagactgttcttaggactgtcctattaaaagttgagtgagaggaacctgaaaatacctttgtcactattttgtccaattcacttaaattatatacataaattttattacatattcttatctccataataacatgtggggctcaaaagaaagggaaaacattcactatattcaaccatataatactgagttgaaatagggatttagttaaacaaaaaggatgaaagtgttgctggttttaaatgtgtctaatttagttacttacctttcatatcaattctgatgtttccaagagtcagataatggcatcaagaaatagacttggctgaacagtctacacatactcatactgaaacatactctttaaaaatattattaataaagttaataaaatcaaaatgaggaatacaagggacagagaaggccacaattctgatacaataattctgcttcatctctagaatgaaaaaatcattctcactctcattcttcctagtgcaatccagacatcctgcaaagttttcccatggtaccacgtttctgagcataatacatggtgtggtttcattcctactcaggccttcattctcccaggagcttcttattgtttttataataaaagtatcttctgacttcttggaaaaactaggaggtcaaaataaaaacttttcccagaaagcttttaccggcacagccagaacttgctataaactaatatttgctacctttgtatttcatgggttagatattcccacagatgagtggttccagagccacacacagccttttcttggtattatatgtctcatctatttctgttgaaagtgtgtatgtacaaggaagatttggggaaaactacaatttgactggagtttgtaccatcccctgggtatcatgctaacttacataactgtgaaggcaggaggagattaattgaagtaagaatatgtgtgcaagtgctagctatttgctaagcagaataacaacactggaactatctcctggcctgatgtttagagcaacatataaatgctctcaaagcttttccacttgtttctttttttccatagtaatctgggaaagtggttgcattatttcctttttttctggattctacaaatcttttaaaacatgtgtcaaggtattagcttcataaatacttcaagtaggaaaactatacagaagggaaaatagaaatgtgtggactttggagattgcaataaaaaagaaaagataaaaacatacatgtcaaattatatatctagttattttttaaaatcaatttatcagaatacccatttgacaatttaggctggctttcactggagaagcacattaactcagttaagtgtctgaatttcttccgttaaagagaaaaagaaggcaaagtcagaaaatcacatattaacaatgaattgaagactgtactggggcgtgcatgtatcacggtttctcacctttgttgctattaacattttgtatcggataagtctttcttggaagggactattctgtgcattttagaatgttaagtagaatccctggcactaaatgctactagtgtgccccgcccaaattcacccccaattctaagctgaaaagcaataatttttgtaacattatttcggtaacaacatttaacagcattttggtaataataagcagtcacacagaatgtgagtgtaagcgctagggtccatgctaataactttttacaaagataccttgtttattaaccacagaaacaatagctttagttctaattatcatctccattttacagaaaagaaaacagagtctcagaaatattaaataacctgagagttctagtctgtaatcagtggtcagtgaaattatgtcatggctgtttggaaagctaatataacaagacatttctttcatggaaaatggcagtggactgaaatttaatcagggcctctgttctgacctcagccaaaaaatgtgaggtccctgtatgtcagtagtaatatactgggaattaatgtattagattgtattcaattgctcaaggacagctgtttgaaacaatgtattagaaagaataggttacagctcaggataattccttggagatgtgccttgggggcaacctgagggacaaaaggggatgagatgagaggagatgagatgagaggagtactatatctgaggcacaaagcctgtaaatctgtgaatgcatatgcatatatggatttcacaggatcagagaatgtgctgacctttagtgggtaggggttggggtactaaacgtcccataatgcaaaggacagtacagtatgctcattgagctttcaaatgtcccgccagatacccaactggatgaataacttgtgtataattatctgagcctagaacctagctttaagtaaattgaacaccaagtatttttggcacacctttatatagttcactaattttttttcagaatacaacaactatgcaaacctggaggagtttaaaatatatttggtttggaaatttaccaagaattcctcactatttcaaaaaaaaatgtcaccaactgtaacatctctcatagtatgagtcaccgatgtaacacagctccattagtgtgcaaatgtagcttcatattcatgcttcttttaggtaaaagcagctgcctacctcactatgtcttctattaccctcatgcctgaacatctgcatattgagatacacagaattttataaaaatatgtttcctcatatttttccttcatattaccattatggaattatagtgattttaaaaataatatatgttatataatctatgttatctatctcatataactggattatctatgaatttcatttttagagtagcaaaactgtacatgaataaatatatatatatatatatatatttttttttttttttttttttgagacggagtctcgctctgtcgcccaggctggagtgcagtggcgggatctcggctcactgcaagctccgcctcccgggttcatgccattctcctgcctcagcctcccaagtagctgggactataggcgcctgccactacgcccagctaattttttgtatttttagtagagacggggtttcaccgttttagccgggatggtctcgatctcctgacctcgtgatccgcccgcctcggcctcccaaagtgctgggattacaggcgtgagccacgaataaatatattttataaaaagaatatactgaatatgagaccctgtcaaaaattctatcttttctcacacatacaaatacaagacaattataaacttaataaacattatttatagaattggaccagataatttaaagaaaagagaattctacaatgtaaaaccctttaatataagctgttttaataattggaaaacagaatgaataatgtttttgtttgtcatgcccaattatttcaacaagtttttattaataacttgctacatggtaggcacagctgtaggtgttggagatatagaggtaaacaagtctgacatgatctatgctaccacggagttcttattttcaaagtggaaggtagaaaataaataaaaatgaactagaagagcaaagtgcctctgatgagcatgcagaagcatgtttcaaaatgtctgtggtgggataaatagatcagcaacacaccaggccatgcaatttggcagcaaatcacttctgcagtctagctgctgttttttctactctgaatcatactccccctttcgtcatctatgccagattccactgagcttcaaccctaccctcccattttacatacgttgccattttaattaattaagtggaaaagttttgacccatcaaccagagctcaagctgctagaagaagtgaatcgtttcttatgcttctttgtgctccattgtgtccccagtaaagtggtgtacacaggaggtaatccataatgatcaatatatatggaggagaaaatactaagagagaggaacactgtcaccctggcaagaaagggcaggtgaatgggagactgaatgggagatttaagaagtagactctgactctcccttaataacttatttccacttcctgatggaattgcacaataggatgagtatagacccattatgaatagcacatccattgaacaaagttgaaattctgatttagccatttattattgtaaccttaggcaaatacctcaatgtctctgagtcacactttcctaacagagaacaatgaaaacctaatgaggttgttacaacataatgcttcagaagcccataacaaattgtctggaatatagtagttaagtcaataagtatagttcattttcagttcactattttaagagttgtgctttcataactggcaacaaatggtataagcattttacgtcatcaggacatatcaaacacatcatacatcatgtgaactccctaaaaattgaaattgaagaaaaaagctacaacaagaaaaagtagtattacagtatttctatgttcaagtgacaattttttttttttttttttgagatgaagtctcgctttgtcacccaggctggagtgccatcgcatgatctcggctcactgcaacatctgccgctgcctcccaggttcaagcgattctcctgcctcggcctcccaatagctgtgattataagtacccgccaccatgcctggctaatttttgtattttagtagagacgaaatttcaccatgttggccagattggtcttgaactcctgacctcaggtgatccacctgcctcggtctcccaaagtgttgagattaaaggcatgagccaccacgcccattctcaactgacaaatatgagtcacaccaattgtcattacatggtatattgtagataggttaaaagtaaaatcaaagggacaaaatatagagaccaattgaataaaaaacttttcatagctgaatcaatactttctaagcattcaaggtaggaactccttagcccccaccctcctaaataaatgcacataaaagcacacaccctttttaatggtactaaaagacctagagtatacattttaatgaagttaatcactacttcctctctctgagtagaaataatacatatcacatataggaattatatatatcaaatctcactccttattttcattatatcttgtttctctcaggatgttttctttcttcaaatgaaagtcaaacagtatgatattacattactgctcaacttcagctttaatacaattattttaaagctattcaaccagttcttttgaagggatggcgttatgtggaccaccttgtataaacttcaattctcaagctctctacatattgctgtcaacattcagttcattgcagagcttaaagagtatacttcactgatgtaaatgctactcacacagagtccaacccagagcgggttcagccatttatggggcagaacagggacatgcaggaattagggcatagacagactcacttgaagggagtaagcaatcaagaaagttccagcagagctgggaaagaaacctgaatgggtagataggtagtccaggcagtatgctggtacgcagtaggcacagttcaaagaaagaagagaagcaggcagggaagctggaggaataaccttggacaaaagaggtttggtcagagggcctggcatgcaaagcttacttccagttctttataaactgtgaatcaaggcagagttggagtttctatgaattaggtactcaacaggagcttcttcacagacgtccttattactaaaaccagaattcactgtcagaactggaatggcaacatgagagacttgatggtatcaccaactgggtcaggatgcaggatggttccaggacctggagagattggtgtacagcatttttgctataggagataaacagatttagccaagaagaccaactcaactggcacttacacatggggtgcagcaggtgaggaagacagctgggaagataaaaaaagggaaagaagcaggtgcagggtgtatttccttcatttctactcatctctctctctctatctctcacacacacacgcacacacaaactcttacataattgtctggttagggaagtaacattttaattcacagctgacatgggtcactattcatacaataaaacatataaagtggaggctgcaaataattatgtaccagagattctgtgagcaggatgaaaaccatagttcacaaaactgttagtaaataaaaaacaggagagggacggctggccctgactgtcaccagctgtgtatagtcacagctcttcagtggagttcaaagagtaattacagaggagtgagttaaattctgtaactgctggttacacagcatttaatgcaatgatccatttagccatcatgctccttctttaagaggaaaattttaaagcaggctttttaaaaagtgacattgaaaatatggcagcttaaaagtaaattttattagtaaaccacatatgaaagctttgaaatgttcccttaagctatgtcaaaggatcataaataagtataactgtcaacagcagaacagtgccatttttatatatgagtagaaagcacagagaggttaggcaactcatttatgccagacagttagataacagcaagttgagattgaaagcaattctcttggatggatacagtgaagctgcctttcttttttacatttcccaagaacatatttagagaaaatgcaacacttcattctcaatcataacttagcacagaaactgccaaatagaaagtgtttgataattactgaggggggaatgattgaatttataaatgaataaattatacagcctctccaacaagttctgtagctacagactggggaggacagtccgttttcccagagtctgccgggcagcagctgggttagcaaaacacatgaaacatgtttgtgagaaaacagcattggaaaactagtgcctggctctaccctaaaaactcagatcctcttgaggtatgattcttttttaaatgtccagttagttcttccagggaagcaaggctaatacggttgtctcccttatccacattttcactttccaaagtggctgttaccagaggtacacaacagtaacatattttgagagagagagatcacattcacataatttttattaaaatatattgttataattggtctgttttataagttattgctgttaacctcttactgtgcctattttataaatgaaattttgttataaatatgtatggatagggaataacatagtacacaggttttagtactatctgcaatttcaagcatccactggggggccttggaacatattcccctcatgtaaggggagtaatcgctatacataatactagctacttactcactaacgtgatgggcttaaaacaaatacactttaaaagtaagatttagctgggtgtggtggctcatgcctgtaatcccaacactttgggaggccaaggtgggcaaactgcttgagccccagagttcaaaaccagcctggccaatgtggcaaaaccctgtctatactaaaaatacaaaaattagctgggtgtggtagtgcatgcctatagtgccagcgactcaggaggctgaggcaggagaatcacttgaactcaggaagcgaaggttgcagtgggcgacagagtgagactatctcaaaaaatatataataataataataataaatttaatttaaaaaataaaaagcaagatttaacatttatagagcttaatcattatttcgtttactggcctaaatgccttacagatgacattcatcctaacaaactcaatgaggaggtaatatggtcagccccagtttacatacacggaagctcaaggatgggaagatcaggtcttttccccagaatgaaggagcagagggagtttgaaaccagagctgacacttttaccacacacaatagtatccattaatatgaagcaataaggatgccatgaaagatggaattgggagtatgtggggttagaataagttagctaaaatgttctctatgcttggaatgtcacggtagtgactaccaaggcttctttgtacaatactcttttctcaagatttgtgcccttgggtaaatccctattccatgattaaaaataaaaattcagtaaaagaacctgttggtcaagatgatgcaagcagacatcaagataaacctggtttcaaattttggcgctgacacttattagctatgtgtccttgagcaagttatttaatctctctcagcttcattttcaggatataaaaggggaatcataataacttacataaattttttatgaggttataaagttctgaaccaggagccattacgccccataaggcatttttggttatcataactgggagtggatattaccggcatttactgagtagaggccaaggatgcagctaaatatcctgcaatgcacacaatagccctacaacaaaaatttacccagcacagaatgccaataaagccagtaagctgacaaatccttaaagaaatacatttgtgatatccctggcataatattagtaatcaataaatgattctgcggctttatcatatgtatgaaatttgtgaagtaatttaggccaaagttttaaatactaaacactaaaggattcttattccttctttaatccagaagagaaaaagtgatttattcttaattacttttgtcatgtttgatttcttgtaaaatattgttttttctgattcttccccacattaaatgaaattataatacatttcaaatgacatttaaaacaattcataagttaagctatcattctggcccagaagtcttggtggcttataaatgatttatagtatccactgagaacagtggagaatattttagaaatgaaaataaaaaacaagggatcattcaagagttagctttttttgtagtggaatcattccacccctctctattgtctaaggaagtaagttgcagcacatctttaagaaaatgctacagatcagaatcctctgtttatttgtcttgcgcaattgtctcagtgcctttctgggccaaagttttgtttcgctttgtttctgaaagcatcagtcctggaaatgggaccattttcctggaatatttggaaagattttaatcagaaagtgtggtcaagggaacgagagattcctatgttcaacagagaagacagctgcaaaataaaactccttgctttggagctcaacattaataagctttctgtgtacccagtagaattctagatacaagtataagcaccagaaactctcaaacgacactggcttttgtaaaataggatctcaaagccttcatttcagctctcaaaagttaacatatatactatttacaaattagtaatttgcattcttcttttacctaggaacatgtctttacaaaactactattggtgaatgcttttgtaataagcttgttttttttaattcatttatggagtatttattgatatttttatagaaagtcaactggtttttgtgaattgatcttgtattttgcaaccatgctgaactaatcagttccactttccttagccttttctgtatgcaagataatgccatttgtaagtagaggtagttgtatttcttcctttctagtctggatacctcttagtttcttttccttacctaagtgccctggctagaatctccaagacaattctgaatggaagcagcaagagtgagcattcttgtcttgtttctgatttaacgggaatgcagtcagcaatcattcagcagctgtgtgatctcagcagctgtgtgaatttcataaattttctttattaagttgaggaactgtccttctatttctagtttgccattacaacgatttgtttccaaacattaaactaacattgcattctacatcctacttaattatgatgtggtatcatttttagattttgtcgtagtgtctttgctaaatttttcttcagaatttttgtgtctacattcatgagatatgatctatagttttttaagttattttgtctaactttgatgtcagtataatttttaaaacagacaataacaagtgtcggtgaaaatgtggaaaaattgctgatttttcttatcatacactgctgataaaaatgtaaatgatgcaacccctttggaaagcagtctggtaggttcttaaaatgttaaatatacagttaccacatgacccagtgattccactgtcatatacatactcaagagaacggaaaatatatgttcacataaaaacttgcttataaatgttcaaagtgttattcataacaggtaaaatatggaaacaacccaaatatccatcaactgatgaatgaatgaataaaatatgctatattcacaaagtcaaatattattcagccataaaaagaaatgaagtactaatacatattacaatattaggacattatgctaagtaaaagaagagagtcccaaaatgccacatcttatatgatttcatttgcatgaaatgtcctgaacaggtaggtctatagagctataagtagatgaatagatgccaggaactggggacagtgaagaatgggaaggactataaatggttgtgggtttctttttggataatgaaaatattctggaattagcatgacagctgcacaatcttcggaatatgctaaaatccactgaattgtacactttaattttatggcatgagaatgatatatcaagttacatgttatgcacacatacacacatatgcacacacatctattgctgatctcagtttcaagaaacatggaaattaaaactagaaataacatttcttgatagctcatgtaaacatgctgttttaacaaatgaaaacttgagatacagagaagttaaatgacttgtccaaaattgcaaagttatttatataaaatttcaaaaaattacttatagtcctggactgcttctataaccattttcttatacacaaaaattctccgatgttgaaatcattaaaacaaaaacaaagtactactttgactcttccactgttctcaaaagaattttttttttcatgtcatgttgctttctcttaagttgtatgaaatgtcctgggactcctcttatctaacagatgaaaaaataaacattaaagatcaggtatttatctccataaaaaggttagcgagaaagagaacaacagatctgcctccataaggcattaattttccatatcagatggagacagaagctcttcaaaggacttaacaactttttcccagctttctttctctcctcatccctccctccctccctcccttcttccctccttccctcctttccttcctttcctacctagcaatgtaacttttcttaagtagtcctctcttcttagggtaaatgtactccgcattttaaatgatttgaaacctaccaaggtctgttttgacctaaataatggaggcttaaaaaagaattattacagaaaataagcactgtggtaaaccccaagctggtgaagttggtgcacaacaagagagacatattatcacctacatggaggaagtatatatgacacccatggaaggaccacacaaatctatgaatttctagaccttgcttcctctcaggatttacctttagcttctcaggcgtgaacttgcagaagctctctgccagaaatgagtgctcagagtattatttacactctgcctctgggcctatatcaggggactgcaagggctcttctaccctgtatgttagcagacaagatgtaaacgtttaaccaaagcaataaaaacaaaaaaaagcaaacatacatcaaaaccaaaattgtgtatttccaagaaaattactattctctactgagttctcacaaattaacttgtaacttcatagtcaaaatatgatataaagctaacataatttaagcaactgtctctgttaatccttacattggtctcattaccaccattttcgggtgagtagtatataagtttttgtaaaaattaggtaacatttggaacaaatgaacacgtgacttttttgcctactctctatttacaaatatgctgatacagagataagactttaaagattatatgtccattgacagagaaataattatttattcccatccactatgatatttgtttctctcgataatcctgtgaattgactcaagcatatatgatagaggcccatttacacataagtacatgataacatgtattcaaattactgggaaatcttgttaaaatgtagattatttttcattaggtatggacctaagattctgcatttctagcaagctctcaggtgatgctgatgcttctaattctcatatcacactgtaagaaataaacacactctaaccactagaaaaaaaagggttatatatgagatggatccatcatttgttttaaataattgtactatactgaccaaggctatagatgttgatctaatcatatggtttattgtcttccacaacaacaacaacaaaaaacccaaccagatgctaggaaaaaaacacggacttttatagacagagtaatggggaatacttaaatctaggaagttaaattgaaaaagaaaggctataatatgattcatttgaattaagctaagctatttggagaaaaatcattgtaatatcatcaatcagatcagatattttaaccaatgattctagtccctccaagagtactctctgcttctggcccaaaatgaccccaaatggcaatccagacacagcatttgtgatgttgaatcagggtcaacaaggagggattttgttaattcctttcctcataatattatcatttgtatatagatacatacaaccatattctccacaaaatgggttagtataccatctgttatcttagaaaatctagacgcttttctattagctattacaactgagaataatttctggactaggcctgctagttaaaaaaaaaagaagaagaaaaatttaaataaaaaactaaaggcaatataagaaatctcaagcatttgcagaataaaattgcattttaccttaaaataacttttgcaccaatgaatgattctgagactgctgctgactattttccaaattaacagaatactctcaccttcatttgtattgagagtttcccatacttgcataaataacaaacggcatgccaatgtattctacatctgtctgttccacaattgagatgttcctgcagttaatattaacaaaaggcgcctctcccttcggtctgtaattctgtcactgttcttcctatctactttccagttaaaattctgattatcttcctgagtatcccttgaggcctcttgtttcttttttagtagttgctaggcaagttctatgagaatgctttaaaacatcagaacaatccaatgataggtatcctcttatagaatgcttcatggaaatttaaacctggcctccacacattacagcttccacattaatggtattctctatatattcacagagccaagtgcttggtttgtttgtttgtttgtttgtttgtttgtttaatttcccaaagtaactatgttcaaggccctgagacccagtctacaagcttatgggatctcattgtcttatgtcagctttcttatgttgatggtgacttaactattagttttgcctctgaagttatgattttgctataaattgcctttagttttttgagttttcatgaatgttgattataaaaacaaattaagcttcaccaagaaatcaagttgaccagttctgtgttcaattaaattttcgctcccaaatgatctcaattttccagaccacaggtgaatgcttcctaagatttcattcattatcagtcaaccagcaagtactgaatatgttccacatgtttagcattaaagaaagcattctgaaaaatacagccaagatcatcagaattgtgcaaaaatggcttagtcctgttgtctagggattaaggaatgtctctctgaagtaggttataggaatagttactttacaacagatttttcccaaggaaaagaaactctatttccttcacattaaaagtacacaagtgttgtcttaattgtacacaaagttgagaaaagcatgtgttgcaagtgaataatttccctttttgttctttaatctgactaggaattgcctcattaatctgcccatttttacttcaccacaacacttaccaggatgctgctgcctattaagattgttctgatgttaaaaaacaaacaacaacaacaaaagaaaaacactgactcagacatggcctttctaaagtgggacagctgtctaccttctctccttcccttttccctccttatttccttccttctttctccctttcactttcctcctttcattccctgaaaacattctatactggtcaaatggacaacgaggaaaactatatgtagcagtttctttaatgtatctttgtatatgccaaagtacttccaccttactatctttcctccaaatgctttatttttaattttccccaattgacaaatttattttgcaagtatataggtttgaactatgtgtttacacacaagtgacacagagaattcttcagcagtcattattcatggagatgttgccagtttacctgaatgaggaagacaccagcattgacatacatgtttaagcaagatacggtgatttttcccttgaatatataaaatagcagagtgactaactgatagtggtgttacctttaagcagattcctctattctgttcatgaagaatgtatatcttcctaaggaaagttgtgtttgaataaatgcctttcttctgtgtattgaataacttagaaagtgcttctttcaatttagcatacacaatgttctgaaaatagccaactcaataaatatttgtttaatgaattatggtatccttgcactaggcatcagtccagtttaatttgagctcaaataatacaaacatatgtcattgtccttctctttatgaaaaatagagcaacatgctaatcagcatttaattttttgcctactatgcagaagaatatgaaatgaaggtattaagatccagttatgctatttagtgtatgttatttcgacaacgattacaaaatctttgtcatctcaactattgatacatttgaaattgtccagtgagtagaaggtttagactatgcaaaggaaaaacctttatgctgttaatcatctcaaactttctgccattctaagtcgcatgtttagagtaaaagtcaagtagtattttattcttggcaatgggaaaactatgaccgttttcaaaatgaattcctatgtgtcaggtgaccactaaagcaataatttagtccccagtgttagttttgttcatatactgtagcatagaaaatctgcattctgtaccttctattccttgaagatggtgaacacgaaaattaaaagatgtaactatttaaaggatgtaactttttcatttaaaagatgtaaacattgcctttccctcaaacgtgtcctattatgaaaatctaacttacagatattcagatgtttaaaataactgtgaccactttgtctccaaaaggattttgcattttgtaaaagaaagcactacaaatttcttttgagaaacacgcttcagtacaattcattacacatgaatttgacaacttttcatttagacccaattttctatagagattatcatgtggcagatattcataaatgctttatttcaggtggaattttaccttgagatacagctccacataaaaacattgttaaataaccaggtattaaatatagtccgattccaacttccattaagtcatttaagaaaacaattcccattgatgcttgtctgagtgctcaatattctttttaaatcaggggagtgaaatatgaaagtaggcaacatactctggaatttttgttgagcctaagtaacttcatttaaagataaaactgaaataataaacatataatttccagttttaaattttaagagccaagaacacattaggtgcacttctcattaaacaaatgagataaggatctatttcagtagcaattaggagaaagaagaaatatgagtgtcgcaaccattctattcttccctcaaatactatgaaacttataacatcacaattgattatatatacacacatatgtatatagatatacgatatattgtgtcatatgtatttacagatgcaatacataactatttgattgcagctatttttatctcaaggagatttcaagctcttggacactaacatttttatctcatggagagacattacaatgctctatgaatggggagtattagctcattaatatttagaaaaataacagattgtcataaagtagatactatcctgttgaccaaatatttgtatctctcctttcaagcatggaggaaaaaaaaattagggggaacattttgcaaaataaccgtttgatttttaaaaaaaataataattttcaaactgatgcttttaatttaataacaaaataatgttattaaaacttaaatacttaacatgtaatttagaataattatctaatggcccagcttacatttacttttacttgaatggtttttaaaagttttgctttttctataatttcatggagctaaaatattttatggatattttgatgccatgcttatatttggctaggtaaaactcacggttttaatgctgacaagaaattagcaggtcctaacaacttttattcacaaatgaatgcattaataatcaaaagaaataaagaaaacattatactattttaaaggaaacgcttaaaattttaagaatgtgattttctagttaaaattgaccctagtgttcattattttttaggctttttacataaacttacaagattttagttttatgtatttatattaaactttttacatgagaccagtaaatagcttactactactttttcatgttatgttgccttctctcaccatagatttttgtcttccaattccttaaagttgcaccttagtagtaaaaagtgtgtacagcattatcagcttttcatattattttactaattgcaataaaaaataaagctcacctatttttaaaatgttatttaattaacctagttattttgaacactttgtatccaatattttttgaaaagtaagacgactttccaaattcatttatctctaaagtacttagtatcttacatggaagataatgacatgtctgtatgatcttcagctgttataaaatgtcaggtgctggaaattcttaacagagctgcccataagtcaattaaatcatggcgccacatcagcttttcccccaatcccaaaagagttaaaaaaaaaaaaaactctaataacatctacaattaatagcattcctgtagcctgtaggtctggcctgttactttagtcttccgctgacaataacggagggccttattatttttccccctgagcatttattaggcatgatgaggaaaaggttacatctctggaaaagagcacaatcttcaactctcttcaggttagatgctttaatgggcattacattagaaaggcattctacactacctattatattacttctcccaattagaaattccattttaatgtgattgccaaaaatttagtgcctgcccatttgataaaattgagagtggcatttgctaaacatcaattaacagaaaatgtgaggcaaatgttgtatgggtagattggctgccagtggggagaaatgaatgggtagtaatggaaattaatggataagggaaatctactttaatttccttgaaaaatgtgctataacagctatctgcattaataaatcaaacttattgtttaaaaagtgaacaacaagatattttgatttaacaagacagcaatccttccaaaatcatagaactcactatcaggtatcattctcttggatatattcaaactgcaggctttgctttggcaaataatctttcactatccttagctctaaataagatcaaactgtcaataaccaggaaataagttgttaaaatgtcattctccaatttatcattttaaataataaaagttgttttaagtaaacacgtttctttccatgtctattttttaaatttctcctccataatatcttccattttaatcccacaataggctgtggccttttgttaatgctacttcagatacataaatttctgataactgaatggagacataaaaagacataaaacacttacatttgaacttaaaagacaatatagatttatatgaattcttttatcattttataactacatttatctaagactcatttaaagtgatttcaatctgtatttgtttcctctaacatttttctttataacaaatttagttaattccatcatctcatctgaattctatgatcacacaaagccacctaaattaaatccatacctgaacagtctgggtaaattccccatataatatttcttatttaaaactttagtattaactaagtcttttaaggaagtatgggcactgattatgttctggaaaactggaagaatatcattaatcattaagagcccaaaatatggaacagggcatgtacatttatagagatgtaatgatttttagcacagaaattatttaccttaaactaagtactaaatgggaagagagggcaaaaggctgtaaatggagaattcttcttccagttttgcaattaacagtgttaatgtcgaataagtaagtagcttttacctctgtgcattttgcacttttacctcctctgggccagaggaggcaacctgcaccatttctaaggtcttttctagaagtttgatgagtctgtgttatttctgttagtttttctgcttatttcacagtaggctaaaattatgaatgaaaatatgtaaaaataaacttagcatggcaattttggcatagcatagagctcatggataatgattacacttctcaataaaacagttaagaatctctctcggggctaactttttattttaggatatgggataatgctaacgaaaggactagattagaaatttatgattaaaataaaataagactaatactgttaataataaatacttctgataggtagactggtgattctggaaagaatgatggcaaaacttttcagaaagtttggtcctacccattctctttgactgtctcctgcacaaaggcttctgtgcctcttcttttcattttggtacatgatccaatcaagagaatatgatccacatctcaaagttttatataatgcttgcaacaattctctactaatatgcctattgatgatactgtatatttgtattcatcttttccatcttctcagatctcctacaccctgtgtactaacttaatatcagccattaataactgagtaaatggaagtgaccaaaatgaactctattttctgaccaccaattccaccagtccacctctatctgtacccatgctctctccatataatgttcttctcccatcagatgtcaaggttaactcttctggtggtaatctggatcctggatccacttcctgtttctgactcaataattttgtttctgaaactaaatcactcttacaaatcacaaattatctcgttactagatcattcacatcagcattcagaaatgctgtattatattttcacatttaataaaagaaaaataaatatcaaattcccctagtgttgccccgtttatttgctcctcttcaaacaaaattttctcaatttcctctttcccattttcctctcaacacataatagttgagttttgtccctattatgtcactaatccttctgtttaaagacaccagtaatctccattttgtcaattccactggtcacttcttcgttccatgtcgactcatatcactcttctgcttagagcttgccgataaatttctatctggtttagaaaaatgtctgaacaccttagtctggcctatttgtctacttctactgaaacttcatcttcttttccaccctcaccttctgcgccaggtaagtcccagtaacactccaagcctcttcacaatttagtgcccttgtacttagcaaattggccagtgaagtgttctccctgaactccacacagctatgcccttcctgcctttcacttctcttgtcctcagagataccttgccggatgacgcaactgaaagtcagacatgctctttatactgtttttattttctgcggagcactaatcattaattaatatattaattcactgattttttcctcaataatatgagacttataagaaatcttacttttcttttgcttcttcatttccagtctagaacactgcctggcacaaagaaggcactcaaaaaatattgcttaattttctcatctttgtatctcaaatgtcattacacatagtaaatgattaataaatgctggttggtattaaatgattataaactctcttgatgaatttacctacactattattttatgatggtaatttatcagtggcttttaataggtattaatatctttcaggaaagatttgtactggaaatagaaagtataaatcaggaagtaggaactatttgatctctcaaaactatttactatttaagcagttgtttcataaatgttaggaaatgtttgggaaataaaaagagttttaaaatcagtacatatatctaaatttaggacaattgaggcaactctttaatctattaattctatgactatatctagatcaaagctttggttttagggcaaagtactgtagaggccaaggagaacctcagaaggtttgctgaaaaaaatcaaattgcaaagttgattaattggagaaaagacaaacacatttatttaatatgtatatatgggagccttcggaatgaagacccaaagataaagaggaaattgtccacttttatgcttatgttcaacaaagtatgtacagcagtgcagaaaaaagggtaagaactaatgctgatatactgagtggggaaacccaggaaggtctatctgtctagactcttcctggcctctttaagcctgcattccttccttctgggtatagaacatgaccccttctggaatgggagttttagtacctacagtcaaacaaggtatatcagataatttctttatgggtcagtttttacacagaaaggtggagagaaaaagtaatatttgtaggtttttatggctggctttggagaaaaagggttctagtttctgtgacctgccttggggaagagggattataggttctatggctagccttaaggagaatggaactgagagaaaagagggcaggaggtcagagaaaaactttagcttctgaggctgctgctgaggccttcatttggtgatattgttttctgaaccccaacagtacccaaaagcccacaaccgtatattttgtattatcaggacattcttcactcaaatcaaagcatctggcatcccacatttcacctagattactttggagttccaaggtacagcaaaacacattaaaaccaattaataaagaagaataaatttatattaaggtgagcagtaagatggaaacaccagaataaccaaacactcaaaggaccttacaaaaaattattcttgattccaactttgaatgttaatcacattttagagaaaaaataattaagatcagttgaaggaaagcaaataatgaaatctttaaagttcactactcttacagattttgaaaaagttaaacagagggtcgttatgtttaaaatacgttgtgggactctattattgaataacagccttttaatctttgcggtttttgctactagatacaacagtgctcttttaatgatctaaatctttccattagtctaaaaagaacaacttgaccacattatccattatctttgtttccagaaatttactcttgaaattctttaaactttgcttttatatctcttatattttcttctaacacaagcaaaaatatttgaaaatcacaatattttttaggacttttttctttatcctgcaagaaaaggtgactttaaaattgttgccctaatcaagatttgtgttgacttaaaagggtctatctacaaacttcaattttatattggcctaacatgtttgaaaatataattttcttttgtttgaagaaagttcctcaaaataggaccaattgtttcatatttcaatattcacctcccaaattagtgcatagtagacagctaataaacatctgcagaattagtaacataaacataatgcttgttagtgtcaagtggctgaaattcgatgattccaatttctgtgtttaaaacaataacaggccgggcgtggtggctcacacctgtaatcccagcactttgggaggccacagtgggcggatcacaaggtcaggagtttgagaccagcctggccaacatggtgaaaccccgtctctactaaaaatacaaaaattagcctggtgtgctggcaggcacttgtaatcccagctactcaggaggctgaggcaggagaatcacttgaacccaggaggaggaggttgcggtgagccgagattgtgtcattgcactccagcctgggtgacaagagcaagactcgatctcaaaaaaattaataaaataaaaaataaataaaataaattttaaaaataaatatttcaggaaatacttaagttttccttgaaaaacactccattcatcctctttatatttttacacaccttcaaattctttttatgacatttacacctttctgatcccacttgtaaacactctgtaaacattacacagtcagtgtttaaaaatttttttcattaaaaattctttctcaacataatacaaacacagatttacgcatttacaggacaattattcctctctcatttacctttaaatagcagtgtccctgcccattgcttactctaccagtttgatataatggatcctttggtggcaactacatgcattttattttcccaaagagaatcttaatatacatcacttccttcacaaagaatttcagtaagagggaagaagagatatcctggagactcaaaatatcattattaattgcaaccagctaaatctctgataatttattttattcacaaaaaaaaaaaattatttgctgtgaaacaaagaattcttattaggaattattaataaggtattatgaacaacctaaacttgaaggttaaatgtgtgtatatttttatatgcccatttggaaaggttcatacttaaaaaaaactctcaatactcatgttgctaaataataaagaggccatgaaattaaataaatacatgttaatattaatgctttatgttggcctgaaacttgctttattgtggctttgatctacttttacccagggctgccaccaatctatatgccactttgtgggaagtggaatatgagtcacctccacatagagacacagtgacttagagcagcgatcccaaacctttttggcaccaggaactggttttgtggaggaaaatccatagactggggaggggggtggtttcaggatgattcaaacacatttattttgcactttatttctattattattacattgtaatatcgaattaaacaactatacaactcaccataatatagaatcagtgggagacttagcttgttttcctgcaactagatggtctcatctaggggtgatgggagacagtgacagatcatcaggtatcagattctcataagaagctcacattgtagatccctcacatgcacaggtcatcacagggtttgcgctcttatgacaatctaatgctgccactgatctgacaggaggtggagctcaggcagtaatgtgagcaatggggagcggctgtaaatacctggttctctgggggttgggaacccctgacttacaggcaagacttgataaactgatcactagcagaaaatcaactgccatctgccttcttagctaaatgcccctgtgcaaggcacaaagtttgtaaattaactcagtggccctgtcctttggatctaggactaagaattcattccacatggcaatctgtactgggtatctttgtcatggtgtcttccgtgtctgttttcctttatcaattaaaaaaataactatgatctcctattcagagatcctttgcacagagttagctatagaatgtattataccaggagcaatgacttaatccaaatgcattgcaactagaggctgacttgaaactttaaagtggccagggatgcaatcatctgtcccaaatgcagaaccattagctaaacaaatcagaccgactctctcaaagacactggcaaacactggtcacagaaaatgctcagagaggtgcagagacatacatgaactattcctgcagaattcttactagggaagccaattgttcaagggctaatgattttctaattacggtatctatatatggttctcatttgtcttaaagatatctcagattaatcctctatttctgcaacaggaaaggaatgcctactaagtacacagtccttcttgctcttaaaaagagttatctgattcgggagtcattctttaagtccaacatttcatctttcttcattaattaattatatgtaacaaaagagttacatatagagtatatgtatatagagtatagaattgacactcaagcgacaaataaaaacaatggtgctatctttggtgatttataggctttaaaaattatcagacatccttggggcaatataagaaaattatatgtattcattcctagtaggtagaaaatttgtgttaaaccaaatctgtatcacagaagttaatttttataattgtagcttcatattttttatttatctcagtcattattagtggatttaaagaataaacatcatggttatagatttctggcttttgtagtgactgattcaattaacattattaattgagccctgcatattaaaaactatggcatgtaatgtgagagtacagaaagaataaaatatgcagtccttgcactcatgagataatacatctgatgtaaaaaaaaatactaaaaatcatgaaattatttgcacattacagagcagcctgagaagtgcgttctactctaagtgatccaagtttcccaaacagagatcaatgagggtgactcgttcaaagctccctaactaaaattaactcaattattcaaactgccattttttctcatgatgtgaatacagttttactatttcaataaaagttatagtgattattgataaagacttttggtacaaaatgccagaccagggatcagaaatgagcttctattccatgttattctcattttggccacaattaacttacatctataggacaaacacccaacagatctttaggcctgaaaggcagaaagaaaccagtacctggggattgtgccttttcaagcttacacagcaggatatgaagaaaagaggtcatgatttgtgctaaagtaactccaaagaataacatatttatcagaatacaaaacacagatatacttgaggaaaggctgacctaaaattgctgaccatcttgtctggtagtggagctttttcttcactctaaacagtcagatttttagtctcatcatagatacccaagatttcctgttctgaacaagtcagctctttatatttgtggcattatcttactaaggccctcaatgtaattcctgggtagcttttatccctatctgttttttttcccatctaaaatctaatcttcataccaatatgaaataaatctagcgtaattgcaatttgagaatgtaaatttcaagctcttaaaaactacagtgcctaataatttgcattgtaactaaatacatgtgctcacatacccacacactcccacgactcataattaaatttcatttaaaatttgttcccttactatataaaatgtacttgtattttccattcccttccattgtatttcatttcatttcattccactccataaatgccaaccatgagccactgaattaattttatgatcctctaaaatagtggttcccaaaatgtggttccagggccccctggaacacccaagactcttccagggaatccacaaggttcttttcataaaactactaagatgtcatttgtctcattcactctcaacatcttgcaaatgtatactagtgttttccagaagctacatgatttgatgatgtcatcactctgagagataatggaaagtattcttgtatattcttttctttaaataattttctcaactttaatttctaatacagtaaatatttataaacataaccatataaacaaaaactctttgggtctctcagtaatatttaagaacttaaagagatcaagagtccaaaaagtttgagaactgctaatctaaagcaagcttccatttgaaaaacagtgacttaaatggaatcattgcatacatacacacatacaagtctctttccatacttttctattctctgcaaggcaaaatgcaaactggcaccaaatgtcttacaacaaattagctgtgattctactatttcctactattctctgctctttactaggaaactccatctaagtcccctaaatatataatgttcacctctgcctttgagtctcattttatagtatactcttgaaatatatttaacactattttctgctaacataagtcctatctaactatgtggacatctgcaatttctttgcttgccctgcgtcctttcttttttggaactgacccttccggattccttgaattcacacgggaatgcgaattatgtggccctaacctttcataggcctgaggattcataccagtcaatcaaactaccccatacctttggtactagtgtgcagattacatgggaagggctaacccaagagcagtcgagggagatatatcaatgttaggggaagaagaaattgtgttttgttctctaagattgctcactgttaggaaggcaaggagaaggccagccttattaagcaatggcttagggacactgtggcacaattctttttacatatatattttttatattttgtcccagtgtccccttgactagacatctgcatatgtctgtcctttggcattgctcccaataatgcctgtgtgccctgtagactccctattttctgatgaggacttgtactgttttcaaatgcctctctattccctttaagacactctattaatttactttgcaatcaattattttatgttattctttttttttttttttcttagaaactcactaggtgcacaaaggaacaattctgtctctgcaactaagtggggattctttcttgtatttcctaaaactctaaaagaactctaatttttaatatatttttggaacctatttgcttgaattttttcccttgaaaatgattgacaaattgaatgctgtgttatcttaacagtttccttacatcttctttaattgctgtgtcatgcacagtttttcttcacttatgttttgaagagaatatgttatccttcccccaccctaaatgttatccctttttgatttgaaaaggcacacaacttaaacacatgaaatgaagataatttccatgctatttaatgtaaatttggaatcttctaaagtaaaaatattaggggaccaagtagttaatgtctatattaataaaggaaaagtgaatacaccacctctgtaatgttagaagacagaagtactcgggaactgtaaccatgtgtacatttcagtaagatgaaaattgagcataccacaaacagaagacagaagtactcgggaactgtaaccctgtgtacatttcagtaagatcaaaattgagcataccaaaaaaatcatcgattaaataacattccaaatgtcctcagcaagtagactttgttatgcatgcttgggattcatattaagatatagccaaaagaattcatgattccgttacctccttcagaaattgaaaacaatgatcatcaaaggtcaaagatgccttcttatgctaaattttattatcaacaggtcatttgaaattttgaaggcatagcttaatgttcttagaattagcacttcttaattaaccaaacagcataacagaattatagagagggagaaaaaccctcagttaaaatgacataaatagtaatttgtgaagttcaatacctcttggtctgctaattattatatgatgcttcattaccatttaaaataccacatataaaaagaaaaggaaagagaaagaaaatttagagcacattcattatataattttgatttattttacaaatgcaattataatcatatttgggggtcagagataataattttgctcaatatttcataaggaaagaaaatctaatttttcatatgtagtcacattttaatatgagcatattttatatgtgatacataatattatatacataattttacatatgactggcagaatttctgcattatatatactttttatgaatcacttaagttggtttttaaaaacacaactacatataccaagaccacatatgcctcagtaagaagaagtatgaaattatttaaactctcattcaggaaacactacaagtttaaatgaagtaacagaaagttactgcagaataatctctctattcaacaaaaatattacacagtttgaaagtaatgtaagtgggtccaccacattaaacacactcctaccctctactgacctattttctagactctaagtcagagtatggaatttatctaagttacttcaatcctcttatctttctaaaaaccaaaggcagtatgcatttataatgcttccttaactcacatcacttcataaatctgttttcttaaaaaaagtcatatcataaatgagcatgcaaagcacatactgcctcattcaaaaaatgtttaatcattagaaatagggcattgcatctattatcatttttaaagtgttaatgtgatagcaatctgaaacaacaaataaaacatctaagaaaggaaagctatacaccttttcttcttaggattattctcagtattgcagcatgttgatggctttactaaacttaccaggctattttctcacctaaaagttggacatcagtgggcaaaatattgccctactgatactacagtgatctatacattttaaatattctttaactgttccaaaatatatatattcattttaaacaaaataggaaaaagaaacagatatgaaaaagacattacctgtaagtccactgcccagaggaaaatgccattaaaacttattcttatacatattcttccagagaccatactctgaatatggatattatacatatatatatatatatatatatatatatatatataaaatatatatattatagatagatttgtttttaaatggaattataattttccatagtaagctttattcaattcttaataacaacaaatatattttcaggtcaacaatatgtatttgtataatctgcatcaatgttgttaatggctgcacaatatattttcaattaccataccataattcagttaaaaatctcttaccagatatctaatccctttccttccaacttctgatactgtaaacaaaatgttggaataaatatccgattactataatgtgtgcatctttcttagtgttttgcatacaatgcttggctaatgcagggtatcaatgaaagtttgttgcattaatgattggatggatgaataaagtaacaaatgtgggtttttaaaatatcatttaaaggagcacgtctatttgatattcagattttgagtcaaatcacttcacacttctttgtgcttttccccatgaattatgataacgagaaaacatgcataatgattaaatgactttcatccccggatgcttccttaatatgtgtgaacttgtaggactataagtaatgctctgtgtgagataacatactcaacaaatgttctaatagagaagaaaaaacgtaattgttgtttttaaatgtagtataaacttcataggatgctgtaattttccatttatttttcttgcataaaatacatagaattacataggaaaaataatttcagcataactcatatgtcccaactctcctctaggattttctaaatttgatttaacaagcagctaatgagcatttatgtctgacattaagctaatcacaatagagaatatttaaaaccttgatatagctaaaacacataacttacatggtcatcgtatgtaatttaattacagaaagtaagcgatttcctctgtgatatgagaaaagactaagattctccagctaagataaacagatgcaatatttacatcagctggaaggaagagagaacttcctcacccatggacaatgtgacagcaattccatccctattctcagcacagtatcctccttgtttaacaaataccttggaaacttgccagttttcaggtatttccatcttgggatactagccagttattcaggacatgaaaccaggacaagaagccagatgtgcaacatataagagtaataattattttccttttgattcccttatcatgacaatggaggatataacctatattttcaattataaattatttcatagactgacagaatttataaaagttcacctgaatttttaaaaatgatatgcctactatgcacaaaatcacataccagaccatgcagggcttgctctgtgtctcagttaaatctggcaacgaaccttggtcaacctgtaaaaccccatggattctcactgaacacactgtactttctcagaagaaaaggattctacgtatgccatcagaggctactcagtaagcaaccaacaccattcaatatattcatttatatttccctaagtttcttcactgtcaacctttaatatctattttcctgaaagagagctgaagcacacataatggtttcaaacatctgtttgttctaattttaacaaaagttgtcccatgattagaagccaactatttggagtaatatcacgtttgttctctataaataatataattaaattgctacaactaacaggaaaaataggaggtagccaacaatataaataaaccacaaaccgtgtttaacctagatttgcatatcgttctcttagttttgctatggttggaatggttttactagagttaaatttctttaaatcaggagatgtctgattaaaattttgaaatgttgctttctaaattctgctttttcttagctcactgcaacctccacctcctgggttcaagcaattctctgcctcaaactcttgagttgctgagactacaggtgcaccccactacatgtgcctgaagaaagtaatggcaaaaaccgcaattacttttgaggtaattaatatattaatagtttctacttttgttgtatatattaataatgagctgttcattcaaaagtttttacctaaaaaacagtttgctaaaagaaaagccattgcattacaatattttgacagcttttggcttagaaattagaaaataaaataaccaccaactaatataatctttagaacatttttctttgcttttcatcttttgaataagtgacaaatattaattaggaatagtagtgatagtttatgaaggtaataaccactactgtaacatgttaataatttaattaagctagtttctattatgaagcaaatttagaaaaggggagtaaataaatgtacacaataatgcattttatctcttcaatcaaaaaatccatagatgctaatgtaatttgttaaaatgccacaacgctattgaaaaccaaagttgccatatgataaagtgatatttattaaacctatcattccagagagttttcctgccttttgttataaatgtatttaactgaggccatattttcttcacatttgttccctaggtttgcttccagaaagattatctatggtagaataatctttataataaatctcaatataccctgctgtgccctaacactttaacactttagggcaacaaattgccctaaacacttgttagttcttctaggcacagagagctactatggcattaaaatagatgtatgcagcaccacattacattttaaaaagtaattacagatatctcttctgtgatcacctataatgtaaggtccaagcccttctgttgaggcaggaactatcagaaagataaaaattgattctgaaataaaatgcttatttcccaatattataagaaacataactgtctcggcgtagtggctcacatccgtaatcccagcacttagggaggctgaggtgggtggatcacttgaggccaagagtttgagaccagcctggccaacatggtgaaaccccttctctacaaaaaataacaaaaattagccaggtgtggtgacaggcacctgtaatcctggctactcaggaggctgaggcaggagagttacttgaacgcaggaggcagaggttgcagtcagccaagatcgcaccactgcagtccagcctgggtgacagatagaaactctatctcaaaaaaaaaaaaaaaaaaaaaaaaaagaatgaaaagaaacatagaaacatacccaacttattcattgtggaagattgtctcttcagccatttgtattacgtattaattttttttatattatggtttctacttttgtcatacatctattaatgatgagctgtttattcaaaagtttttaaccaaaagaacagtctgctaaaagaaaatcctttccattacgatatctttgacagcttttggctcagaaattagaaaatgaaatgataaccaccaacaaagggattctgcagctgagtatggatttcctcccagtgacaggcatttttgtaagcacagagcctaataattgtttgaataaacaatgtgtgtgtgtgtgtgtgtgtgtatgtgtgtgtgtgtgtgtgtggtgtgtaatctacacagaaaattgaaaaaaaattttcacaatggttaatggtattaataggaataaatccagatatcttaaaaagagagacagagagagagatagagaaagaggagctctgaaaataattcattaagactctttttatcctgaaatccaaaagaacatctgagcttccatcattcatcttaatagtttatagagtcaactctaatttcaccatggatgaaagaataaacttgaaataacaaataggcaaaaagctatggagaaaaagcttacagatttatcttaaaatttagcctgacaatttccaccttgacagttcggtcatgtttcctaaaaatgattagctaaaaacattactttatagtgattcaattgtaagactttctgaagaacaaatcaagactatttagtaccagatataaattattttaggcaactcttttactcttagttttattaatgaaaggactctcttaaagaatcaagtcaggcattgacactattttgttttttaacttcatcagtagttaatttggacttcacagcagaatgtacactgaatacatgctctgaacgtggcctaagggacaacactaacctgacatcaaaaaggcctgttcatattactaacattaacacagcatattacatatagaaggtgattcgtagatagggagtaatgaacaatgattaaagtttacatgaacttcatctttcagatacaactagaagcatttttaacccaaagttatcaataaggcaccatttggcatagcacctaagtttttccttttatacttcaccttaaaaagcttgctgttgactacaaagatgttgaaaatataaaaatataaaaataataagaaatgtctcaatagtttgcatgtctagttgatcattttaatgtgcacctaatactaattttaaccatacacttaataaaatgatccaaactcataaatgtattattccctttccattccaataactctgtttttaaatagtttgcaaacacctaactgacaaattcctgaagctgcctgagagtcatgaaccacttgtaccccttcccaatttattcacttatttattcatttattcattatttctacttaaaaataaaaaatgtgttggtcaaggagttttatatatatatagttctattaattcaccaaattactaaagccatctttaccaatcaaaagttactctaaatttgttacattagaagttcacatttccaaatcacagaagatttactaattattagtctagatatagtataaatattttggcttccactttttgccatttatttaaatctaattaaatgctcttaattgtatatctctaagtttacctctcaaatcagagaggatggaaagatactctttgcatttaggggtatgaggaatccttatcactttctcctcgatagaaaaatcaatttatttccttttctaaggccactgcgagatgcttttccagctccaggctcaaagagagagtgtttcatccctatttcaatggacaccagaatcaatattttctttaggtacttgctaaaaagtagttacattaagtccccacccagtggtactggccttagtcttttcttactataaaagaacatggctattcctgtttcttcctatactagggatctcttcaaacacaggacagttaacaaattgtcagtaactattggtaaacacatccttccagggaaaggcttcacatttatttgcctacatacacatattagggaacttttcttatttagatataatagtgaaaatgtttgtaaaaggcaaacgtaaaaaaagaaaaaacataaaataaaaatctgttcattttaatgaaatgcattatgtcccctaatctgccaggatggatcttgtctatgtaaacaaatttcatagtgactttcaccttcttcaagatacttactaggaagtatcttaaaggcaatgaatataactcttctacataaaattctgtacatagtagagtggatagacattagctactaacaaatatttgctggcaaaaagctagagcaaacattcaaagcatttttttatttttattttttaattaatctattttttttgagacagagtcttactctattgcccaggctggaaggcagtagcatgatctcgactcactgcaacctccacctcctgggttcaagcaatcctccctcctcagcctcccaagtagctatgactacaggtgctcactgccacgccaggctaattttttttttttttttttttttttttttttagtagagatggggtttcaccatgttggctaggctggtctcaaactcctgacctcaggtgatccacccacgtcggcctcccaaagtgttgggattacaggcatgagccaccagagtgttctctgtattaggctgcccagtcctgtttttgtatgactctctatctaagaattagaaaaaggtttctctttttaataaataaaacaaaaagaagaatatataacgaagagtgtatgcggccagcaaagcctaaaatatttatgtggtccattaccgaaaaagtttgccaatctccattttacagtacagaccctttgcctaatatatgtgcctactatatacagggtattagatttccagagaagggaactaaaaaaagaaataattttgacttttcttcctgagtcctataggctgaaggctatatctgggatagaaagggattaatatttccaaaatacttaaaatgtgttttcctcttcatcaaatctgaatcaaacagtctgtattaaaagtgaaaagtatattgccctgtatctttaatatggataagggcaccagagttgtgcccttttttagccaaaatgtagttatgaagaaagaggcttctttaatagatgttaacaaatcaagtcagtgacaaagggaatgtgaatagagaaaccgcttaaagagtaattagtttgtatttaccccaaattttatttagatctaaaaaaaattatctctgcaaatactttatagatctagaactcttttagttacataacactgtcagttaaatttcaccaaatagttactgggagattggaccaaaattgcagattcaacatttgttagttttcctttctgctctaattccatgaaaagacagaatatatactttttaagatccagaagagtgctagaaaacaaatgacagattttgagggctatcttaaaaatataaaacatacaggaaaaaaaatgtgtgaagtaaatctgtagattaccacagactaaaattcacatggacaaaaatgctgtaggtttggtagtataatagtaaatatcaccaacatccatgataggtattctcaaacaaggttaagcaaaaaactaatgattactatacatttaaaaaggatcaccactttaaaagagctatgccaatttccactaaaagaaaaattttcactgagaacttactgagaaatgggaataaaaattacctatattagaagaaaaaccataacggaatcagacttatcttcaacgtcggttaatagaagagtatggagagatggcttcaagcagaaaattctgaatctagaatgttttactcaagcaatccaacatcaagtagaatgaaaaatacaatgttttaagatctacaagaactcagaaatattaatatcaatgaaaccactctgaaagaattaactgaaatgtactacaataataaggaaaaaaggatccaaggaagaagataatggagaatgagaaatagtcaaataaaaagataaacataaacaaatcaaaaatgttaattgaaaatacaggagaattgagatatgggaggctgtgctaagcaagaaatacagttcaaaggcatgaaggaaaagactgatacatttacccatataaaaaaatgaaatgaaaacaaaacttcaaaatgaggaaagataaaaatgtttaaaaagactatataatggctgataaacatatttgtcccatatatgacttacaaaatgtcaatagctagattatataaaaagattctacaactctcaaagaaaaaatgagcagggatataaacagaaaaacactacagagaaattacagagaaaatgaacaaaagtgaccaataaatatatttaatgacttcccatctccccagtaactctgtattaatagagttaataaagattaatatagattaatataattaaagttaacttaacatacagttaactttcatttccataatggaaattaaaacagcaacataattctctctccatgagactggggcaagcaaaacatagtaatattaagtcgtggtgaggagaattaaaacagaagctttatatactggtaatgcaaatataaattaggagagactcttgtaacgtaaattggcagtagtttgctcttgggaatttcatttttataaataaaaaatattcgtagatgaataaatgtatccatgtgtgagttaaatatggacaaacatatacagaatatccactgcaacattattttttatagtaaaaaacattgaaacaacctaaatatttaccaacaaggaatcagtaaatacatcatcttctatgccagaaaatactgcgcagatttttttttgaaaacactgaatatttcatgtgttgttacattgtgaatactaaacattaacatagtgagaaaaatatctaataaattttaaaaagtttttcatttatattttccatttctccttccactcatatatcgattttgcccttatgcaaactacatatctgtaaaaatatctaggtcttttttaaactttttattagcatataagcttttttataaatataattgccaaatattcatattttttttccaaaaaatcgagatagtgctatcaaatatccaaaacataggaatggaaaaaagcaactcacagaaaaaatgcttattagataattctatttgtttaaaataaacacaattgacatagatatatatgtatatatgcgtaaatgtacagaaagtaaaattgaaaaacagcaccctgaaatcttaatagtgctttactttgtagaggataatgagaaagcagtaggaatggaggactcttttccatttcacaatacatttctatatgctattcatcttttacaataaaaatgcacttatgtgacttctacaactaaaggcattcagttatacaaattaaacaagaggagaaaacttttaaaaaacaaaaactcatttttttcactgtcagtcttaacattcattttatttgtcataatttgaggttttaatagttcttcatatgttgactacttattagtaaataaacaacttactatccaattttaaagattttctatttaagttagtacaataattcaatataaaataaaaaagtattaacaataaaataaagattgcaccccacaaatctggatgatgttgaagccatggtcctcattttcttcttctagatattcactctgctattacatagagtcaggccagattaacatatgatttgggaaatgtatgctctttttcccacattctggaattggaatttgtggtgacatattttgaacaattaatgctcctagaagatcctgttacaaacttagaacaaaataataaatgggttattacatctgtgtgtgtctaaagtttatttaggaaatcagaatcttaccaagaaaaaggcctcaaatcagcgcttcatgaccactaaagtataacaacctcccactctacattcactttgtatgaatacacttaaggcagcttctaataaaggatgcatatgttctgtgttattttggaacatatactgtctgttaggttgaaagagcttgtccatgaatcaataataacttggaatctggacatctctttggagattaatggatagctaagtagagctattcacaccagagaccactaacccccattggtccctgtccagtttgtagcagctgcagaaaaggaacactacgaaacacagaattacttttttggacgttattccaatgatcctcagcaagtgtcttttgcaaaaaatcaaaatggattaattttttaggccaggttcactatattctattcaattcagaaaatccataagtctaaatccggatagctgctattgaaatgttcatacactactcaggtctattcagggaactgggatagttctgatgcaacagtgctttaataagatacagattcttccataagggtcagtgataactccaatgttcagctgacaaaaataagtcaggcctaatttaccacatgagtcttgtcggcgctccttagagtttatcctgccaaatcaatgactattcctgtggcataaaccagatcattttctttttaaggtcttagtcattatttattaactcatctagtaaagtactcaccttgaaataatatagactttagatgcaaaccatttacatttattttttccccaaaaagggacttgtgatgaagtgaacagtatggcttcatggcttttactactatgacaaactagacagttttgtttggacaaataagaatgccaattttgtttggaaaatcaaacgagaatgctgtctaaaggttctaaccaaggagacaatccatccgtaaatgactgtcaaggtgagctagccctagaccaaacaaggaagaggttaacagctctaaatcccctctcctgtttaaattcttattacccttagggtatctaaatcaatgcaaccatgtgttgtactgagatataattccttgagataactgagataaaacaaccgagataactcattgatatagcagagtatttaccctaatgctccatgcagagaacacaggcgttagcagctgctgtacctaagcttcaaatggtttttccccagtttattagctgtatgagggtgcctaaattatgcaccctgcctaaaacttcagttttcctttatgcaaaataggaataacaacagtatctactctactaggtggttggggagatcaagtgagatcacggactcctgcctttacctctgctttatgacaacttctctccttgtctttcaatttatttattttctgcctttcccactttttccccccatattttcccctatttttcttttttaaaaaaaatccaggaacttgcgtcctgagagatatttttcttcttttgctttgattcactgtttttagatattctaaattggcaaatttatcccaattggagggataatcagtgagaaataaacaacatagtaacagaatattttgaaatttatgaaggttttgttttaatgtctccaagaatttactaatgacagtaaaataagcagattttgttcttatataagaatgaaatacatgtgttcatctcattactatgactacattcaatatttgagtgagaatacaattgttaaagttatttatgagatataatttacatacagcaaaaaattacccttataagtgggtaattatatgaatcttgacaaacacttacagtcagataaccaccaatacaatcaaggtataaataatttccaactctgttcacccttgcccctacaacccaggcatttagcaatcagcaattgttttctgtccctgtagttttgtgttttccagaataccataataatagaatgatatagcatgtagacttctgagttggtttcttgcccttagtgaaaaccatatgagattcagccatgttgttgcctgtattcgtattttgttcttcttactgttgaatacataaattgcatggatgtaccccagtctgtctatccactaagcaattgatgggaatttgggtggtttctaaaatttatcaattataaataaaaccactctaaacgttaggtacaggttttgatttctggtatggatgtagagaaaaggacttacgttttcacttgtctttgctaatatgtaggagtagcattgcttggtagtatgttagactttatcagaacctgtcaaatggtttaatggttttcccaaaacaactttatcatttctcattcacaccagcaatgcatgagatttttagttgcttgctctacatacttgccagtacttgatattgtcatttttttaaaaaattagccattctaataaaggtgttgtggtagctcattgtgactttaatttatgtttactaatgactaatgatgttgagcatcttttgccttccatatatcttctgtagggaactgtctgctaaaatattttgatcttttttacattgtgttcattaacttatcattgaattgtaagggtgtttgtgtatttaggataggcatgtattattcaatatcaatttgcaaacattttcttctatctcttgagttttccttttatttctcaaatgcacctttgaagcccagtgctaaaaaaatcaatttttaagaaggtaaaaacttacttaaattactacttcacattatttttccctttataaatgtcaatgaaatattatggtcatatgtttttcaaagcttttagctcattacacttttcttatctactttccaaaagagaagactatgcatagttaacagttcaagcgctcttttgaatttctttgccacatagcttattctctagggaagaaacacttacataaacatgttgctctgaagagtacagaggggaaccttagtgacacagtttttggttctgtcatcaggtgtagacatagactttagtttctcttctctcttctctccattcttaatacttttccagtttgggtttgggcctacattcatcctcgagtcctattaaacaggagtatgatttttgttctcccaactcaacaagacaacgtcttgctgagtttccttttctcccaggagctgtttcccagatccatggctcacatgctggccaaggagctgaagtgtcgtagtgctgcactaaaaaagctttcccaggtggagacctcgccatttctcaaatcttagccttcctctctgggataagtaacaacagacagagcaaagaataaaaggaaaacaagcactttgggagcatccaatagacctgggcctatgttctggatctgacattattcatttgtttatttactctttctttaatgtattcattcattcattcagcaaataactctttcagcatctgctctgtgtgccatgctaggaactaggaatacagtagtaaatgagacagacttagctttttccctcaaataaatggcaggtctgtcatttctttgttgtcctgaataagctgttaagcttttttgtgtttcctttgtctattctgaaatggagaaagcagttcttagctcacacatctaatgaatattataataagacaaaccaaaatatccacattttaaaaaataaggtggatgtgatgttctttgtggtcttccatacccccaattttctgcaaaggtgacctcctaaataaattatacctaaggtggaaaagaaagatccaactgcagtagtacctcatcaaaatggatgcttgtgatgatggagagctggttttagcaagaagcccaagccagccagctttctagtatataatcctgataatctactcaactatggtcctactgcaatagcttctgaataaatgctcaacagttcaggttgcctttccatatattttcactcctatactagtgctttgactagtctctatagttgtcattcacccatctatcctcattgtaagcacactttgcatttgtcaatgaggcctttgcacttgaaggagaaaaacatggaaaatagaaccagaaaatagtctgacatcatgtactaaatttccagaaaacagattatctaatatcttgggaacgcgattcaaggagcacgttcttctgagataaaaaacagcttttacaatacaagctattaaaaggcaacgatgcaatacaagctttttattgttaactccattctcataacttcagtttcaataaaagatcccattagaaatgcttccccatgtggcaactgctctggaatttccgccattattttctaagcattttatctatttatatcataaagctataaaagaaaggtctggatcaacagtgtgtacatatgaatcttttcgtctaaaagcctaagactcaatccgagaggggataatataaaactttagaagccacccagtttctgtccaatctgccatgaaataaattcagagacagaaagagagagagaagaataaacctggctgttttctattcataaaggtctcctccaaaagctagtcagttctaactagctaacagaactagcaataatgagtttatttagtataaattttgcatgtgttctcttttattccttaactagtaaagtagatatgagcattacccacattttatagaagacaaactgaggattatagaagttaaataaccttgtccaaggtcatacaggtagcaaacagcagaaaatatttgaatgtaaatattctaccctcaaaccttttattaaattatgcaagatagaactttgaaaggctaacaccctcatcattagcacacagtaggcatataatagaaattatcagctggtagatcagtgaatttgagggctccaaaataggtttagtgcttataaaaagcacagttctttgtagacagaacactacctattatgacaataagctgttggcaggacctgaaagaaatcagggagggccttttgaggattaagaaggtataatgaaaatcaggaagctggtttaatgagaaagaaatgcaatatactttgcctctccgattccttttgtatttggtgtactcatctaggagcaactccgtttgttttcttactgtcactctttttttcacatggcctggaaacgattcatgtttctttagtgatgcatggggagagaatagtttatgcagacaattataaaaaggatggattattggtagagactgatgggtcaatataacatatggtgttcaatgcaactacatatctttggaagttactgacaagtctataggtacagcaatataaagcagattttaccaagtgcataaatttgcagaatgactatattttttaatcaccaaaagctatggactaagccatctctagtgacttgtgaaataacgtatgcaagaaatctaaatacaaggacatacaaagagtagaataatcacaaatatatcaacagggaattatttgaagcatacatgtattaggagtaagttctattacacgagagaaaggtaaatgattgttataggagaaaacaattatatattgtctatgagagaaggtagtcattcaatatttatattggaagatatcattaatagacgataatctaagtctttcattttacaaaatgagaatggagaccgaaataatttatactgtatgcacatttatatagttagcctagggctagtctcagtgtgccatactgccccaaagatttttcgtgaactgaaaattatagtacttttttatttatcttctgttttaggttccctttgattctcagatatttttcttttatgtttctattaactcagccattcaccctttcccttctttagtcactgcctgacacttggttgcaatctacctttatacaattaattagggtgtaattctccaacttgctatgattctttttaattctcagactatcatccaaattctttgtcagccccactttaaaagttgcgaggacaccaacagctcatgctaaaatatttttcatttctggtaaaatgccatgtaagtggaatgctaataaaattttagattccgtataataaatataatccatatagcaggccatgttgctatccacagaaagcttctccacacactatttacataggattcttcactacaaaaatcacatggagaacatcctttccctattctttatctaagctattccttggtaagaggaaaggttgatgattatgctgaaaaggggaacccagagcactttgcaaatttatgttctttaaccggcatgtattttaaccttcaactactttctattttcctacattgactattctaattcatctttccagaacactcacttccattcccaaaatacacaccgacaaaacctaagattttagattttgtttaccatgttctctgtgccagacatggttctaaatcttccatatttatcattcaccacattctttcaagatagggattgtcattgtctctattcacagatgagaatactgagccttagagaagttaaataatccaatcagtcttatagagttgatcccaggtggtgtgatcttagagtctgtacaattaagtactaagtttcattaataaacaatctcacacacacacactctctctctctctaaatttaataacctccatcaaggctacatttccattatatctcaccttgcatttttcaaggaatacacttattaaaagaaaaaatacagacttaaatagggagataacttatcctcaagttttccaattatacttaatcacctagtcaaaagcattcagctttgcataagtccctatattatcacgacttttgttttgacaagagaagaacatagccagagaggcagaacagaatgtacatgccaaggatctaggtttatatctagtctaaagaaaacctcatcataatcagagaattgatttttaaacttcctcttccataaggagaatttctaatttaaatgcagttcactaccagagaatgcattagttctgtgtaatgcatccagaaaatgttcaataaatattaacagataattactaaagttatagataatataaattacacatgtagtacacacatctgagttttttaaaaagcataaattcaaaataggattttaaattatatacaagaacaacaactgcaaaattaacttcctgaaaggtacagcaagcacaggatacaaaataacctgaaccttacttagtaaacacatacaaacggtgatgcaattacactgtttttttaaaaaaaactattttcttcacaattcattctcaatatgattttcagttttaaatactaaaatcactgacgcttaaagtgtctgttctcagtttaagagaaatatagggtaataacattgaatataaaagatcattttagaaaagaaatacatattaatgtatttacactgaggcctaaattatcaaccaatatgttgcttattattaatttcagagagaactgcattgctttaggggctgagaaggggcctaaactgagacataatgaactgccaagctgaaaaggatgttagaggtcattaagttacgccttatagttttccagatgaggacactgagacacagagagtagttgggacaacccgaggtcaaaccacaaattagtggcagagaaaagacaggaactcagaggaccaaacgcagtggctcacacctgtaatcccagcactttgtgaggccgaggtgggtggatcacctaggtcaggagtttgagaccagcctgtccaacaggacaaaacaatacaaatatatctacacaacaaatacaaaaattatcctggtgtggcagtgcacacctgtagtcccaactactgtggagcctgaggcaggaaaatcgcatgaacctgggaggcagaggttgcagtgagccaagagtgtgccactgtactccagcctgggtgacagagctagactctgtcaaaaaaaaaaaaaaaaaaaagagctcagaggatcctagacctcagggtactgtatttgaagatgggacaatcttggaaggtgtcagtgaactttaaataaatagcaccccatctagtagtttctctttcagtcatggataaatgcaactggagacaagtcttggctttacgccgagcaaggcagctcagagattcacagcaataattcttgtgtgactaagcaaaggcctccactgctttaaatccctgcatgctttaatctccagctgtctttctggtgtactctctcagggtagggagggatcttaaagataataacttttagctttgtaaaaagttcagatgattttaatggctaagtatttacataggttatcattttcaaagtccaaatgttggtcaatgaggatattatggaggggaaaagtcttgcctacgtggaatatctatgactttgataatgaagagtgagcaggttctgcaaggagatatgttggaaaatactgagctcccatgactaaaattaagacaggaaataaatcaatctcagaatttctcaaaagatgttaaatgggcagtttgctggttttgggaagtgagaagggaggtggtaattattttaatccgtatttttgtggcacaatgccacaaaggtgtacgtatcatgcttaaagtatattcgcttgaatgagattatcatctcatatctgcttccaggaatagctcagatagaaactggtgctggggttaaggtaagaaatgatgggtttaccttcccttgtcaaacaagctttatcatttagagtaagcacaaggccagtttaaaccagcttaacttttacatgtatgtatgtatttatattttcatagaactacatatttatttctcacatatttaattagtgtcaaagacagcagtgataatagaaaggagccctggaatgaaacccagaaatcttgagttgacatcccagatctgcatgtacctggcttctgcccttcaccaagtcaataccttcaggattctagagctacaagacgaaaagcttagacttccaccagggaaacctccatattacataaatgggggagataagtaggttagacttattcaaatgcagaaaactagaaaattggctgagctaggactcagtcaacagccactctaacctccttctatatcatcttctactattgtagaagatggaaagttaaaaaccatctttcaccaattccctttacattaggattcttcacatggcgtaggtttcatcaaactcgtgaggggggagtaatcattccacagcccacatgagtgggctcacacagtggtggaatccctctttgttattgtttgacgccataggtttcacgtaaggagaaatatgagtcaatgacaatttttacttttttttcaatggatcctggagtttaaaaaactgcaagaaggcactggaattaaatgattaagtttgggtccaggcacagtggctcatgcctgtgatccaagcactttgggaggctgagctggaggctaccagtgtgtaatcaatccacattatatttaaggaagtgtgtttattatgtcttggccttcagaagtattgctccacttgagcccaggagtttgagaccagcctgggcaacacggcaaaaccccatctctacaaaaaatagaaaaattagccaagtgcagtggtatgcacctgtagtcccagctgccattgcactccagcctgggcaacagagtaagaccatatttgaaaacaaacaaacaaacaaaaaaagatactctgcatagaaattaatcacaatttctttaaatatgcaggtttttaaaattttttgattaaaattttccaaaggaaatagctccaacttttaaatatttgaaggggaaaacattttattttatttattttatagacaggctctcactctgtgccctaggctggagtgcagtggcatgatcatacagcatggtaatctgaaattcctgggctcaagccatcctcctgcctcagcttcctgagtagctatgactacaggtgcacactaccacacccaggtaattaaaaaaaaaaattatctggagacggtttttgctatgttgcccagctggtctggaactctgggccttaagcaatcctcccgcctccacttcccaaaatgctgggattacaagagtgagccatcacatcagccacattttcatttagacaatttaatttggaacaattggagcaatgcttctgaaggccaacacataataaacactcttccttaaatataatgtggattgatgatacactggtaggtatttatattttgaagtgccatgatgagttccgaatgtttagataagaaataaaaagggaggactagaggaagtgtaccctccagagaagccaaatttagtctgggaaatagaaatagggtcaatgtcaacagcagcaagatgacgacagaccaatggctgtttacaccagagtctttccaggttttctgacaagttttgtgttacttcatatcttccttatttaatcctggccattaactacaatacagtactaacattttaactcagctatacaaacccaaaacttcaataagtttatcagagacaatactgatatgttaaaaaaattactcacaaaacacatgcatacagaatatagtaatatcacatattttgcaactgtgtccacaattaagacctcctgtactaagtagaatgtcactgcatatagggtattgaaatacagaagccatttcttgtgtagcacccaaggaaagtctttcacattcaaactgccttttacattaatggaagtgccaaaatgatttgcatttgtatattcgcaaatcatattgttttaatatttcaaagaacggatcacactcaccccttatcctatttgattctattaggtcttcaaaaaggaactttgggtggacacaacatacagaaatcctattaagcatatgatttcatgaaggtatgcatgtagagtgtttagaatatgacacatatttaaatgctccattaaaaaactattaatgttaggattagaatataaatctacagtaaaatggtattgatgacagaaacattttaatcttttgtcagtcaattattgatatttcaaagtattttataaattttggtacaacacatacacccaccacaataatgtgaatcctttcaaattcttgttttgcacatatagtacagtataaacttgataaatgttttttaaaattaatatagaaatggatgaatgagattcaattagcccaatgtcagatacagttgttgaaatacattaagtattcaacaagtggatacaaaaatatgtttgaactgccaattatagcaaggtctctgtgtcaaattaaaactaaaactaagatacttcgtatcttgttaaagactggcttaatttttgtcacatggtatacttccaagtgcttttacctgaagaagactaagcatttctccagcatgcctgtccataactagtatttatcctctatgcaatttgttaacatggtacctaagagttgacaaagaaaagcagatacctctttagctagataattcattaatccatgttattttatcattttgtggcccactgtagtgactctcacttatccatttatttgttcaataaatatttcctaagttcctattatgcactgtacaaggtggatactccacagtatgcttaacaggtatggcccctcctttctccaagcttagtttagaaaggcaaataatcaggaatgaaggtgtttatatggggctgaaagattagggaggagtaaaagggaaaaggagcaacacttcttgcacatcttctatgtgacaagcacaattccaggtactcccccatagttcctcttttcagggaattgttgctgacatgtgatgtctcccccaggcacccagctttaaaatttctctcttttgtactctgtccctttatttctcagaccagctgacacttagggaaaatagaaaagaacctacgtgaaatatcgggggtgaatttcgactgatagggaatgacctctccagccacccagtaactcaggtcaaacattttggagccatctctgactcttttcttccatttccactctatggtaaaaccatcattaaatcctgccagctttgcattcaaagtatgtgctaacattaaccagttttcccatttcctccactaccaccctagtccatcatcacatctggtcatacaaaggttactctactgcctctcttgtgcatctgtaagctattctctctatgacgaatgaaacagaatcatattcctatttttcagatacttttcaaatacaaatgattttctgttgaatttagaataaaataggaagttcatgttgtggtctgtcaagttctataaaatctggccttcaattaccgtgcccatctatctctcaatctctgctttgctcagtgtgttcaactactccaggctcccactggggttttcaagcacacctccacttcaggcctgtttcactcacatggagtattctcgctcagagctgcatgtttctttgttgtgtttgctcaaatgtcagcttctcagaagactgaatgtgttcaccctcgctgaaatagtaaccgcccttatccattctctatgtccttatcctgcttaaattttctttatagagcttgccattttctgaacatcaattacattatacataacactcctattgatttctttattatctgccttcccacctgaatatatccatacaaacagggcttccactatacaaggctctatcctcagcacctataacagtactaaccatgtagcaaaatccaagaacacattttttgaaataatggattatttcatttgattcttatatgaaattgctaatattattactattaccaaaaaaaacaggtaaaaaataatgaaacaatttttggaaagagataaaataatttaggaaacagggctcatgattgaggattagatgactagcagaggatttaaaaagtgaagaagtagaaataacagagacagatgttttgattttttttaatttctcaatttctttaattttaatattacaaatgaaatattttggggaacaatataccttaattccgtaaattaatattttaaaattaataatctgctttgttaatttccaataaaaattaaaacctatacatgaagatcatttacaaaagatgagaaatgacacagaaaatatagagtgaacactacttaactactcctccacttttctgtttccatgtcagacacatgcctggtttctgacccttgtcagaccaggaacaaattataatttgaaagtagggcataaagcgctggagttgagacttgtaaggatgtaagagcttacaacaaaagaacataggaaagtgtggtgaaggctaaagagaattagaatgcctttccccatttggtgaatgaatagatttttgtgttttgttttagcatatcttcaggcctgaatggaatgctttgtgtagtaaacacagtaaagctcaaatcgagtttactgcctccatatggttccaaccacatacgtacaatggtagattcatggggttggggggggggggcgtttgtcaggggaggacaagtcattttcctagaaaaggcaattgtgtttctagaattttattaagcaagagttcaaaagcaagccagagcaaaaaatcgtactcagaacatcagtttgttggtgcctttccaaaacagcaatttgataaaagtgcatctgcaagtcttttatctgcaaagttaatttcattattgcactatactgtacttaaaaaaaagatccacacatttattaaaattgtaataaatgaatcacttaggctttgatctcctacaccagttttactgagctcccctaaagggagatcaattaagcatacatttttccaccttttaaaataatactctcagacagagcatttgaatttcattttattaaaatgtaggcacagtaaacattataaaaaataaaattcccacaattcacgctattttaaaaaatatcagcaactgtctcatttcattcttgataggaaaaataaaattttagtttgatgatggggttcaggatataatatccccaaatataacagtttggcatgctgaaaactgcagaagcaggaaggtcactctcatcctcttctgcctttcactcctgaagcacatcacaaaacataggaaagattttctgaccttctcctgaagcaggtcataagatattcaggtgaaagataccctccctatattgggaggaaaggaacatccttgtctctgaagaagggtcacacagaagaatctaaacaaacaccctgataagtttccctaatttattacaattaaatcataccaaatttgtccattcatacttttgtacaactgtccactcttcatcaaacctagcacaaaatacacaggtttaactattttttcaggtcttcacttccttacaaaggcctccatgtcaagtaaaacgtatatgaaataccttgtatgcttttctcttgtttattagctattttgttataggaacttcaaccatgaacccagaatgggtgagggaaaggtatttttcccctcctataaagatatttcctaagtgttctctgacacaatacactaaaaactactttatgacacaaccagaagcactaataaaatgttgtgtttctaggaaagtgctctcttcatcaaatgacatgctttcgtagaaaacagaatcttattcaatattgtgagagttttgatttatttgctatagtgtaccattgcttctgtgttccaaaacacaaaacgattcatataataatgaatttgttaaaatgactttccgtaagaaacacacatttattttccagtgcatataaagagcttagttatgagtctgaaagtatcctctatgtacctaggaaggaagttcccccatcaggacaggcaagggaaaaaattctctgtaaatataaccgaatgaaaacaaaaggagacacatcatcagaaatattacatcatacatgcaagatgacaaaatacaatttttgaagtgttattttctttgctacttaaaaatggaatgacggaaattatatggtggctgtgttcttgtcctggctatgaaactaatagggtgactttttcaaactgttttctttctctgttcatctctaataagaagtggctgcagtagatactctttaagatttcttctaactctaaaattctatggattaagtaatttaaacattttcaaaggtattttcatttcttcatatattcttcctgagcttatgacaaattaattctatgttcaagcatttatggacagactcttccaactgaaagaactggtgaatttaatgatcttgaaaaaggaggagaaataggaggaaacacttaacttattactatccaagaatatcctaaaattctactcatttgagcatcttctatgcagccctcataaggtaacaaaaacaaataagcatagaaagtcttggaggaactactgattcctaaataataatgatttatcaaagtaaaattattgttatcaaccagtggaccagttaggggcaccaataaagtaatgagagatttctaactgaaatacattcacttatttaccctgtagcataataaaaacgaacgtaaggaatatacaacattgagagcattgtttcaggtcattttcacatacgattctaattactaaatattccaggatgagaagaaatgactagagataaattatggtgcctattaaaccttttattgaaacctcctttccaaaaattaatatcacatttaatcatcaaaatatcctatctaaaaatttgatttatttagttgtagtctacttccacatggaatttggagtaactgtgtaagacatgaaagaaattctaattgaaaaaaggcagactgggcaaaagataatcagataaactagatgcactacatgtatgtagcttatttgcctctgactcctggtacatatgacaatatatcctgcttgtacacacaatagtaacatatttctgccacaaggaaggacaaagaaggaagcaaaggagagggggaggaaggaaaagttgactaattgcattttaaactgttaccaaacaagaagtgagttacagaaatgaatcaccactactctgaagtttcagcttgtgaataaagttgccctggctgatactgattattttctacttaccattttaactgtcatctttttagcacattaaggctctcttttcatagacctgcagaaaaccggttttactaatccctttcctcccagaatgccttcgctctttatcctggatgtaccctcacttcctgttttttgttattgttgttgttgtttgcttgtgtggtggtgggggaaaaaaaaaaaaacttagaagacattgaaccatatatccaggtttccggaggtgaactaacaaccccaagtttggggtctagccaaccctttcacagatgctggacagatactaagcaaactactgctcacacacctgccatgaataaaattttaaattcatgacaaagggcaacctgaataaacagattctgggtgagaaaataaagaaaatgtgcagagcctaaaacagttatagcagccaatacataaagtatttgctttcagtaagtgccatttctgtttttggttacttctcattcccttatttctcccttttgacaatattttgtttggataagtcatcagcctagctgaaattttattacacagaaaaaaatgaataattaaaaagttatgaccatttcagaaaactaggctttatggaagtaactttaaagtacgtggttttataaataagcatttgtaggaggctgagacaggagaatcgcttgaacctgggaggcagaggatgcagtgagccgagatcatgtcactacagtcctgcctggacgacacaccaagactccgtctcaaaaataaataaataaacaaataaacaaacatttgctcaaaagggactcgggggtatgattctggtattttccctctcacctataaatgttatgcaaatgtattatttttcaaggaggggaatgcccagtactgggagaccacttctccatctagaggagaattttcttgtgccaaggttactgctaagtttgaaatagaaagaaaagtgtgcttagtaagcactgaaatagatcaaaggaatgaaaaaagtcctaagaaatattaattttagactatagtaaaacttaatgaatgaaccttaccgcataagatggaacatactggatagtcactataatatgcatgcctatatctacatacatatctactacatatagatacacacctgtatctagctattttttaaaatagtcacatttttcttgtgatttctttgtttctgcaactcttgatttcctctgattactcttttaactggatctataacctacatctttctctggatattcctctggtaactctccctcttttattcctcatcttctttattccaagttgacaattagtttacctttaccctgattactcagttataatgcctattcttacttcccaagaaaaaaatctacacatttttaaactcatttttgaattgacatataataattgcaaatacttatgagatatatactgatatttctatatgttttatgtacaatgatgagctcaatgtgatcagcatatccatcagttcaaaccttatcatttctttgtgctgggaacattcagtattacacacagaaaagctatccttcaaaaatgaaaaagaaataaaatatttaacagataagcaagaaataaggggattcatcaccatgagaatggccttgcaagaaatgtttaagaaagtctcacatatggaagtgaaaagacaataattaccaacatgaaaacatgcaagactataaaactcactggtagtgtcaatacacaaaggagaaagaaaaaggaataaaatcttatcactatagagaatcacccaattgcaaaaataaaccataagagaggaagtaaagaacaaaggaaatacaaaataaccataaaacaatcagtaaaattacaggaataaatctccacctatcagtagtaaccttcaatctaaatggatttaattcccccttgaaaagatacagactggctgagtggattaaaacaaaaatgacccaaatatatgttgcctacaagaaacccatcttatctgcaaatacacacatagactgaaagtgaagagaagacaaaagatatttcaggcaaataaaaaccaaaagcaagcaggggcagtcatacttacatcagacaaaacagactttaggtcaaaagctgtaaaaagagacaaatctacattttttcttggatttctcggtatgatagaagctagcaatcttcaaaacgtgtataaatctattgccagtcattgacatttcttataagaacctgtgtagttgtctcacgtgggtccgcagctatttatttccaatttcctttccatttaagacctacctatgcagccataaaaaatgatgagttcatgtcctttgtagggacatggatgaagctggaaaccatcattctcagtaaactatcgcaaggacaaaaaaccaaacacagcatgttctcactcataggtgggaattgaacaatgagaacacatggacacaggaaggggaacatcacataccggggactgttgtggggtgggggaaggggggagggatagcattaggatatatacctaatgctaaatgacaagttaatgggtgcagcacaccaacgtggcacatgtatgtatatgtaacaaacctgcacgttgtgcacatgtaccctaaaacttaaagtataataataaaatttaaaaaaaaagacctaccatttgagcaactatagtcttataataaccttctgttactctctatttttctaagtacaccacatactcaaaaggtaagctccttgccccttaatatagttacaaggtttacaaagcttagtttccagcctgtttaaccacttttcaacatcttgcctctgtgcactacaaattctaagttatttgtagttcttcaaatgagtaagtgtctttttgcttgctctaccctcttctccctatgttcccttagctctaattcctattcatattcaagtttcgccttagctgtcttatcctctaggaagcctcctctacctcccaaatctgagttgcttgtgccctatcattactgttcatcactctgtatcgtggctgaccttctaaatgtctatattcacctataatctatgaacaccaatagagcagtgacctgcctatctgatgacaaacataaccccagtgcctaagctcaatgactttacgtattacttaaaagtcataaatgttaaacatttttctctagtgcataaattacaacattagatactataatgagctataactcttcgtctctttttatttcaaaattctattttgtaacaaattactttgtttccatatgcaattggacatgtttttcagataattatcagaagattaatgagcattttctgaaccatttctgaaatacagaaagggtattcaaaaaaaattattgtccaaagaaaaattgatacaatacttatttggaagtcctgaaatctaagagggttaaaaatatgtgtgcctatgacaatttctgaattatttacaaaattttggtgatacaatatagaaactatttacatactttccttatgagttacttatgaaaacaatgttaacataagttactcgaagtgttaggggtttaggaaaattgtgcataataagcacataaccattatacacatcaaaacgtacttttaccttttgtgtgtgtgtgttttatatattatttttctatttttaaatgaagcagatttgagaaattattgattggatagtttttgataaaggataaaagagttagacaggttaaatacacatttttatgggatgcacttttacatgaatgtttctttcttaaactgagtaaatcctgagataaaatattatcaccaaagatatttagctaaattgtggacaaatacatagagtaacagtctgtagacaacagcaaataattatctggaatattcccttcatttcaaaagttttcatcttaggtatattgtttgaatattttattatcaaaaagccaaaatatgatgaaaaagtcataaagtgataaaatcctaagaaaggaaataacagtggaaagaaaaattaatcttgcacagaatagaaggaaaataaataaacgagaagcacacaaataatcaaataaagaaaataatagtagaaaacaataaacctgttttgtatgctgagatttgcctacagtcttcctataaaattctggaaactatatctagaggttgctctttgattgttgctggcaatgtatcatttggttgggaaatacattcacacataaataaaagagatcagttataaagaaaaatacaaatgtcaaatcaattaaacccaagcagtgctccaaatcaaacaaagaagagagtcagagagtagctcaaatgctattatactatctaaaaagaaggggtttacttttgatcctttgtgtatatgactccatagaacctgcctgagctattctgaagctgtgagtggcgatggtgaaggcagatgagaaagcatgacgtgtagagacaaataaagcttgggttcaaattttctccttgctatttagatttttccaggaatttgttttcctaaatacaaaatgaaaataattaaatttggtttgtgtttttgagaattaagtgagataataatcacaaagttgatcactgcagggtatggcatacaatcattacacatcaattcctttcctctcttgcccattactatctatacagggcatcttgaaaacgtatttattaattgtatttcttataatacatcattttaattgtgtataaaatatactcaaagatactaaaagcatcaatataataatttcctaacataacattttagctctttgtaaatatatataaatataaatttataatttacaaattaatagccacaaatgttttcttggaatgtttttataaaacttgtagtcatatacttctattttttatagactgcttttaatttcgtgataatattaaggttatttggtaggacaaatcacatttttttttagttttaggcaattttttcttaaactggaaaaatctgagacatacagtaaatgaaacaaaaatctgagctgtagagtcaatgaaaacaaagtataactaatttgtggaaaggcaaaaattagaacccagcaatgtactattctactaaatatctttagtttccacataaatcatgagttggcatataacatggatagtctgaataaactcttgttacttaactccaatattgccctaatttcaaggagctgatccagaagaggaagatctgagttgggacttcagaccaatggcaagattcaagcctttcatctccatgctttctgcatttctctatagatattcagttgtgaaacacctggagtttatgtgtagttggctcacaccagctgcatttttgaagaaggggtaaaataagcattttgggttagatatgaaaaattttatgcaacaaatgcatatttggaaactgcaaaatgagcatgcaaatcaatttatatgcatcgatgaatgaatatagacgggctattttcaaagtataggcattctagtgtagcataatatatcgggacaaaaggaatgggaaggaggcaaattgctcagcttagtcatccatttgcaatggaaaattgcattgtcaagttccattatgcctgcacaaatttagacaaattaaagagtctactaagtaattattgataacatacatgtgtatgaagtagagcaggaaagttgtgagtcatttggaacttctcagatgtttctaggattttcattagcgaaaggaggcattgaaagaatgataatataccttactatgaaaccaatttgagacacaacactggcctattcagccatatctcttctatggtgacagagatggataacaaccggaaaaagtgtaaataaaacattaacacaaatcactctgctgaggagaaacgttacatctggttctggaccctgcatcttgttaggatcccttcattcattacttcattaccaggagaattattcaatctgacacacgagaccaagttaaaaaaaaaatccttagaattatacaaactttaaatcctatatttctctcttttacagtgtgtgttcagaatatattctgcaaggttactgtggtattctcttctgacaatataaacattctactacgtttaagacagaatgttcaaccaaggataacataaatccctggaaagtcatataatgggtctcatcttctgaaatggactattggtttgacatttcaaacatctcatagataatccctcaagatggagagtcaccaacttcctttgataatctgctcttgcacttataaatatttatccttcaacaatttaaatatgttttttctttaccctcttcactgaaaacagcaaaacacctggtctttacaggttatgtgcctttttatacataaataagtatataaattctattttgcatatatgtgtatgtatttgacatttatttatactcgctaaacgtatttttaacaaacttccataccagttcacaaaacacacctcattcatgttatattgtgagtcattatacacagctctaccataatttatttaatcaaatccatgttaataaacatttggatttgactccatttacttgttttcactattacagacaacatgcaatgagtaccagtgctaatatatttgtgaggcttgttcaggtatttctgtttaaaaccaaagttcctagagatgaaactgttaaaggaaatacacatttacattttcatagttactgttaaactgcctctcaaaagaactataataatacacactccatccaaagatgcacaagagcataagagtgtctacgttgccacacctttcggccaaaactgggtatgatggtcttttctgtgctttttttttttttggtcttgctttgccacccaggctagaggacagtggcacaatcacagttcactgcaacctctaactcccagcctcaagcaatctacctcagcctcaaaaatagcaggaactacaggtgtatgccacaacatctggctaatttttaaaaatgtttttgtatcgcgctttttgcctgggctggtctcaaactcctggcctcaaacaattctctcacttcagcctcccaaagtgctgagattacaggaatgagccaccctgcccagcctgatggcgctttttaatattttcaacaagctaaacaataaatcatatacttcattttaattcacgtctttacttattattgaggtcaagcttctttttatacatttactagctatttgatattctcttttaagaaattgcctacttgttttgtttgaccattaccgacaatattctcttcttaatatcttgcagtgagacccactaacgtttattgaactcctacagtgggccagactctggtagctcttacgtatataaaaggtgtaagtgctcccctggggacttagaatcaagtgaagaaatcagatgggatgataaattactataataaaatgtgttcagcataagaataagggtctacacaaagccagcattgtccctgctggagaaccaggggtgagcaggaagagggtatcagggatgatttcacagagaaggagaccttacagatgggttttaaatgatgggtgaaatttcactcagtagagattcaatggaaggcactaggtccagagagagtaacactagaaagaaccccaagacatgtgaacacaattattattcagaatataaataatgactggcttagatcacaaagtttctgttgaaagaaaatggtaagaaatgagtctggataaggagaccaatttatatacaagtgcttgcctgccattcttgagaatctgtattttatctttcagccaaaggagcagtactatttataaaggatcactccagtagtagagacaaatggctttgaaaggggacaaaaggagcaatgcctgagattgggaaagtggtaagtagactatagcagcaatcctgatgagggagtatgagagcctaaaatagcataatatcaatagaatcaagagaacttggtcacagaaagcatgtgattaatcctttcatctttctacaactagtcacactggatattcatctctgtggcagcatttattgcattgtaatgaaatcatgcatgttgtctaccagcccaccccactaaaatgtgacgctttccaactcttagacctgtagttgaccaaaacgttgtttcaccaaaaaataaactttcaggtttcctcactttccttgtgttcacattttatgctgcaacaaactcagtatttattaatctaaagtctttttttaaaaaaacttagcctctataacattctaatgccttagtgcaaactgttttattttgatatggaagaatccagtgattacagtaatttgaaatgatggtgacttaattaagagtgtgaagcaatccattaactataatttgtaaaaggagccatatgtttttcactcttttaggtataccattggacttgcattttcaaaaagtaaacctgctaatttttgcttcaactgaggatatcattaacaatatcaccagtagcacacatgtgtaccttattacagatcttcatatactataattaatagtgagttttattcgtatttggatgcctgaattgtttagacttgtatttaggtttcaagccctttatttgtgctgtcaaacgtttagtcctcaagggcttgagagcacagaggtgaacactgcctaagacctaacatctcacctcctcctgtgtgatggcttcttaatatgtggttcaggaattatgaatggagaaaaacaacagaggggtcaaagatgaggctagatttctggtttgtgtaactggctttcctgggaaaccaaaaacatgacagaatacccagaaatgcatgtttttcattttgtgagtactataattttttttctctggtttttgttttctttgttttgtttttaacccaaaactatttttctgccctctaatctcatcctcctccaggaacaattcataccagtactaccaaagaccctttcacccaaagctgtatttcacagaggaagaacaattacataggatataaacggactgagatgtaagagacaccactcgaatattctgtggttatgcagcagggcaagaacatcacacctggtggaggtagagtcagtactgggaggataccctggagatggcaaagcaaacaagaggaagtgcaaggtgagtctgcaatacaggcagcggctgtaactcgagctcaaccagctcaacaacgtttaaggaaacatgaaactggggcaatccactgtgtaaagaggacaagggcagctggctcagggcaaacataagcatgtgggtggagagcctgcccagagtgtattccagggacaccaatgtgcaacaacagcaagtcaagtcactgggggaagtaattcatgggccaagtgttctgtaacagttggtgacatattttatgcaaatgtatctgtgaattataacttcagacactcttgaaatagagttgttttttttttttggcagaaattaggttttgtagggggaggggagagtatttgttttgggctttttccaactcaggacttgggagatttgcacgttaaaaggctttcagaaaagtccaattatttacataactacagaactgaaaatatatttcaaatgttacttagtccaggctgctgaccagaaaaagaggaaccttaagcaatttaaaactagcagttgtctatttaagctactaaggatctctagtgatacagattcacccaccacttctgctgacctgttctcacatttatactagaattacaagtgaatgctgttttctctttccttcggcctaaaccagcacaattttgttcaaatccatttccattgtttagtcctctgtggaccagactaccactgccagttttccttagtccaaattcttttttctgtttgtcagctcatatttttctgtcctacttttcctgcttacaaatgcaatgctatcaagatttttccctttatacaattctggactgcctgatctacagacactagtgagagacattttttaagccactagataacaaaaacctatcaagaattttatgaagttcttgtccatgcaatttccaaggcatgatgggaaattagcaagtcagacaaaggcaacagggaaggtgagggggtcactgaaagtgcagtgatgctgctgctgggatgaacagaccaggatgactgtaacacatttttggaactagcctttggaagagcattagccagctgaagtgatagtgggtaaaataaacagagcgggggctattagaggaaggaggctgaatgtcagaccagttgcaaagaacgaggattggaacatttttagctcagtgaagacagcactctttctcttaggcagataaagataattgaagaggatgctaaccatatggattttatttccactgaagacataaaaaaattaatttatgtcagcagagaaaggatattcattaaacttaagggagaaattttctgctcaggaaaagttattaaacagttaaatggaattttgaaaaagagaaaaaatatgacattgcattagcttatacagacttctttgaaacacaggagagattatcctatgtgaaagggtgtggaggatatacagttagttattattttataaataaaaaagaaggaattacaagtgaagagtctggcctcaggatttacgcagctatgattcaaatgtcaggtttgtgaatttctagtgcgtgaattggggaaaattttaaaaatctttctgggccttaattttctcacctatcaaatgagaaaaaagtcacctactttttagggttgtagagtagaccaaatgaattaatagcacaaagagctgaaaatagtgcctgacacactgtgagagccatttaagattttgctattgttgttgatgttgtcagttggcaggaaaaattccaatgatacactgccagaaatgacagctagagacaaagaatgattatattttctgtaggttaaatgtagacaattacgtatttattcttgtcttttccttcctatttccctttttggcttaagcccagagccagaagtcaagcaatgtatgttcctgtcctgtcttctactaaccagatgtgtgattttttaaattttaaaccaacagttctcaatgtcctcattgtttcaaattctgttaactcttctctgtgtctgtctgtctctctctctcaatttactttaatcacaaatactctttttctctcccatcatcttttctcctatctcctgttcctctcttctggtcttctgtctcattttctaaattatcaaacagctcaagcttcccagcttccctgaggcttgagcatctttccatcctccacctcctatgggcagaagacactcagaattgtgtatttggctccagttcaaattgttattgtctctgtttaggatacaaataaggattttgtccaggatggataatgtcttgggtcgaggagaaggaaggtgcccatcattcttctttattgccaagaacctctgggaacatgaacagctcccagctaacagcaggagaggagcaccattcccagaagatttattctaactcctgaagctctacctatgtctgtacttttatgaaggaaatcaatatatagagtcatagaataacaatggataaacttcaagtgaaaaaaaaatatttaaatatcatttgaagtcaaaaaatacattgtgatagaagaaagacatattttaatccaaccatttttaacttaaataaagggtgaacaggacagaggaaaagaaaatgaatgtctaatatattataaaatatatgtaatgatattaactgaaaaatggagcacgtttttaaacttacaagttaccatttgaaaaaaactactttaaatttcatatggaaccaaaacagagcccgtacagccaagaaaatcccaagcaaaaagaacaaagctggaggcatcaagctacctgacttcaaactatactacaaagctacagtaaacaaaacagcatggtactggtaccaaaacagatatatagaccaatggaacagaacagagacctcagaaataatgccacacatctacaaccatctgatctttgacaaacctgacaaaaacaagcaatggggaaaggattccctatttaataaaccataaagatccttgaagaaaacctagacaatatcattcaggacacagacatgggcaaagatttcatgactaaaacaccaaaagcaatggcaacaaaagccaaaattgacatatggggtctaattaaactaaagaggttctgcacagcaaaacaaactaccatcagagtgacaggcaacctgcagaatgggagaaaatttttgaaatctatccatctgacaaagggctaatatccagaatctataaggaacttaaacaaacttacaagaacaaaacaaccccatcaagaagtgagtgaaggatatgaacagacacttttcaaaagaagacatatatgtagccaacaaatatgtgaaaaatagctcatcatcactggtcattagagaaatgcaaatcaaaaccacaatgagataccatgtcatagcagttagaatgacgatcattaaaaagtcaggaaacaacagatgctggagaggatgtggagaaaaagaaacgcttttacacctttggtgggagtttaaattagttcagccattgtagaagacagtgtggtgatttctcaaggatctagaaacagaggtaccatttgacccagcaatctcattactgggtatatacccaaaggattataaatcattctactataaagacacatgcacatatatgtttattgcagcactatgcacaattgcaaagacttgaaaccaacccaaatgcccatcaatgatagactggataaagaaaatgtggcacatatataccatggaatactatgcagtcataaaaaaggatgagttcatgtcctttgcagggacatggatgaagctggaaaccattgttctcagcaaaataacacaggaacagaaaaccaagccctgcatgatctcactaataattgggagttaaataataagaacacatggacacagggaggggaacagcacacactggggcctgtcagggggtgggggtctaggggagggatatcattaggagaaatacctaatatagatgacggattgataggtgcagcaaaccaccatggcacgtgtatacctatataacaaacctacgtgctctgcccgtgtatcccggaacttaaagtataatttaaaaaaataaataaatatcaaaagcaaatatgtgtataggttccctaacttttctgataaaagaggtttctgggattctttttttttttttcttttaagagatagggtcttgctcggttgctcaggctggagtgcagtggcacaataatagcccactgcctcctagaactcctgggatcaagcaatcttcacacctcagcctcctgactagctgggactacaatacacgtatggccaccacatctggcttttttttttttttttttttttttttttttttttttagaaatgaggtctcgcttttttgtcccgcctggtctggtactcttggactcaagtgactctatttgtactcccaaagcactgggattaccttatttcctagaaagttggcagaactttttaaatagacattcataaatgtatactcttacacatttcactgtgcttttgagtagtgaaatacaatatgtaacttcctatatttagaatgttttcaattcagtaaattaaacatttaacatttgtagcatcacgtataattttaaataaataattacattatttgctggaaaataaatcaatttttcaccaaagttaaagagcttaagctgtatagtggtttcttccatacaacaactatagtcatatgctgccatgccagctatttccctaaggagagcccaggcatgcttaattatagaggaacaccattacttagaagaaaaaacatgagtctttaatttccttgtctccgctggacggggctgtggattctgctgaatctagcaatgtctgagtaacacttaagcctagctgtttccatatacgggccaggtgttgcgaggtcccaaacaacagtacctcctaagctctcatcagttgtgtttccatcatggattagaacccacacagaattcattatgtctataattaaatgaagaaagcccttctgatgtcaggatattagtgaagcaactgttcgtcttggcagctccgcttttaacttttggattgccagatccctcctgggaaccaacctaagaaagcactatttgatgtagcagttgttcctgcagtgtggtgtcagtgcatttctaattacagtccagacagttttgagcgtgagtaactagacaagaggccaggtcagcactttggcttgccaggtcagacttattttcctcccacttctttccaataatagtttctcatatatacctgaaatagtacagggcattcatctttccaactctaagaaccactcctaagttcaatttcaagctatgtgttgggaagccaaacacgcttagccaaaaagaggcactatcttctcattacgacatttcaattaagtgcccactgtaccatcatctagattttcagcagaaccatactctaactcagcaactctcattatttatgtgactgagctagttctttatatttgtgctgactcaccacagaggttgatattttcaataattttatcatccaaactctgaaagagatgaaaactttgtgttgcttgttttccaaaataataagtttttcatcaaaaggacaaaaatttgttgtaatattatttagttgcaatattttggggctttactgctggttatgatagagtagaatcaacccatcaagtagaatatgaaaagaaggttaacaaaggaagcaaataaacaagcgttatgaaaacaaagagtgatgaattctgacaagctattccattttctttattatcatgacagtaggaagcagcactaaatgtaagagtctgccacaaccctcaaatctgaatgctttattataagtcagccatttaaaatagtaccaacctgaaaactagtgaacaaacagcccagcatccctttgataagcgaaatatacaagttgtgtcatacaatggacagggctgcctgctaaggtattgggcatacttggacccaaatcccagctctgccatttacgagctactgaacttttagcaagtgatctcttctaactcacagttttctcactgataaaatcgatattttataaaattatcaagtaggactatggtaagactatataagataaggtagacaaagtacactgcataatgcctttcactcgaaaaacactaaatagtaattttaataaaaactactgtgatttttaacagaatgattttaaattattctcaacttcaagaggtgcttatgaccttacctttaaggagaggcatctagtccattttctgaaataacttaatgtataatattttgggggaaaatcatgtatatttgcagatttagaaaatactatgagagttatggttgaactacctggtaatgccttttccaatatccaattactcattcaagtatttactgaactcttacaaaatactcatcattcaattacttaacaattccagcagttgagttgttctaattggaaaacttacattgcctgattgtgttggtaggatttgtgctccgtggatgcaagtgtaaaataagaacctatgttttatttctaaacattataaagaacataaaagtggaaaatgattcaaattcaaacactgtatacagtgtttaaaacagagtactttctctgcttacttttaaaattattcataaataggtctgctctctggaatactccttggatatatgttacaaatatttgacttttatactcaacatttttcaatatagatttccattaaggattactttgtaactaagcttttttgtatattcagtgcattggtattcactgaacagcatttctgttttaatttgaaaggtttttttttttaagttgagggagagtttacatacagtaaagcatatacattttacgtatatagttcagtgaatctttacaaatgtaaccaccacccatatcatgcccaatgctccattgttttgtcctcttctagtcaagaccactaaaaggtacctttatcccaacctctatcatcatagattagttgtatctgttttaaacttcatataaacagaattatatcgtatgcactcatataattgctgccttaaagcacttattttatttgtttaaattttacccaagcggaataagggaaacaatgtcctctttacttagcttgtcataaaatccatattttaaagcataataataagagaactctaccaaatctgatgcatacttctgggcataaatgatctaaaatacatttaaaatgaccccaaagtagatgtaaagaaatatgattcacatttttataatactattagcattcacaacgtcctacagcaatctacctgctaccatttaatatctcccacaaatttttaagctttgaaagagtgtgtatctattatctactcgcaaacaatctgtgaagtaggctggcattagttcacaatatattagtagtctgattaggtggtttcccaattcgcaaccttagaaaatgaaacagaacattgatggtgttattttacttttaacatatattaagatgtaaagtcccacctggaatttagttcttcagattccaaaccatgttctgtttacacacaaaatacaaataatcatgtggcaagaaaggaatctgagagagcatggtactcattccagtattcaagtagaactacatggaatccatgctcaggagaaaaaacaaaaagccttgcaattttctgaacagctctaaagcaactggccaaaattttgttttccaaagctaattagaacattttaagatttacgtattcagcaaaggccgtgtaaatttacctattcctatacttatgaataatgaataaaagaaaaggaactgggccacaaaattatagagaagtacacaacaaaaaaagtataagatttttgcatactgttttttaataaaccaaaaaactttaaaaaatataaaaataatttattctgaattacatcaaatagcttatatactttttgagagcacagtttgcacagcaacttctaataggtttattaaccctgtaataaaatgaaacctgaatatctattgtaaggcctaattttcagtacatatttataggagttaattctgcaaccagtgtagctgaggaaggagtatagaatgtggtcaacgactattttcaggtactaatgtgtctcagagccctggttttcataatgtagctaagaatgacagaaatattatacagtgccagttctttctatagtcaatcaggataactatacttttagtaatcaatttaattcacatttaatgatatccaaaactgaacatatcagtgacatgtatacatatatatatatatacacaattttatgctgaaaaatataacctacttatgataactaaaataacagcttgcttgaacttttaaagccaaatatattacctatcttatctgcagcatatgtgtaaataactttaatgtataagagagtctcaaagacaagttataaattcaataaatcttttttatactaaaactattaaaacttttcctatttgatagacaatgtactataaacttcaaagtaaatggtatcttcaataagctattaatatagtaaaaatcactgcttaaatataaaattgggatggaatacaggtattagtttatgtggaaagtgaaagcatagtttctacatatacttttgtgttaagtgcttgctaaatcacaaaattctcagaatgtgattttttaacatattttgagtaacagctagacatgggtaacattagaacacagctgcatgcaacagaaacagaggctcgttgtctttataaactgaaactttaggcaggtaatggatcattattatactaaaattccttttagacaagaagaagttctatacatttaaattttgcttgaaagtacccctaaagaaaatagtgtcggtggaaatagtcagtgaggtaatagtaacaaaagtaacacgtggacacttacaaaatgcttactatgtgccaggcactaatctaagagattcacatgaagtcacctgcttcattttcttaagagcactaagaagtaagcagtattctcatcccaatttcacagataacacaattgaggaatagaaagtttgagtttgccacttgaaaccaggcagtctggcccaagagtctgtataatttaacctctgcactacaactgcatctcagaataggaaaacaaaatctcaaaataatatatttgactttatttgtggcattttggaatagtaactcagtttttattattacctcatagtcaaaataaactttttaataaacagatgcctttcactgtcatactttaagagtttcccagaatgcttcctctagatcaaaactattgatgagtttctgtgactcagagccttctcaatacaggtgatccaccttttcctacaatggcagacttcaaacaaaactctggcaaaatctctgaatcatttttaaccactatctacttatataataactacttaaatgaaaacaatcttacaaagattacaagcacctacaaaatattttcctttattgtagtagttacaatgttgattcaaacaacaaatatattttgtcactagaacatgtacttgggggtatactataaagtatggcactgtacttggggtatgctataaagtgtggcactgccactgggttccaaagacccataaattcaatgggtgtatctgcaggaaaccacagtacaatccacataaagggttcaggtaatgcttttcataggtagaaccaaagtgttctgaacaatcaatggccttacatttcaacacctaaccaaacccatgatgactttaacttccttcaagaaagaattgtatttttcccctagtttaatctacagcttactgtgggtgcttaacaaatgatgttgactgacaaacagaaaatgtttcctctttctccctggccccctttcaatctgttctctacactgtagctagagtgacattttggaaatataaatgtgataatgccatcttcctccctaccatccacactacactctttgcattactattttatcacttttacagtaaagacaaaaatacttgacatggtccagaaggttgtgcactgcctgaccccactcctctcaagtagggagttagagctccatgcttaaggcattctctcagtggcacatgctgtgccatctcctgcatcagaattctgttcctctgggctttacctgattaatacttttcctctgccttaatttggttaattctttctcactttttcagatttcagtttaataatcactttttattacgtcagctgacactattttaagttttcatagtatcatgcacccatccttcaaaatacataccacagttttaagcttcatttttttaaagtcaatatgccttctcactagaatatgaggtctatgaaagtaataattatttctgcactaccattttattgcttaagcctagtactctggtacacaaaacaatcagtacttgctgaataaagaaattaataaacaaatgaatgaatgaacaaatgaatgaatgagtgaatgtggttgcctatctggtcacattcacaaagtaatggaaagcaggagctttcttaagtcacatgtatcatactgacatgttcagtgacattaaacaatcaggaagcataagccatacgtgtttatggccatttaaatagagaacatgcaaaaaaaagtgaaaacagtccaatgtgggattttaatatacatgactctaaaatgcacgagacctggggatctggaaatcatgagaattataacttaatttcttattgattatccttgttattcttgtttttaaactggatagctatgaaattcactaattctttcaagttgctagggatctatgagtgctcttaagtagaaataatgttcaaggtcatttagatgagaccataacaacggtccaggcacttagatgaaatgaatataaaaaagctatgtaccctgtaagcattcatcactcaggaaaggtgacatttttgcttagttgagttctgaggctgacgctcagggtcaaagaacataagtgatgcataaattagttttgttctatcagccatttttacgtttttttttcccttgaatataacacctgaacctgaaaataatctcaacccgaatgaactggaaatcttatttgccagacgtcaagaaaaagggcttgggaacaaataaaagtgtttatgctcttacccaggttctgccactaacctggtcatcacacataacctttcctggattctctaacaatacataaataaataaaacttgctaggctcaaacacaaagccaggatgaaattgagctcattcaataaaaatattctggaaattcataggtgcataagttgtttcaaggcactcttggctggaggttgggggagagataatatttttattatcttattatagtcttactttttagtagttcttattgtattttaaacatgaaggcagttaaatggtgttaaaattttaaaagtattatagtttggaccagagataaactgaatttgtttaatatttacttgtctgtttttttccctaaattttctcttaatgaagtgaacttatttattttaaaattagtttttatgaagaacatggcagacaatgtacatactggctacaggcagagctttgttgatatttcatctgaatagaaatcatctatccctagccattaatacatgatctgtattgggagaatcatccattctcaattaattattcaatagtcacttgacacacatgaaatagggaaaataagcaaaatggagccaatccttctaggaagactgactctgcctttatcactccatctcccaattctgtgatactcaaaagaatccaatcttttgttttccttctacgtttcgtggtgatcttttgcactccattttcagttcaaattttcaaagtgactcaatgcttcagaagaatcctaatggatttgctattctgagttgaattatcctatgtaccaggcactacactgttcaattatgcatcttggtaattccaaattctttatcttatagaaagagctatccatttgcaaaataaaatgcatttcagatacatctaattctgcttctctttaacaaattactttttccactcttaactgttcctgattatgcatgatctctgaatccctacattaaaaatgcatagaaaaataaaaattttcatttaaaacaccctcccacacagtacaagctgtcattgtgtcatatttgtttcctaatttaaggaaggaagctatatttcatgggtccttcattaaattgccttctctgtattttaaagtggcattaggatacttaagacaattttcccataaaataatgttcattttaaaatttgtttctattaatcagtgcaaaagtatgcaacttcaaattacagtatggaaattatcatatctacctagcatattattcatgattcacaagtagatttgctagaagaaaaaaactatcttttttattttgtaaaacataactgtaaagcctgctctcataaccatagaaatgtactgttaaagctgaagtgctgtataggccatggaatacacagttttctataattacctaagccaaaatataatgaaaaacaaaaacccacatgaagacagagcgcaacaaaatagccctttctttcttcccctcctcctaatcctgtgaaggctacagaagtctcctaaagaccagttttttttcttcctaactaactctccttgctgtttaaacaattacaaatcttatcaagtcttcatttctcttaaagtcaagtgagagagaactgccaactctaataagatttacaaaggctagttccccttagcactgtcagcaaaaatcaaagacattatacaataaaacgcagccacacagagcttttgtccctatagctttcgaaatcagatttaataattcaccttttttcacccatttcagccacaaatgccatttatccatgtgttgattgccttgctttgacccataagctatctactttaaatcctgacatctcctacttagccactgattcgtctttttcacaccactcactcactttctgttagaggctttgctgtatttatacaacagtattttccttggtcattgtcatgtaacagcaccggcaaaacacactgaagaccgaattttatttctaaagaggagaaaagagaacttaggtatgacttttgtagtttaatgccacactgttttaagccccaagaaccacagaaattacaacttggcctccactacccagataaatgtcattagccgaatatccttagaaaatctcttgcaatcccttacatgcatccctgtttattagtctgcagaagcttcccaatccagcaacatctaaatttctctactactttatttctctttataaggcatttgttaattaagaaatcttatttaatctctaacatttttaaacgtcagctgacctcacacttcaagaaaccgcataaatgacaaaattttacttaaatttcacaaatgttggacttggatataacagtggaaaccaacattattccaaaaagcctcctgctaatgaagaaacgcttcacatcctctctttccctttttccacaacgaaaagcaggtttttaccgctctatctgcaaaaggcagagcactgcccgtgaaccctgtctttctcgtcctttaccacgagtgaccagaaccacgtggggattctcaaccacggccgtggtatacctctcctgtgcttcatttctcatcaaacacatgcccaatcttctagatgcttgtttgcatcttaagggcaaagtctgtgtgttacagatttagaagtggtagagacaagtacagtggtcatataggtgggccgcggcccaatatagggcccaacctgccaaagaacccgaggaataagaagaggccattgtatttgccacttggaagggagtagtgttggtagaaaggtctccagaaggaactcaaacttggatatgggggctgccaatccttaggaggatgtcaagggagaagctgtggaggtggtaaggtagagagtcccccagaaacaaggtccttccctcgaagcgaactgccacacgtttgccaagattaggaagaccccatgcaccagcccggtcccctcctccccgagccccgcccaggccccggcccccgtgggtcgggcgtcgggccttaccttggctgcagtccttgccgcggaagccggttcgcgagcagtcgcacacggcctggtcgtccaccacggagcacacacctccgttgaggcacaccccgccctcgccctcctcgcccgcctcgcacgggcttcccccgccgctgttgggcggctcatcgtccagcttcacctcgccgctgtccacgggcaggacctgcgaggagttgaccctcacgtcacgaatccaccccttgaagggctcccgctccctcaccgaggccagggtgagcttgagcgccgcggcgcgcagttccgggggcagccccccgacgaaaaggccgctgaacaccgtcatgtccctgcgcttggacttgacctccacccacttggcctccacctggtcgatgaagagcgtggtgttgcggaactggcggcggatgcgcacgctgtgccaggcgccgtcgttaaccggcgtgtcggccaggagcgtcgcaggctcagcgcagaagatggagaagctgagctgcaggcggccgccgcgcgtcagaatcagctccaggaagtcgcagaagccctcgtcgtcgaagtagagcacgaggccgcgggcgctgcgagtcttgagctggaagctcatctcgctctcgcagcaggcgttccacttggggaagcgcgtccattggccctcggcgcccggaaactccagcccgctgcccagctccgcccagcagcccaggagcagcagcgagaggcacagaagaaaacagcccccgcgctggagcagcgccgtccccatgctcggggctggggtgcggcgggggggtgccggggccgacagggtcaaaatggtcctggacaccgtgacgaagaaataagggtcccgagagacagaaaggtaaggggaaaggcgggagtgagagggatgtgccctcctttatctagttctttttttcttcttcttcttccaataaccccgccctctctccctgtagtcctcttccaactggaaaacgttgaccccagtggtacagggtagccacagaacttccagaccaaagggaggatgcactttggagacaacgttctggaaaaggcttcaacaaaagatcaagggaaagcactgacccatttgagtctgattaactaatttaagagtatctgcagtgtcaacagatacttaactcctcaaatcccattatctgccaggttccaccagtggtaccaggccaaaaggaagcagtgagagtcagtaaaaagaaaacacttttctcaagaaagtacaggaagccagcagtgagccagtatccttggatgcttgtgaatgcctcaagtctgtctccttcagatgtggtgtcttacagcagaacggagaaagggatgcttgcctctttagggcaccatttcttaacccgaggatagcttcaaaggcctgcttcttctgtcatagcatgggcttcagcaccgctgcagccaaagcctaattccttgtgcgtggtctcacaagttggattttacttctcttttcagccacggcaacagtaggactcaaacccagcagttgcgaaatagccagaagctgttagatgtggaaatcgcaacagctcctcttcttttctctctgcctctgcagggccaagctaagatgccagcacatcaattggttgtgtgttggtgatgcattttggttttatcttgtcttttttaaggactcagacatctgcagagaattaaagtcaaaattaaggtctaaagtcaatatagtattatataaatcattattcagctcataacacaagtgtagacctggtcctattagtaaggcaaagagttaaccttcttgtatggagcttttgttatcctcactacaagtaagtcctaacattttctaatagttaatatgacacttttacagtcagccatgacacccttgtagtttattataactgttagttggtaacccgaagttttaaagagaaatttgattatggttatctttttcttttcgcaagatagtttaatttttaaaatatgtgaggggagaacaaatgcttttaaggatttctacctatgttgtgtgcttgttctgtggacagtaaaaatacaacctattcaaatctcagttaagagattttacaattggcaaattagattaaactgttggcaggaagctgccagcttagacttgtatagcattcctgccattttatttttcttagaaggaatattgatggtttcttgatagtctcttgcaaaatttcacacaagtatagttctcctttatattaatgaataatctgttgtaaaagaaaaccactaattggagccagatttatgtttttggcattgtctcaattgccctaatattaacttctctaaaggtgcataaagtatttaatattttgcctaaaagtgtagatctaactcctcctgaagtctgtatcttgctgtcagccctcacaatttgtgtggtcagaagagctgttggcatgtatgtcatctcagctgcagtggctccaggatgctagaatttaaaaccgtacctttgaatcactcactatactattaaatcacttctctttattcaactctaatctgacaggttcttgaaatggtacagaaatcataatcactgatttttttcctaagtcattttttaaccaaaaaattactcttaccttttgaaaaaaattacaaatgtataatctgttcatgtcaaggaagtgcattatttttctcactatttcttatattccccacctcttgcaaacacacacactgcaatatatatacaccatacacacatgcacacacacaccccaaatttattgtctggatgtagaagctcactacccaattaacactttttttcccttacaagctgaaactagcagtaatttatggcaccgcattgtgctgctgcttctccatggggggagctgagagcatttctcttcagtacagagcaatccccacaggtgtcagctgagagccaccaagctagggtatcccacttcaagttcctcccagatgaaattgatgactggttctctctctttcaacacacacacacacacacacacacacacacacacacagtgtgggtgtgcgcacatacacactgcccactagcaaaaggaaataaaaatctcagttgcttatttattatggctgatacattccacaccatcagcaatcaccagtcatatcttgtcttctcctatatcaaacccgaggaaagaggctcgtcaaatcatctgaaatagcatattattcagtatactttcatattttaagtggactcaggaatctgctaaattttcagtcatttgcaaaataaatctggaatatcatgatcaagagtagtgctttgaaccctttctcaagctcatgtgttagaaaacctttttttttttcttgtgtgtgtaactctgttggagccaattattgtattaattaatgttacattgatcacataaccttttttctcccgtccctcctgccctcctccactaatgcacaccttgacaattttaagggatggtggaagagagaaaaaccgtagagcaatatatatgtacatatagatatatatacattcttatcacagggaggttaactggttttcccagttcttggaggaagctcattgtatgtgagcgagtatctgtatttatatggagaaaagaggattctctctaggtgccagaaagacctggccagttcacaaattagaggatgaaataaagggatctgaaaaacatccttactgcagccaaaagaagaagcgctctaattcaaaagcagactaacagcatcattaatcttttctttcatttctagaatcaaattcatcccaagtcactaggaggatcaatacagtacgctcatcggctgcagttgcatattttaatgtttctgatatcacacacacatacacacctacacctttccatgcacccttcaatatatatatatatcttcataaagaacatgaaatctctgagagaaattttagaagtgcttattatttcacccctggcttttgcaaagtctctcaataccaatgcacagccaaaattctctctggctttcccgcccagtctctaagctccatctctaataccagtgcagtttcttggagctcggggtctactgcacaaattaacgatgggcacagtgtggggctgatgaggtagggaaggaaatatatggagagatattttattgctttgatatctagcctgtctcttattttctttcttttgctaatacatcactgcattcagcctttaagttactaccccagttccaccatctcttcttgccatctatttaaaaggcttcatgcaaaacaaccaagatctacactcctccaccctcccaccacccatctttccctgtgtatttgtggcagatcctggctcagttacaatggggaaagatatccttcttcagcttgcctcgccccatcccctccccccaacccaaattgagcttctttacctgcccggttattcccctcagctcgagccagagcctgaagcatgcatcggtcaaagcgaatttcctgaggtctatggataaggcgactgctgctgccttttcagaggcgtcaggcttgagcgtctatctccaggagtgcgggaggggagaacaggcaacggaggggagcaggaggaggaggaggaggagaaggaggaggagggggaggagagggaaagagctgggaaggaaaaggcggtggtggagcctgagaaggctgggttacgtgacgccgggtgctgtccttctgaaagagaagggcggagctgagctctccgcagtaccatggagagcggcgggcccgtcctttggctggggaatgggtgggctcggcccgtggtcgcagcccctccaggtctggatgctgcggagcgaggtgcttttacctttgcatcgtccccttgcagggggagcctgatcctgggggcggggaccttccgcaagcgcttctaacttgtcaccaccctctcttccccatcggaaagaaagaaagagagagagagagagagagagagag

SEQ ID NO: 2409 - DNA, 1114033 bp, Homo sapiens; identical to SEQ ID NO: 2408
